United States Patent 7,745,391 (HUMAN THROMBOSPONDIN POLYPEPTIDE) - sequence listing, part 47

SEQ ID NO: 123406 - DNA, 5156 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123407 - DNA, 5095 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123408 - DNA, 487 bp, Homo sapiens
catgctttctgccatggtcagctgtggcttttattttaaatttaatttgctcaaccagacacacagtgtagcagacgctattaccgtatttcagtttttggtgctgtagtgagactttgaaattctaggaattgagtagataacacaagtgtgatgtgggaaaggtccctgggaaacaacagtgattctattaggctggtgcacaaataattgtgggttttgccattactgttgtacccacataatagctcagtgcatgcaatttacaaagtaataagtgaaatgctccccatagttgactataacatttcctcatttttctctgaatttgctttttaaaaaactcttccccttgccattcccttccccattccagattgtaactgcttctttccagccgcatccgaagaaggggactttccatgtaggtgttattctcagaaaaggccagaaaagaccaggtcatggtggggatgatttgctccaa

SEQ ID NO: 123409 - DNA, 1145 bp, Homo sapiens
gcctctgcctcctgggctcaagctatcctctctcagcctcccatcccaagtagttgggactacaggtgcatgccaccatgctgagctaatttttttttattatttttagagacgggggtcttgctttgttgcccagactcgtctcaaactcctgtgctcaagcaatcctcctgcctcagactcccaaactgctgggattacaggcttgaaccacgagtgtgttttaaattttgatagtgcataccaaattgtcttccagaggccatgccggtttaagttcacaagttttcagagtccctgtttcctcacacccttgccaacacagcgtgttatcaaatgttttgttctttgccaatctgataggtggttttaatttgcattcctcttactgtatttcattgattctaagatgtcactgattctaagatgcatcctgatttcagaagttcacatgtaaaaatgtggctgggtgtggtagctcacgcctgtaatcccagcactttgggcggatcacgaggtcaggaattcaagaccagcctggccaacatagtgaaaccccgtctctaccaaaaatacaaaagaaataattagctgggtgtggtggcgggtgcctgtaatcccagctacttgggaggctgaggcaggagaattgcttgaacccaggaggcggaggttgcagtgaactgagatcgcgccactgaactccagcctgggcgacacagcgagactctgtctccaaaaaaaacaaaaaaaaagtaaaaacgtatagcttcaaatcactgaaatacaatatgttttgtgagattgggtatcttactgtgagtttaaaatgcatttgcatttcctcatctgttcatgtccttttcctatttttcttggaagggagggtagcattggttaagagtgtagggttcaaatcccagttctgccacttacaagcttgtgactttgggcaagttacttaaccgttctgtgtctcagtttcctcacctgcaaaatgggaataataatggtacctacctcataggataggtgtgaagattaaatacattattatatgcaaaataccatgttcctggaatatggcaaatgctcaataaatatttgctgtaactgtcatctttgagttattttttcttaatgag

SEQ ID NO: 123410 - DNA, 742 bp, Homo sapiens
gaaatctgttttcccaacttttgtttcattcatctgcactgtatgttttcttcccctttaagtattttatctctctgctgcctttaggtttataggcttttaaaaaaatcatcatgcagcacttgtctttcaagttgcctgcttggccctcttccaagtgtactctccttccttttgtttaaaaaataaataaataaaggccgggtgcagtggctcatgcctgtaatcccagcactttgggaggccgagacgggcggatcacgaggtcaggagattgagaccatgctggctaacacggtgaaacgctgtctctactaaaaatacaaaaaaaattagccgggtgtggtggcaggcgcctgtagtcccagctactcaagaggctgaggcaggagaatggcatgaacccaggaggcggagcttgcagtgagctgagatcgcgccactgcactctagcctgggtgacagaggaagactctatctcaaaaacaaaaacaaaactcatcatgcgatttttatttggaaaaaaattttcctttatgtatcctattcaacctaagccaatatgtcatccctcaaagggaactttgagcattcgctctgcactgtagaactcaggctggcccagcatgctgtttcagacagctttttctccatttccactctcacttcacagtgcagtttagattgctacccagtacttcccaaagcacagcgccgtcccaaagcataagcgatcgtctag

SEQ ID NO: 123411 - DNA, 741 bp, Homo sapiens
gaaatctgttttcccaacttttgtttcattcatctgcactgtatgttttcttcccctttaagtattttatctctctgctgcctttaggtttataggcttttaaaaaaatcatcatgcagcacttgtctttcaagttgcctgcttggccctcttccaagtgtactctccttccttttgtttaaaaaataaataaataaaggccgggtgcagtggctcatgcctgtaatcccagcactttgggaggccgagacgggcggatcacgaggtcaggagattgagaccatgctggctaacacggtgaaacgctgtctctactaaaaatacaaaaaaaattagccgggtgtggtggcaggcgcctgtagtcccagctactcaagaggctgaggcaggagaatggcatgaacccaggaggcggagcttgcagtgagctgagatcgcgccactgcactctagcctgggtgacagaggaagactctatctcaaaaacaaaaacaaaactcatcatgcgatttttatttggaaaaaaattttcctttatgtatcctattcaacctaagccaatatgtcatccctcaaagggaactttgagcattcgctctgcactgtagaactcaggctggcccagcatgctgtttcagacagctttttctccatttccactctcacttcacagtgcagtttagattgctacccagtacttcccaaagcaagtgtgtttttcttttcttataccttttggcc

SEQ ID NO: 123412 - DNA, 470 bp, Homo sapiens
accctttctcttcagtctctttctcttgactttcccctagatcttgcccctagaccatcactcagctggttcctcttcattgcctccatcttagttcaaatgtttcttctttggacagtttggagttttgctccccctcttccctgccattctatagtaggttttttttttcttaaaatagtgcatatcatctgggtgcggtggctcatgcctataatcccagcactttgggaggctgagggggtgtatcacgaggttaggagataaagaccatcctggccaacatggtaaaaccctgtctctactaaaaatacaaaaaaattacctgggtacggtgatgcgtgcctgtaatcccagctactcgggaggctgaggcatgagaatcgcttggagccgggaggcagaggttgcagtgagcagagatcatgccactgcactccagtctggtgacagagtgagactccgtctca

SEQ ID NO: 123413 - DNA, 359 bp, Homo sapiens
aataatgtaacaaccttaggatatgtaacaggaaggaatttttatgaaattcatttccagaattcaaagaagacagtttgtagactgagtaaaaattataagcttcagtggttaacagtgtagctttctaaactggtttctgttacagtatatttacttgaagcaattgggggggtactttcttaaaacagtgttttgccttctcttaaaacactattccttctagactgtgtttttgctgctgaatttaaggtgactttcatttttctaaaaaagttacaccaaaagcacactgcaccttcttcattaaggtgaaatcatatgcctttagcttgaggacagtctctttgaaactgctt

SEQ ID NO: 123414 - DNA, 418 bp, Homo sapiens
agaacatttctgattcacgggaggaggtcaaaatatcaacacaaataggagtctgaaagacgttgattccaactctaatggatgactttgaagggttcaggatttcagtggaggaagtaactggaagtgtggtggaaataggaaaagacatggaatctgaagatgtgactgaattactgtaacctcacgatgaaacttcaacagatgaggagtttgaggagttgctccctgcttttttggagacagggtcttactctgttacctaggctgaaatgcagtggcgtaccacagctcactgaggcctcaaccacccacgctcaagcaatcctcctgcctcagcttcctgaggagctgggactacaggcatgtgccaccacacctggctaatttttgtattttttgtagagatggggtttca

SEQ ID NO: 123415 - DNA, 427 bp, Homo sapiens
tttgcccccttccccatgcacttgcagaattcttgaaagtagttatgttcctaattcaccttggtggtttccaatgctccatgcatacccaacaaatatttggagactagaaagtgaatatactcagagcacagagtcatttactgaacatgaatgaacagattaattgctctgttttctcaaatgtctttcttttctcatgtctttcctctcaaaagatgattaagaggacatgatctctcaagttcttaggagagaaaaattaaacaagtcagaattgctcactaatttcaaggcttattcaagcttgggctgcccccctgggagacattatagtggccctgagggaggcggcgcagctgctgctccagcctgccactcatctctgtattctgtggagacagaggccatgccggggccccacaag

SEQ ID NO: 123416 - DNA, 398 bp, Homo sapiens
cctgcctggtcatccacaggggagtgccagctcccacccccagccacatactgttctcagcttctgagtggctgggctgtcccagagggccatgctgggcctgagtgctgtccttgggcatatgcagatggtgttgtatccagggggttttcagggaagctttagcactttcatattaaaacaaaaaatgttggaatctccattaaatagtcaagtcttagggatagtagtaaaaacatggctgtacatggctggccaggcacagtggctcacgcctataatcctagcactttgggaggctgaggtgggagggttggccaagagcttgagaccagcctggtcaacatagcaagacccgtctctacttgatttttttttttaaagtacatggcaaaggg

SEQ ID NO: 123417 - DNA, 261 bp, Homo sapiens
gttctccttccaagactggtgctgggacaaacaaggtgttgaacagtacctgacagggccacactcctaatttcaactcaaattttgccagagaagctggactttttcaggctaccttctagcacatcctgtacttgtttcttcatgcactggcctctagcacctgccctctctaaggttacagatgattttctcttcgtttattcagtggctttcccttaattcacataaagttaatcactttaaagtgagcagttctgt

SEQ ID NO: 123418 - DNA, 216 bp, Homo sapiens
aaaagttacagtgaaatcctttctagtttctgttttctttagaatcttaggatttaaatgcagtaaaatttaaatcctaagattctaaagaaaacagaaactagaaaagttacagtgaaatcctttctttctttttttctgtatttgttgggttttgtgtgtgtgtgtgttttttttgttttgatggaataattaagactgttttctgattttgtt

SEQ ID NO: 123419 - DNA, 350 bp, Homo sapiens
atggccacacaggcagggaataactgatgcacagaattcagccgggccgcactcagcaccgcgctctccagatgcaaacggacacacgcaaaccggccccagactcgagaattcgtccgcagagatgcatccactacaactcaaacatcattccaccttaaaaaccctgcttaatgacatcagccctgctctgccggttttgtggcctctttgacacaggccgagatcctcccttctctggcctccccgctggctgccagatctcaccaagccacaagttacagacgcagggtgcaactgaggaacatgatcagtgaaggaagaaataaggaagggggagctttacgagt

SEQ ID NO: 123420 - DNA, 316 bp, Homo sapiens
ccggcagccgccccgcgaagagtgggacagacactcagcactgacacagaggccacggcagccaccccatgaagagtgggacagacactcagcactgacacagaggccacagcagccaccccatgaagagtgggacggacactcagcactgacacggaggcccaggcagccgccccgtgaagagtggggcactcagcactgacacggaggccacagcagccaccccgcgaagagtgggacagacactcagcactgacacagaggccacagcagccacccgatgaagagtgggacggacactcagcactgacacaga

SEQ ID NO: 123421 - DNA, 483 bp, Homo sapiens
ggctaccctgctcccatctctgcttattactatgtcatgttttccataagactttcctcatatccctccaagtagactaacttccctctttcctgacttaaggcattcttgattatgtttatattctagaacttctcatattttgtcatgtattatagttagctatatacagttaagtcttagaccccactagattaattaaaggctgatcagaaggaattgtctagagctcagctgtcatgacctattgttaaatatattcccccaacaaccctagaaaggaattctgcatggtttagataatatgtttgattgattaacctcatcttccatctgtgaaacatgcttcccgcatttttcttttttaattctcatttgacaaagaaggctggctctaaaaagaacagctcaggctatgcccaaaaagtcaaatgattactaacaagcaagttacttaaaaaacagtatccggtatttgtgaaa

SEQ ID NO: 123422 - DNA, 240 bp, Homo sapiens
ggatagaagtgtccagcatcaagagaaacagacatattggcagccagtattttacaaagcacattacagggaagcaaagatttaacaacttgaaattattcatacttaatgaataaaactggcattttacatgtatgaagaccaagaaaacacagaagtgacaaatccccacataacaaaaacagaaccatatggagctaaagaaaaggatcaggagaactcagtattttagttcatact

SEQ ID NO: 123423 - DNA, 790 bp, Homo sapiens
gtggggagaggcaataacttaatcagaaactttgtacgtggcctagtaaaacagaaatacagagtccacatctctcaacatctcactccttcaaatactttttgccaccattccaagtagtctatgtttaaaatacatttaaaaatagaatacgtatcatatattatcctgaaaattaaaataatacgtaggcaaagttcttggtgcagtattagcaattcttgatatcattattattatttattgtaactatagttaactatgtattagctgcatagtgatcattttgggtgagattaataatttgactgaaaaccacctcaggctcttctttattcaggtctatccttcattccagcacaataaccacggggatttttaaaaaagctaacatccaagttagccttaatattttacatcttatattacatttcaccccaatgtacccgcttaaggtctattttttaaaaggccatgacaacgacagtctcttgtttgttagagggagaagttctgacatggcttattcatatatccattctcacctgagaagatagttttcccacagtctggttatataacagtaaatattttattaactgtagctatatagaacccataatggtgaattacaacccttgttatttttttcaaaactggtgtttcaagagatgattatactatcacacacacaaaaatgacctgcaatgttcaagagtgagccattgaacagcaacagagaggagttacacagaaaaataaacaagcaaacaaataagcaaataaacaa

SEQ ID NO: 123424 - DNA, 209 bp, Homo sapiens
acagctacaagtatcaaagaagaataaagaatcaatagagtaaaaaggcatcctatggaatgggagaaaatatctgcaaaccatgttatctgataaggggctaatatccaaaatatataaggaactgctacaacagtggcaaaaaaaccccaaataacccactgaaaaaatagaccaaagactcgaataggtatttctccaaaaaaaaa

SEQ ID NO: 123425 - DNA, 366 bp, Homo sapiens
gccattgcttttggtgttttagtcatgaagtctttgcccatgcctatatcctgaatggtattgcctaggttttcttctagggtttttatggttttaggtcttacgtttaagtctttaatccatcttgagtaaatttttgtataaggtgtaaggaagggatccattttcagctttctgcatatggctagccagttttcccaacaccgtttattaaatagggaatcctttccccattgcttgtttttgtcaggtttgtcaaagatcagatggtggtagatgtgtggcgttatttctgaggcctctgttctgttccattggttccaatggtactgttccaatggtactgtaccagtaccattatagttt

SEQ ID NO: 123426 - DNA, 803 bp, Homo sapiens
ctacaggtagtattatactcaagagtgaaagactgaaagctttcctcccaagatcatgaacaaggcaagaatgcacacttttgcccttttcttgtacacttaaaattctagtcagggtcatcagacaatgaagatatataaaaggcatccaagttgaaaagaaaaaaaagaaaaaaaaaatggaaattatctctcttcataaagatgatgatattataaaaatgctttaaactgcagaaaaaccatattagagctaatgaacaatattcagcaagccccacaggatagaacattaaatcgtaaaaatcagttatagttgtgtacactagcaatgaacaatctgaaaattgaattaagaaagcaattccatttataatagcatcaaaataaatcatattttaaggagaatatttcactaaacagatgaaagacttgtacattgaaaaatcacaaaatattggagaagaacttaaagattacctggatttttaaaaaggacatcctgtgggtaatgagttagaagactaaatatttataatatggcaatactagccatagagatctacagatttaatgtaatcctaattattattcccatgagcatttatttttgggaaaaagaaagagcaaattctaaagatcctattaaattgcaagagatctgagtaaccaaactttgagtaagaaaaaccaaggtggaagacacacttctagatttcaaaatttactagaaaatctagagtaatcaaagcaggctgatgatcaaataagaatacacacagtgattaatggaagagatgaag

SEQ ID NO: 123427 - DNA, 400 bp, Homo sapiens
agttcagaatgaagagagaattgtttcaaccacctgttctgcatgagagcctttcaccattttctgtgtgtttgtgaaatgaccattctgaagttcagatccacatataagactcattcaaaatgatcttcctcaatggaaaccgggggtgagatttgaacctgagagagacagtctgctctggttgatgaacagcatagctctggacccagactgcctgggtttacatctcagctctgccacttctaactttgtgattcaggcaaattatttaactcccagtttttttatctgtaacatggggataataacagcataagagcactagccacactggatggctataagattgaaatcaattactatgtgtaaaaatcttagaatagggcctggcataaag

SEQ ID NO: 123428 - DNA, 307 bp, Homo sapiens
tagggtccaggtgcttttacttgaaagggtttcagacatcaggaatatttatcttttgtctattcttacaacgttattccttaagaacttaccagattgatgactcatcagttctactcatagagaaataaaaatatataaatacactaatattgtacacaagtgtgtgcagcagcattacttatagtagccaaaaagtggaaacaacccaaatgtccatcagctgatgaatggataaataaaatatggtatgtacatacaatggaatattatttagcaataaaaagagatgatgtactgattcctg

SEQ ID NO: 123429 - DNA, 652 bp, Homo sapiens
cacccggaactccagctggcccgcaagggccgcacgcagccccggttcctgctcgtgcctctccctccacacctccctgcaagctgagggagtgggctccagccttggccagcccagaaaggggctcccacagtgcagtgggggcgctgaagggctcctcaaatgccgccaaagtgggagcccaggcaggggaggtgccgagagcaagtgagggctctgacgactgccagcatgctgtcacctctcagtatgactaaaagttgatgaaactgatttttatagaagcttactatttagaacttaatgatacataacactagtgtactttgaggaaatttcattgaattgttgggcacaactgttgttcttgtatacttagcactttcccctttgttgtgaagacagagcccttctcttgctttaggacactatactttgcatcgatccttcacccacagtaagaatatcgataatattgccttgcttatattaccataagtgaccaacactggcctatctgtttatcacctactcctggaaactgtgattgattcagaactaacaggtataccaaccagggtgattagaatcctattcttggtaattgacgtaatgtcaacactaaatacgatacaaacctaaagcaactgtg

SEQ ID NO: 123430 - DNA, 417 bp, Homo sapiens
ggttttggtgaggagatttcccaccccagccaactttctttgggcacctagcatgcataaaaaatagtcctttgattttgataagctattgaatttggaggttttattttactgcagcctaacttagactaacctgaataatacattatctaccataatcttttcatcatcaaaagagaaattcacagcagtgcccagtctcaggtgaagatttctgtcagagagacaattcatacttactgtgtaataaatttctttttcaagcttagagaaagagatgaagaagagagactgccaatggctctgtggagatacagctaaggaccactgtgaaatttttgtttgtaaaatgcttctagtgaaatgttcagagttttaaccttttgtattcacagatataaatcaattttctggctt

SEQ ID NO: 123431 - DNA, 319 bp, Homo sapiens
gtccagtccatcacgttagcaatgcaatagaacacgataactaagcaatgatgcttgtttaagcataatggcagtcagaaagaaatcacaattttagggttggaaaatatctccaatgccccaaaggaaagatgatcttatgataaccacatttcttccggatgccttcccctcaataaaaataaagttgcaaccatttaaaataatgcaaaacagtatgatttaagtggaatacaaagtggggactctgactgtataatccttggttactgactaggagaagattctgcataattatgcaaacccttcaaaatactgg

SEQ ID NO: 123432 - DNA, 304 bp, Homo sapiens
cagctatttgacagggaggcactattcttggatgtccatctgcacactagattcatgagtgttggggattacctgggcatcccaaaccatattacagtgaattatgttattgttatttatttaacatgtacatatattttcaaaatatatagaaaatgtcagaatcggaaaaaaaatcatagggacttaggcagttattggagcttgctttaaaaacccatatcagtgttgaccagtatctgggtttcaagagaattgtcaggaaaagcagtcttaggtcaggagtggtgctcacacccataat

SEQ ID NO: 123433 - DNA, 589 bp, Homo sapiens
tggcagtggtaatggacagagctgatgttgagacccggaatcctcgcattgcactcacgtgtcaagtttgctgaaagtgaagcccacctgcctttctgaacgctgagattagacctataatttaaactcttaaaatttttcatatttataaagtaacttttgtttttcataaaacatattgttgatctttctaatttaagaaaaagatatttctggtggtggttaactgtccacttaatttctcagtcagccgggggtgggtagtccttctggccttagcttaattactaaccttgaaaatttttattgtttttagggcctctgtctgtttcagtattgttgctgttgtatcatatgataatgcagcaaacacccctgtaactaccaccaggttaaggactagaacattgctgtgtctggaagctctctgcatcctacccaattacaaccccttctcttctcccttgaggtagccactaacctggcttttgtgataatcatcccctcattttctttacattttcctgaatgacatgttgtttacttttacctgtttatgaactttattaagcaactggctcatgatcat

SEQ ID NO: 123434 - DNA, 751 bp, Homo sapiens
tcagtgccaaaagcaatgctcatcagtagcatttgacatatttgagcatttattctttcttgaagctcttcatttggtttctagaacaactctctgtcttgagaaaagtgactctcctcctatcacttagtctccttgaggatctttctcatctccatgacctccatttgagggccccagaggtgattctaggacctcttcgccatacccactccctcctttggttgcatcacccatcttactattgtcaatgcctactgctatgcttgactcccaaatttaaacctccagtgcagatggctttcctgaacaccatactctatattcagctgcctaaccaatatctccacttataagtctaataggcatctcaaacttaacatgatgaaaactaaagtgatattttcaccagacctgctcctctgggttactttttcccatttcagtaaatgacaattccattttccacttgtccagaagaaaagtctttctctttctcacatcccacatccaacacatcagcaaatcatgtcagcttcttagcacctctctcttcttacctattccacatgtgcaccttaatgcaagccacaatcatcttttccctgggccattccagtagcttcctctcctgcttccacccttgctgcaccatcatttaatctccacatgggtagccagagccatgcttttaacacatgaggcagagtatgtccgtcctttacgcacaactcatccagtagctccccat

SEQ ID NO: 123435 - DNA, 317 bp, Homo sapiens
ccttggcttatagatgcactgtcagtccagtctctgcctccatcatcatgaggcaaccccacccccatgcctgtgtatcctgtcgcgcacgaccttcctgtgtgtgtgtgcatttgtgtgtgtacatgtgtgcacgcatgcatgtgtgtgcacctgtgtgttctcattcccctcctcttctaaggacaccagtcattggatcggggcccacctcttaccttcatcacatctgcaaagaccttatttccaactaaggccacattcccaggtcctgggggcagggactggtcgacgcggccgcgaatttagtagtagta

SEQ ID NO: 123436 - DNA, 761 bp, Homo sapiens
gcagggaggagcaaagatggccgaataggaacagctccggtctacagctcccagcgtgagcgatggagaagacggtgatttctgcatttccatctgagatatttctgcagccaccccaaccttcagcaaccaccacccggatcagtcagcagccatcaacgttgaggcaagaccctcctccagcaaaaagattacaactcaatgaagactcagatgattattagcatttttattagtaatatattaataaatattgtgttttattaatagcaataaagtgtttttaattaagtgatctggaactgaacctgtaatatgtccaaggtatgcttctaatcagccaaaatgataaaccatcagattgaaaaaacttccagagttaatatattaaaagagtttcactcttgttgcccagtctggagtgcaatggcataaccttggctgactgcaacttatgcctcccaggttcaagcaattctcctgtctcagcctcccgagtagctgggattacaggcgtctgccaccacacctggctaattttttgtatttttagtagagatggggtttcaccatgttggccaggttggtctcgaactcctaatatcaggtgatccacccgcctcggcctcccaaagtgctgggattacaagtgtgagccaccatgcccagcttggtcattttcttactgattttcaaatgctctctctgtattagaaagactagcacctgcctatgttataactagcgaatatttttccaag

SEQ ID NO: 123437 - DNA, 417 bp, Homo sapiens
tatctgagagtggtaattgatgtgcaagcaattcaaagtggatggcacatgtatatgtgtatgtttcatgatatatatatatgtgcgctgtgtggtgtcgagccctgaattgtgaaggcagagtgagagaggtatttatagaggatccgtgtcgctctcctgcaaaacctgtgtcacgcggttgcccagcctccctggaatgagcatcagtcaggtgtattatcatgcaatgaccttgggactgttccttctggtctaaagcactgagcacctgagtcatgagggtgtccaatgagcagggaggtcctcatgggctggagcatcagggcaggggccatgcagagcagacgcacctggagcctgacctcgaaccttcatatggatccccaagaactagcacatggggagagagaccct

SEQ ID NO: 123438 - DNA, 525 bp, Homo sapiens
aggcagggagggaggcctggaggcccggacgcggccgttagatggcttcagagtgtggcttcctgacccttgcagctcacgatacgatcgcccaatggagcaaagaagaacaccccagccaccccctggaagctactcccattcccctcaaacggctggcacccaaagtggaccgcaggcttcacagctggggctctagggccaggcaggcccaaagcagcatctcagatttctgtccttgctggagtttgaccttgggcaagacacacagctgtcctgaagctaacgagtcttgtttctaaactggggtaataatggcacccacctggcggttggtggaaaaggctgaataggatgtgtgctcccagtgctcgggccagagcctgccacttagcatttgctcaataaataagagaaagactggtgggaggaggagagttagagcaccaccctccctgaaacagaggtgcagaatggccaggagtgacaggcaccacttgcacagctcaggacacacacccagag

SEQ ID NO: 123439 - DNA, 366 bp, Homo sapiens
cccgtcattcacctcactgcatctcaccaggtaggcatcgtatcatctcacgtcatcacgagaagaacgcacccctgctcagactgaatgggaatactgataaacacgaaaacatgctcaacttctctaataatcaaagaaatacatattaaaatgagatgccactgtttcttctatcactgggactgaaatggaaagtattcatcatatcctttgctggtgagaaagccggacgaagaaagatcagagagagcgccacccccattccccacagcgttccagctctggccctgctctgtggctgcccctcaagcctgaaaatcacctcatattcttacaataaatcccttctcctctcttgcttcc

SEQ ID NO: 123440 - DNA, 309 bp, Homo sapiens
agaggcgtaccaccatgcccggctaattttttagtagaggcagggtttcaccatgttgatcaggctggttaagagcaggattttcatcaaggccttgaataatttcctttatcttttcatagttgactaccttaagagtggctttattcatgcctgccaggaggcatgttatcttatgatcttgcctttacctgtctggggaagttggctgataatcccactgggatcagttctggggacaacgaaggccccaactgggttatgagctgcatcttggtggtggagagcatcagtgtgagcctgagcagc

SEQ ID NO: 123441 - DNA, 494 bp, Homo sapiens
aactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcaggtatgccctccc

SEQ ID NO: 123442 - DNA, 886 bp, Homo sapiens
  misc_feature (675)..(675): n is a, c, g, or t
  misc_feature (678)..(678): n is a, c, g, or t
  misc_feature (682)..(682): n is a, c, g, or t
  misc_feature (687)..(688): n is a, c, g, or t
  misc_feature (690)..(690): n is a, c, g, or t
  misc_feature (692)..(694): n is a, c, g, or t
  misc_feature (697)..(697): n is a, c, g, or t
  misc_feature (703)..(703): n is a, c, g, or t
  misc_feature (719)..(719): n is a, c, g, or t
  misc_feature (726)..(726): n is a, c, g, or t
  misc_feature (876)..(876): n is a, c, g, or t
agtgggggctcacgtctgtaatcctagcattttgggaggccaaggctggtagaccgcgaggtcaggagttcgagaccagcctgaccaacatggtgaaaccccatctctactaaaaatacaaaaattagccaggcatggtggcgcatgcctgtaatcccagctacatgggaggctaaggcaggagaatcgcttgaacccgggagatggaggttgcagtgagccgagattgcgtcactgcattccagcctgggtgacagagcaagactccgtcccccaaaaaataaaataaaataaaaataaaaataaaataaataggaaaaataacaagttgagaaggggagggcactaggtgtgtgagcaagtaattggcagggaagaaggaagtaggagttcagttgtagacatagtgaatttgcagtatttgtatgacagcaaaaacacaagatttttagttttaaagacaaaaacagaagcgaagaagtaaaatggaaatcacataatgtacttaatgggtagatcctaaaactactactataagccagtggctgatgcctgtaatcccagcactttgggaggcaaggaaggaggatcacttgagggccaggagttcaaggccagcctgggtaatatagcaagaacccatctcttaaaaaatactaagtcaaaaaaaccacnttnggtnacccnntntnnnganagtggnccgaaatacgcggggntaccttngggcgccaaggcatcggggaccgggagccccctaaaggaagcgggggggggcgaaaagggcaagtaagaacccaccccaggtaaccgccaaaaatgcaaaaccgggccataggggagaccccgcgcaaacccgcgtgccgcctctagtgnccccgcgcct

SEQ ID NO: 123443 - DNA, 631 bp, Homo sapiens
gaacaagtggggagaaatcttaacatcatgcacaagggcaacgggtcccagtaacatctttaacgttatgggccttagtcaggactgctttgtccccactctacacagaagagcctaaaaagggaagggaggaagaaccatcatctaccttaccacctcctccttctccctcagccccgcgttaccgagtaaaggtgccacagaggagacaaatattttccctgagccctctctcccaatatattggaaaaaatacaagggatacactactgttatgggaccctgtcttagtcaagtggaattagaagggagctcttgacctgcccagtgatgcaagatcaacaagacaatcagtaagaaacgtacaaacattaagaagagcctattcagaaaagacagtcttccagttaccttataaaggcaaggaagaactggtagtttgaaataaaataatttcaaaaagtgctgtaccccctgagtattctgctgtaataaggatgaaatcccataagtcaattttttctcgggattgtgaagttcactgcacacaaccagccttattttacatctctttcttttatttcaaccatctggggactgggcagaagtcatggtcagaggggcacatatg

SEQ ID NO: 123444 - DNA, 708 bp, Homo sapiens
aggggcagaacaagctggggtgtggagtcaggggtcagggcacagacagcacctcttgtcttgcagagagaatgctagcaatttgcaagttacttgaaaaggtttgtgattttccaacgccctgagtaattctagccaaaatgcgtgactcgcctcacactagatgcttgctgtaattgtgtctctgtattaaactgaccgttctttggagcttcagaatggaccaggaggaaaaggtaaataccaacctcgctacaacctcagaggcatcaacgccctcctgctacagacgcatctgttctcgcctggctcctgccggctgccctgggagaggccacaaaatgccctccacggagacaaggcctgagaaccttcgggacgcccgctgccgctcactgtgttgaagaactgcccgttccgcaccctgggccctacacacacggctctgcggaggacgaggaagtgccgtcaggtgagacttcaccgtgaaatatcttctgagacacaacaatctccctgaattaaaactacagactctaatttataaaaactgtctgtttcaaaagctccaagtgtttacattctccatcattccttcttctaatttattttaggaaataatgcagagtactcacaaaaatttatatagaaagatgttcattgcagaattcattataataaaaacctttaaatgctctgagtgcccag

SEQ ID NO: 123445 - DNA, 397 bp, Homo sapiens
catatattataaggtttttggaaacatttacatttggtctcacatattcacagaagcaatctgactaaaatctgagatttgtaagtataagtagcaaaattttaacccaggggactttaaaatgttttctttgcaccgatttgtattcattcagtaaatgtattacatgacttctgtagggttccgatgtctaatagctgaggtaacaaagaaaataagtcacagtccttggaatttacattctagtaaatgtaggttgctaaattgtattagactatggtgtagtcagtgtcacatgcatggcaaggaaaagtgaatacggggaccaatggggtcaccataaaggggaatgatagactgtaccagggttggggggtggagagctaatgaaagctga

SEQ ID NO: 123446 - DNA, 317 bp, Homo sapiens
atccgcggaaagcctgctttcagctgctcagcaggtgggaacacttgctcctccagcattccaccatgagacaaaggaaaaagtcgcttctgtgtgtccaccagcacacgactcccatgtactcctgcacgtcacgtggacgagctaaagaagactcctctgctccacagccaccatcacactttcttgtttttgttattttttgagacggagtcggagtctcgctctgtcgcccaggctggagtgcagtgacacgatctcagctaactgcaagctccacctcctgagttcacgccattctcctgcctcagcctccc

SEQ ID NO: 123447 - DNA, 620 bp, Homo sapiens
agctggggaacaatcacttcccagttgctgctgggagccgtggcatagaggtgggaatctatcagtcatctcccagctcccatactggtctaagaggcgggcattccagggggaagacaaggctttgggagtggcactgccacagagttctccttggagggctccagaggatgggcagggcttccatctccccaggcagccctcagggagggactgtagctgctggagcctgagtgccatatgagggaggtgtgagcacttcccttctttggatttgaggtcagacctacagcgacacttctagctagtggggactgcccaaggccaggtatgagcagctgtcagggctgattggtgttctaagctccccatgtggccttaaacagcaggaatgaacagtcagggcatctgccatggcagggtattgccatgccagcctgctgatggcatgagctaaacaggcacagggaagaaggcaggcagatctcacatggaaaagctaaatgtctctggaaaggggacttctgcagtgggtggccaattcctgccaatgcaaggtggtgcctagatttcagttgcactttctccagatttcacatatgggtggttgccactgagct

SEQ ID NO: 123448 - DNA, 637 bp, Homo sapiens
tctgttctcccactacaatggaactttcttgtcttattcactgaggtatcctatggtcgaaaagagcttggcagatagtacataaaatttacatgtgtttaataatacatagcgcaaggtgcagtggctcacgcctgtaatctcggcattttgggaggtcgaggtagggagatcacttgagccaggaccagcctgggcaatatagtgagacctcgtctctgtaaagaattgaaaaaaacaaatacacgaataaacagcaccttgctgtctcaagggccagcagaatccttactcatagcccagagtccttctcttctctagcaaggctacatcctttctgtaaacctctctcacattgaactcctctcttcttcccatgcctaaaaggaacccttgtccccagaacagacatttacactcacccacagagcttcctgaaataggtgtaaagaccctgctgcaaacataagactatgatgggcagaactgagcctgggtccacacactgcacccaacacaaggcatagggaaccacctgtccctcttcccactttaagcaggcctggctctccccaccatgctgtagcaggaatgggcagggcagagattggggctgggatgcaagtgaaggaggtgt

SEQ ID NO: 123449 - DNA, 836 bp, Homo sapiens
gcctgaaatgccaagtaggactcaggactctcctgtcctcaaaggctgactttgaagagccctgaaactcacaagcaacatgatccatttcccgtctcagatacagtttcctcctgaactggtttttatttgcaaccattatttctccatcatcagaggctggaaaatgcaaaaaataaaggcagatttagaaagtgggtacaaataagtttcaaaaaataaagctaagattctttattttaattagagacgatggctagaaaccactgaaggggagaattaaaaaagagaaaggctttcacagacaaaaaaaattaagtgagctaaaaaagcaactttacagagacaaacatccctgacttagcaattttgctagaactgttcattttcgtctcggctgggaccaacagaaactgcatggcaaacgtttttcatgtcccgcatggcctgctgcccacgtaacacctcaatggaagccacatcaagctccaaacttggccgccttgctcaacatgagcgagccagcccgtgacagatccaagaaggagaatacaaatcctcaccatggatgatggctgcagacagcctattttttaaaaataatagtttaaagtgaatttaacagttccacattacaaagggccttcaaactgagtgctccatttccccatggcatgaagggcaatttcagctcctcctggcccaaacttcaactattaaacaggctatccattcagtttctatagacaagactactactactcagaaaatggtattcagaatataatatactgatgtagtaagattgcactgcaatgctattgtttccaactcaa

SEQ ID NO: 123450 - DNA, 783 bp, Homo sapiens
agggcaggttcagaaagggagaagactgtgataatttactattcccacatatctctaaacctagcaaatgtcttccgcacaatgcctagcccagtcagtgcatgtacccattatgtgttgctgctgctattggatgtagaaaaatagactagaacttaatattggttcaattattctttttctttttttctgagacaaggtctcactctgttactcagggtggtgtgtagtggtgcaattacagttcactgcagctttgactcctgggctcaagcgatcctcccaccttagcctacagaatagctgggactacaagcacatgccaccacatctgcctatttttttttattttgttgtagagatggggtctcattatgttgccccaggctggtttggaactcctaggctcaagtgatcttcctgccttggactcccaaagtgctgagatttaggtgcaagccacggtacccagaccaattattcttttactttgaaaaaaatagactgtaaatatttttacaagattagatattaacagctaggatccacaaagcacataaagtttatacttttacacctaagttacaattaaaaatatataaacttacattttaaatttatatttatgcatgtttacatccctctactcaagcatgcagtgaatatgggtaacataaaatatgaaaagagaaaaatagaaaaacgcattctctaaagcctatctctttagatcagaaacagaaactcaaagttttgagatgagaggctttctggactctgcga

SEQ ID NO: 123451 - DNA, 310 bp, Homo sapiens
aataatgagaagtgggaaggtatggcttttctttcactcttctctcattttccttttggttgtcggtggcattgaatgagatatggaggctaggattctggcagaggggtttgtgtgtgtgtgtattcacacagagaattcatagtcttacgtataaaacatgttttgatgttttatgtctcattgaataaagtacttgatgcccttgtctttttcaaatgggattacttaggcttctattgatgttacatttttgtttatgtgattgttttttagtaggtacagtcataatgatgtttcagtcaatgat

SEQ ID NO: 123452 - DNA, 317 bp, Homo sapiens
caaggtgtggccatgagactaagtgtgaaccaatgaaatctgaggatcattcgggcttcccaggcattcacctccaagcttacccccaccagccagcttgatgcagacaaacatgccgactgtgggaagtattaaagatggcaggaaggccaggcgtggtggctcacacctgtaatcctaatactttgggaggccaaggtggaggaattgcctgagctcaggagtttgagaccagcctgggcaacacggtaaaacccagtagctactaaaatccaaaaaattagatgggcgtggtggtgtgcccctgtaatcccagc

SEQ ID NO: 123453 - DNA, 449 bp, Homo sapiens
gtggaggggcctcatctctctggtccagctggaaatgtgattgctgcctggggtggccatgactaagggattcctgtctcagctgcctctatatggagaactgagctgaactggtaaacgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatccatttcacaaagcatgtgcatttgtcaggttgctttttcttggttttgtttttttatttgacttaagataggtctatagatgagtgtttgccttcgttttctg

SEQ ID NO: 123454 - DNA, 283 bp, Homo sapiens
ctctttgccttcatctcccaggcttctcctgctcactgtgtgtctgccctatgcttctatgtgtgcctgccctccccctaatctcttctctcgcttggcagtaaataacacgtgaccccaggtggtcactctggaaggccattctgaaactctaacttctgccagctcacatcacagacccagtctttccacttcccacttcccaattccaaattctctagagggacaatctgattggcttagcttgggttccacgctcaccgtatcggttttactgttgcag

SEQ ID NO: 123455 - DNA, 932 bp, Homo sapiens
acatgttttcatgtccccttctattgctgagcggattcaatcccaaggatatgccattcagttgttagtgaacatctgtgttgtttccagtgtgacgccattccaaataaggcttctaggaacattcacattcaaactcttaaaccttaataataagaggaaaaaaatctaaaaatcaggaaaatatttgaacagacacttcacccaaaaagatataccaatggcaaataatcacatgaaaagatgcttaaccccatttatcactggagaaattcagattaaaacctcaacaagatatccctccacaagtattagagtgactaacatttaaaaagaccaaccattgcaagtgttggtgaggatgtggagctattggaatgcttgtccactgctgctgggaatataaaatgacacagccactttggaaaacagttcaaccatctctcaaaaaaggtaaatatgcatctatcatatgaaccagccactgcatttttaggtggttacccaagagaaatgaaagcacctgtgcacacaaatgcctgctcatgaatgttcagagcaactttatgtttaataagaatctgtgtttttaaaatcagccaggtaatcctaataatgagacaggttttggaaccactgggctggacactcggttatatatgattgcttgagaaaaatcctcttattcctcagatagctatataagcagggaaggggttaaattccaaatttagcctgtcggggaaggaatgtcatttaatgaatctatgtaatgttggacaagtcactttttatctttttcgaactgtattttgtacatttgaaccctaagagggaggttgagcgatccccagcctgcaggattctatactttgatgatctcagagaactccacaataaacccactcggtgtccctaacagggtagcatga

SEQ ID NO: 123456 - DNA, 1108 bp, Homo sapiens
gagaattaaatgaggaggccagagccctagctgctgcctcccctccatgccctcagagaaagtgggagtgctggcatttggctaacaggacaggctattttgggcccaggtgttctttctgacctctctgtgatttctatggtgggtgtcaaaggatggctgggaaaggggatttttaggtgtgctaacatcccttgcctatgagtgattcactatcttctcgcaccatctggtttcacccgggctgcaaagcctagtgtggtgtcccataccctgcaaagccctatttgggttatttaccaaatgccaccatgccatctccacagcatctggcagacgaaccaggtggggctgctattgcttctgggtatttacgggatgcagatttttctgcccaccgttgttttgggagggatttccccctccctcaggtagagttgttctcagagatatctgtaattggcccttcccatttaagagtcagccacgaatgatttattctaaaatgatagacccaggtagagaggttacccaccctccgtcacagagtggccagctgtgtcccctgcttccgggaggtgggaatgcatgtggaggggtcgttatttcctaactctcttgctctggcagcctgaagagctgtctgtgccctgaacaacagcttagggagctggaggaaagagaaggaggtatgcatttgagggagagaggcccactgggttggacaagaaggtaaaagagggctggtttggcccctaagggaaggacaggaaagcacccgcttgttccctgtgtggatgcagtgtttgtccagctgaaggcagcctcactcggctgactacctgatgagtgattttccccaagctgacagctgctccaacacatttcacctacaagtcctgacaaagtggtgtgttcttttggggctgttattactgcagcaggcatttggaacaatctggaagaatggggtgccaaaggacacccttgaagccgtttctgagtatccgtcccttcttttctctccgatcctctagctttttttggcttatgaaaaattgggcccatccctttcgaatgtccattgtgctgttagtaatgaggatac

SEQ ID NO: 123457 - DNA, 683 bp, Homo sapiens
taagaagtttcattatatgaatgcaaatagttcaatttacctgtggttcccaacctttgctgcttaaaaaatgatgctgaagtaaatatatctgtaacatgaattcttagcaataggattgctctgtcagagaacatgtgtgatttggattgatagtgtcaaactgccctccataatggcctctattatggaggctagtggggctatgagttcccactaggagtgtatgcaagtgcctgtctccccacagcttcaccaatgttgtaaatatatgtctaacttttggatttgtgccaaaccaatagacaagaagtggaaatgcggtttggttctaattagtatttctctgataaaacatttgaacatgttttcatgtttaagggtcagttgcattaatttttctgggaactatctactcatgttttttgaccattattctgtcaggctatcctgtttgttttctaggaccttctcatgtattaaaatgattaatggtgggtgtagtagttcatgcccataatcctagcagtttgggaggctgaggcgggaggatagctagaccccaggagttcaagaccagcctggacaacatagcaagaccttctctctacaaaaactcaaaaaattagccaggtgtggtggtgcatacctgcggtcccggctacttggcaagctgaggtggg

SEQ ID NO: 123458 - DNA, 580 bp, Homo sapiens
cttttctatccacaagtaccaataaattattacactaatatgttaaatattttcatatacaaaaccaccacaatctgtaaatcactaacttgctgggtcatcctgtgaaattaaagcctttctaagtttcttccctcatctgtacaatgtagatatgagattaatctctattgccctgtgtgtatatctctttgcttctatggtcctgaaaagaggaatggttgacgaaaagatataaagtgatcattagaatgaattggtagtaaatccagagatggccttgcctgtggccagggtacacacctatgaagcccaactcagagcaaactgctgaagacaggaaagggagtaatcactgtccttatcccacataagagtcttaagttgcaaactagttaaaagaattccaaagcagtcacaatggtctttgatgagaatggcagtcaaagataagggaaattacttacaaaagaatacttctaaggcaagtactccaggagataaataaaacccgaaaaatataagattgtgtatgcatgtgtatagatacctattaaaacacaaattttaaacagctcca

SEQ ID NO: 123459 - DNA, 412 bp, Homo sapiens
aactgaatctcaaacttgatttaaatctctctttcacctagagcatctggacccttctctaaagcacctgaagggagagaagagatagagggcattctgtcctttttctccttctgcctctttctcatctgggatcaacctgtctcccgcaaaggttggggacagagaggaagcactggggtcacagggaaggtgaatgaacacctctctgctcagctggatacagatgctgtcctcttattgctgctcagatgttagctcagtgtcccacatctcagctccgtgactcgggctctgccttcagttggaacttttcccactcttcctgctgccctcctactactgcaggggtcctctcccccaagggcagccatcttggttggggtacaggcaagatagcacaagtcaggct

SEQ ID NO: 123460 - DNA, 440 bp, Homo sapiens
tttgtaaatatactttaaaaacattgattcttaccactgagtttaaacaaccaaaaaaaaatcccaaggtgcattgaattgtgtacttcaaatgggtgaaccttaataatatgtaaattatatcccagtaaaggtgttaaaaaatagtactttaaaggaatctatggtagttttgaaaataaggcagttttccatactttgttaaactctggagaagatgacactttactactggtacctgctagagtaagacttatctagtattaacaaaattagggtttattaatggtataggatgatccaggtaatgggggaaaaaaaccgagcatcctgttatctaatgtactatccagtaaactactctagctttttttcatgaactttttctaaaggctttctagggcctcgtcttggtttgaaagttcacagctacccttcag

SEQ ID NO: 123461 - DNA, 4025 bp, Homo sapiens
gtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttatttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaa

SEQ ID NO: 123462 - DNA, 3971 bp, Homo sapiens
gtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgatacttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttatttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaa

SEQ ID NO: 123463 - DNA, 4389 bp, Homo sapiens
gtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttatttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaaaaaaaaaaaaaaaaaaaaaaaaacaaaaaaggaaaaaaaaaaaaaaaaaaaaaagaaaaaaagcaagaaaaaaaaaaacagggaaatcacgagtaacataaaggggccgggtatcatgattagattgcaccaagggcgcacccactaatgtcgggcacttatttatgatgaagagtacgcgctacttaaaaggcgagtttgatgatcagcggtgcggcagtcataattagagacgagcaccacaaccactgcacgtgtattacacgtgaaacaacatgattatttgaggagaacaaggccacactcgagtatgggctaaaacctaattatacggtactgggactaacgcttcgtggctatatct

SEQ ID NO: 123464 - DNA, 657 bp, Homo sapiens
taagggggacaaataattttattttgtgcatgcaaatacatgtcaagtactgcaaactttttccatcaattttctctcaaacactgaaaatcatgatgctctatttagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaaaaaaaaaaaaaaaaaaaaaaaaacaaaaaaggaaaaaaaaaaaaaaaaaaaaaagaaaaaaagcaagaaaaaaaaaaacagggaaatcacgagtaacataaaggggccgggtatcatgattagattgcaccaagggcgcacccactaatgtcgggcacttatttatgatgaagagtacgcgctacttaaaaggcgagtttgatgatcagcggtgcggcagtcataattagagacgagcaccacaaccactgcacgtgtattacacgtgaaacaacatgattatttgaggagaacaaggccacactcgagtatgggctaaaacctaattatacggtactgggactaacgcttcgtggctatatct

SEQ ID NO: 123465 - DNA, 504 bp, Homo sapiens
gtttatcattatcttgacttcatgccttttctctagaggatcctgctttatgccaggtcagggtaccaatgggctcatgtgattgatgccctatttccataagtctgtgttgtaaaagaaaaaagaatccctgctaatgtagagctattccagactggggaggagagacattttaagggtttacacaattttctgtaacagattttaatatgcttattttacattgcttctaacgccttttgaagttgaaatttcctcattgccaaacttgtcatttctttggctcccctcatttccacccctccaccttttatgagcaaatcactgcagttaatgggtcactgtgtaagtttcattctctaagatgaaaaaatgcttattccatttatttaaaaagaaattggcgagcagaatttgcttggcactctgagagtgactttggcttgaactatgtattagacatcaaggcagagttagttgaaaaggatgttaatgaaataatgt

SEQ ID NO: 123466 - DNA, 341 bp, Homo sapiens
gcaccgttacttcccaatgacaggcaaaggaactgaagcacagaaaggtttcgcttaaggtcactcagccagcaagtggcagaaccgggatttcagtttgggcagccagactgcagagcttgctctctgcagattataacacagatatggggctgtgcgcctccatctgtgcacagagggagacttctccagaaagacacaggtggctggtaaggaaattgagaagatgcctgagttgctcggtggcttcctggaagccctagttttcccctccagagtggcttcctccccagagggagcatgagagttctggtctacctgggtgccactgggactttagt

SEQ ID NO: 123467 - DNA, 477 bp, Homo sapiens
aaggccatatatgattagcccacagccgataaatctaacggtgaaaagttgaaagcttttcccctaacatcaggaacaagaaaagggagtccactctcaccacctcttcaacagaatattcgaagtcctagtcaattaggcaagaaaaagaactaaatggcacacaaactggaaaatacaagataaactgtctctatttgcaaatgacatgacctcatacatagaaaaccctaaagcctgcataaaaaaattgttaaaaactattatagtaagttcagtaaagttgcagaatataaaatatacaaaaattagttgtatatttttgtatacaactggctgaaagatttgtacactaaaaactagaagacaaaggaattgaaaaagatacatacaaatggaaagataatctgttcatgaattgaaacaattaatgttgttaaaatgtccatactactcaaagcaatctatggattcaat

SEQ ID NO: 123468 - DNA, 492 bp, Homo sapiens
tgggctcccggcaggcccgggtggggagccaccgcccgagcacaatgtagctccttgttccccgcctcggcctcctggaattggcccatttcctgcctgggccgtggggccttttccaaggtaaataaacaaatacagagaagttggggcctggggtggaaaggggtacgctgggcttttcctccctgcatcccaaccccatagcaatagctgctgtgtgaccacaggggccgggacaccaaggctgagctcccacaccctgggcttcattgatccctgggagaagagaacgggatccactggagggtttgtgccgctctgcctcaggggctgtggttccccatccaggacgcccaggggccaccgattcctgcaggaattgcctgagtgcagggctgggacagccgctgagagacggaaaaggctccagggtggatgacaattccctaggctcccgtcctggctgtgccaccttggagcactatgacatca

SEQ ID NO: 123469 - DNA, 263 bp, Homo sapiens
aaaatagaagctaagagatcagagtttagttctacccttgacttgggaccaagttctaacaagttatctcactttctggccctcagggctccctgtgtataactccttcccttccacctcccaagattgctgagaaaatgagttgatgagattatgactgactgtgtcagtcattgctgcaccaactattttcaggagtttgcacttctttggttaggggttcccccatgatactggtatttgtacaaaattcagatcaggct

SEQ ID NO: 123470 - DNA, 308 bp, Homo sapiens
aacaacaaaaacctgttaccaaatcttaatagacacctcacttaccatcttacaccatctctcaaaaattcaacaaagatgactactactttccttgaaattattttgcttgattctcaggctcccccagtttcttcacctcatcagtcactcctcctaatcgcctttgctgtgtgcccttcccctaggtgttttcccaatctaacgtcaaggccccaggattctgtccagagccctcttctcttacttagactttgcctagatcatctcgtaaacccacagcattaaacactattgttaagactggt

SEQ ID NO: 123471 - DNA, 611 bp, Homo sapiens
cttcctcacaggctttatcgccactgtgcgtatctgcatatggcagattcttcttgatatttcaacactggttaaatttttccttcttggagaagccttccctaaccatccagtctagagcagccagctatttcctttaagtgggttatttaacagcatctatctctgacactttttatttcttttcctcctccaattagaatgtaggctccactacagcagagaccttgttcatctttatctgatgtatccctaggcctcaaaacagctgttcaggaaatgtttgttaaaggaatgtattaatgaatgaagcaatgatgtagccagtatttctaagttaattgataagtttccaacataaagcaaaaaagccttgtcagtgtgtacagccatgtcactgctgaatgtacactttcctttaaaatagcaaaacgaaatcttagataatcaggcctcctttgctgaacctctgaagttcaggaatcctagtctgggaacttccttgcttttgacagagtgttcacagtgcagagatcctagaacagaatttgaattggttcttctgccactccctcaatagacttaatttgcaagtagttttgcccccaggg

SEQ ID NO: 123472 - DNA, 355 bp, Homo sapiens
tcctactagagcctaagtctctagaaagtagataacccaattcagccaaaagaaccagctttccatggggtgggggtggtatatgttcagtaaacaaaaaaaaagagaaacacacacacaatatgtcagaatgattttaaaaaataagacaggaaatattaaaaacaaaaaaatctgcccttttttcatccacttgtcaacctaatttcccccaatccttttgcctttcatacttttgctaaagataccgttttctaccttccaggcaaaaagcaagacaagcaaccccagacaaagaatattgccaatgccagtgctgactcaaagaacacgcaacagatgaatggtttcgtga

SEQ ID NO: 123473 - DNA, 303 bp, Homo sapiens
acgtgtgatgtggggtcatgtgagtgcggatgtgcacagtgtgggatcgtgtgagtgcacagtgggttgtgtggacgtgcacggtgtggcgtcgtgagttcaggcatgcagggtgtggggtcgtgtgaatgcgggcctgcacggtgtggggtgagtgtgggcacacgtgatgtgtcatgtgactgcggatgtgcacagtgtgaggtcgtgtgaatgcgggcgtgcatggtgtgcagtcgtgagttccggcgtgcacgatgtggggtcttgtgagtgcgggcgtgcatggtgtgggatcgtgtg

SEQ ID NO: 123474 - DNA, 834 bp, Homo sapiens
  misc_feature (1)..(3): n is a, c, g, or t
nnntaacaaagaaaaaaggaagacatgcaaataatcacagtcagaaatgacaaaggtgacattacaaccagtcccacaggaatataaaagaccctcagacactactatgaacatcactatgcaaacaaactagaaaatctagaggaactggatgaattcttggaaatacaccatctccaggattggactaagaagaaacataaatcctgaacaggccaataatgtgtaatgaaattgaatcagtatttttttaaaaaacataccaaccaaaaaaaaaaaaaagccttgaataggatggatttacagccaaattctaccagacatacaaagaagagctggtactagtgctactgaaattatttcaaaaattgaggagaagacactccttcctacaatattctacaaaaccagtatcatcctgataccaaaatctggcaaagacacaacaaaaaaaggaaactacaggccaatatcactgatgaacatagttgcaaaaattcccagcaaaatgctagcaaactgaatccagcagcacatcaaaaagttaattcaccatgatcaagtgggctttattcctgggatgcaaatatggttccacatatgcaaattaataaatgtgttttaccacataaacagaattaaaaacaaaaatcttatgatcatctcaatagaagcagaaagaacatttgataaaatccaacgtttcttaatgataaaaaagaactcagcaaactaggcatcaaagaaacatacctcaaaataataagagccatttatgacaaacccacagccaaaatcatactgaataagcagaagctggaagcattcctctct

SEQ ID NO: 123475 - DNA, 438 bp, Homo sapiens
accttaatttatatttttttgtctatttgacataagccaagtacccatgccatgattcaacacagaaaattacaaagcccaccttactgtagactgctgctcttattgcatcaacattcgtatcttccacggaaaataattaacttagttctataatcaggatatgcccggtttatttacaaggaaatacctatcaggtgctaatttctcttagaattagaaatcttggccaggcatggtggctcacacctgtaatcccagcactttgggaggccgaggtaggtggattacctgaggtcaggagtttgagaccagcctggccaacgtggtgaaccctgtctctactaaaaatacaaaaattagtcgggctaaggtggtgtgttcctgtaatcccacctactcgagaggctgaggcaggagaatcgcttgaacctggga

SEQ ID NO: 123476 - DNA, 880 bp, Homo sapiens
cgccattcctcagtttcctgcaacatttcttggcaagccagccaggagtggagatgacaggcttactgtctcctttgcctatagggggctggagccctgggccaagggagacctgtgaccccaggtgccgccgggagaacttcagcccagaggggaaatcagctctccgtgacccagcacccctacccagcagcgcaacagatcctgagaggagctacaggatgattctagaaacagcgcacttcaggaatcatgttgcaggtgttgtgcattggatccaccacagtcggctgaaactgacaactcaagacaagtggaccagccagcaggacccagatcatccaactcggctgatcctgagacgggaccaaactgctgccgaagacgaccgccctgttctggtcactccggaggctaaccagcctacgcatggctgaagtttgaggaaacaacaagccctgctctagtcacacactgaaagctgactagtctatgcacggccaaagcttgaggactcatcaagcaagtaaatgtagttagaaatcttagaactagtagttttccttgtaatattaactgttttactattgttctgtcactgtgctcaacctcctctcccaaataaggacctcttctgtccttactagatatgaatatactgtacattgttttactgttggtaccccacctaaccatgctagaagaaacacccatagaagggtgtccccatcgtacacatactacatggtcagaaaacagtataaccaggactctattataccatacttattatgagtatacagggactcacctaggaacttgtacttacaatcagatcacctattcaatttatgacccaggaaatggccagctacctagg

SEQ ID NO: 123477 - DNA, 366 bp, Homo sapiens
tggaggcagggccggggaaggtgccacaagatgcagactgcagactagggaagcgggagccggtgccgcaggctaagcgtcaggcgaggcagaggactgtggacgtccacagatggccagggtggcaagggaaaaggacacagagggaagggaggcggtgccagctcctcgccacacccaggccaggaagaatcaagaatgtaggatgcagaacccagccacctctccagcccactgctgccccaggcagggcttccccgaccgtcttgagggctctgcccgaatgtgaggggtcaggacagcaaggtgacgggatgtggctgaacccttccaggactgcctggcagctgcacctctcacagactc

SEQ ID NO: 123478 - DNA, 842 bp, Homo sapiens
ggcgttaaccactaaattgccctagctgtaggtacaaatccttctccttgtaaaactgcttcagagctgtgtattacatcatatctcctaggaactggctccagggtatgataaaagtatacagaattaagttactcctcctatcatggaaagtcacttattttatgtgtgttgtgcttagtggagataaggaaacgctgctcaccttccacttaataaccagaaaactcatccttaagagatccttgtggcttaaacaaacaaacctctgcaagccttttagcatccccagtctggctggggccaagtagtatcttgtaattaagctatggggattatgttgctgttgctgatgttcccaagaatgtgggtaggaaatggtgtctgaatatatagaagtcctaagaagggaccatggtctaacattgggactttttaagttttggggaggttgaggatggtgtttattaagtcaccttggtgcttagctgtgaggactgctggagtggagggcttggagctttattcaaaactggaagaaaaggatcctgatgcttcaaaaaccggaagactgggatgagcgggcaagatcgatgatcccacagactccaagcctgaggacatggggacaacgcgcgagcatatcactggaccctgatgctaagaagcccgaggaactgggatgaagagatggacggagagtgggaaccccaagtgatcagaaacctggagtacaagggtgagtgaaagccccgggcagatcgaaacccagaattacagggcaattggatccacccagaaattgcaaccgaagtatactccgagaccagattatgctatga

SEQ ID NO: 123479 - DNA, 583 bp, Homo sapiens
ggcgttaaccactaaattgccctagctgtaggtacaaatccttctccttgtaaaactgcttcagagctgtgtattacatcatatctcctaggaactggctccagggtatgataaaagtatacagaattaagttactcctcctatcatggaaagtcacttattttatgtgtgttgtgcttagtggagataaggaaacgctgctcaccttccacttaataaccagaaaactcatccttaagagatccttgtggcttaaacaaacaaacctctgcaagccttttagcatccccagtctggctggggccaagtagtatcttgtaattaagctatggggattatgttgctgttgctgatgttcccaagaatgtgggtaggaaatggtgtctgaatatatagaagtcctaagaagggaccatggtctaacattgggactttttaagttttggggaggttgaggatggtgtttattaagtcaccttggtgcttagctgtgaggactgctggagtggagggcttggagctttattcaaaactggaagaaaaggatggcaatggatgagctgagcagatgttgaagccacct

SEQ ID NO: 123480 - DNA, 193 bp, Homo sapiens
gccaagtgccagtaacagaggcttcagcagcgctcttaaagctcctatgctatattcgtacagccacaaaagctggctaaagccaaggcttgtcctccaaagtacgattcaagatctcctgtacatatgtaagaggaaaatctttaggggcttttggtgttttgtgtttttttataacaccacatcaatttgc

SEQ ID NO: 123481 - DNA, 511 bp, Homo sapiens
agacaggcacagagtcctataatgcccacgatgcatgcctctagcagctttgaattctgctggatcatctgacgcaatgggcagagcaggtttggccacagcctatatctgctgtagagatatctatatgttctggattccacttgaaaccacgtagtctttgcattcattctgcaacccatctagttttggcagaggctaggtaggttaactgaacagggatttaaaaaggactttattaacacgttggagcaatatcctctattgtggtatttgtggactctgaaaccccaagaggctcaataaacactgtgcttcctttttagtgataagaagtatatatagggcaacatgccatttaccttaaaaaggatgtttctgctgggcgtggtggttcaagcctgtaatcccagcactttgggaggccaaggtgggcagatcacttgagaccatgagtttgagaccagcctggataacatggtgaaaccctgtctctacttaaaaaaaaaaa

SEQ ID NO: 123482 - DNA, 209 bp, Homo sapiens
tacacacatacattttgtttatcatacatcttccctagtactatgtaatcagcataaaaagagaggtaatagctgtcttgctttctcttgactcacaggatctaaaagccacactttgggaggccaaggtgggcagatcacttgagaccatgagtttgagaccagcctggataacatggtgaaaccctgtctctacttaaaaaaaaaaa

SEQ ID NO: 123483 - DNA, 365 bp, Homo sapiens
agccaagatagactaacaggaataaattagccttcctgcctgaaaagaataaaacacagaacagaatatatgaaaatgtggttttcatgatattggacactaagcaacaaaaaacagtgacccgtgagagaagggaaacaacagtgtgaaccttttgacttccgcagcttgctgcctgaaagggtttttccaggttgtgctacaacatggaagtttgccccacctgtggctcacaggcttcatgcagcccaggagagctttgaatgcagcccaacacaaattcgtaaactttcttaaaccattatcagggttttttttcttttttctttttttggtcatcagctatcgtcagtgtattttatgtg

SEQ ID NO: 123484 - DNA, 216 bp, Homo sapiens
gcctcgttctgaggatccctgcctacctgggagtattgttgggaacgaggggaagtcactcccaccaggcctcacctccaacactggggattacaattagacctgcaatttcctagggacacagatccaaaccctttcagtgaggtattcatcgagtctcctgcacatagattctccctctgccaaaaaagatctatttttccacaaaagaaagtg

SEQ ID NO: 123485 - DNA, 479 bp, Homo sapiens
agtcagtctggacagagtgccacagaagttcaggcgagaaagaggattcttccaactgagtggggccatggaaaaactcgagttccatttattagcggtaggaaacacatgttgagaatgaagaatggagttaaacaattggtctttccctcagatcccagggtttttaacctgttactaaaaaagtatagcaatttatggccaggcacggtggctcacgcctgtaatcccagcactttgggaggccgaggtgggcccatcacgaggtcaggagatcgagacaatcctgcctaacacggtgaaaccccgtctctagtaaaaatacaaaaaattagccgggtgtggtggcgggtgcctgtagtcccagctacttgggaggctgaggcaggagaatggcatgaacccgggaggcggagcttttggtgagccgagattgcgccactgcactccagcctaggagacagcgagactccacctca

SEQ ID NO: 123486 - DNA, 301 bp, Homo sapiens
gggatctggtagcattctatatcccaatcttggtgtttaaacaattggttcatgttatagaaagtaatcaagaagtatacttattatttcatcctgtttatttatgtaaaattaacacagtaagtaaggtacacaaatcacaagtgtgtgataacagtcagtgtccattcaggagctagaaaacaaacaatcaattaaaacaagaaaatgtaacataaataaaaaattattaatttgtaaaaagttgtcaagtgctaatagatgtaaaagacaatttgaaggaatatggaactagcaaata

SEQ ID NO: 123487 - DNA, 350 bp, Homo sapiens
cactgcttgagtgtttgggagtacaccagttgttgtagcagacacggaatccttgtggtcttggagctttcattctagtggggggctgcggggagccagacagtagacatgaagtcagttacgtcgtgtgcagaaaggtgctgtgtgctgtggaaaaaatagagcagtgtatggggattagggatgagggcggaaggatagttgcagtattaaagtggtgatcacgtaggctcatggggaaggcaggattggagctgagactaagagggagccattgtggttccctctgcttcagaggtagcccctggtttcatcttcgtccagcctctttttcggtgatctctctactc

SEQ ID NO: 123488 - DNA, 225 bp, Homo sapiens
gagcggaccagatcagagaagcaaggctaggaatcatgagcttaggaacaataatagaagtcaaggaataactgatctgaaggagagtatgtgaacaaaacagacagacactaggtactttgggatgccagccccatattggtacaggcatttggcagttaaaaaaaatatattctataaaaatataatctgcagccaggcgcagtggctcatgcctgtaatccc

SEQ ID NO: 123489 - DNA, 298 bp, Homo sapiens
caaagtgctggaccaatgttgacatgagcactgtacctggtcactttttgtatttcaaattgaagatgagaaggaacaattccaagtgggagattattagttgtctcatgttttctacatataaaccatccgttttcttatcatttatcttcttttaccttcttgaagtggtggtcttagaatcatacaatgtcagaattgaaagtagcttaggaatcacctaattcagcatctctttagctgcagaaacctagtatttccatttgactcctgttttatattacatctccctgctgaa

SEQ ID NO: 123490 - DNA, 313 bp, Homo sapiens
tttttgttataaggagtcagaatttaatcttagaagaaggaagagagaaactgttggccttttgaaacttttgagctccttttgactatcctggtacccaaatccctcagtaccacatgttattgatatttagtgtaaaaataaagtggagacttgtgctttattttaaaacatccagattttaatgttgatatttagtataaaaataaagtagagatctgtgctttattttaaaacatccagattttaatgtactagtaaattttttttcactttcctgcaaagatctggtaagcaggaagaaatgtacatc

SEQ ID NO: 123491 - DNA, 272 bp, Homo sapiens
ctgtcagcaaaagccaaagagaaggacatagcaaagtggagctagtgctgtgaagatgtgttagggcaagggcacttataatcaaatacgtttccactaatctccgagtccatgacagcctctgaccttacaggagttccaggcaagcaacacctgcagagcccgtgcggacaagaagctggagaaccgtgcagaaagacgatgtaaaaacacaaacccccaagagagcgagccaacagggttgtgtcctggtgagtgtgactccccaataa

SEQ ID NO: 123492 - DNA, 176 bp, Homo sapiens
tctttggatgctccacatgcaccatcaactcaacttgtataaaattaaacacattatctgtagtccaacaactaaatgtgctcctaataccaccagccacgcagtcatctggaaagtctgagttgtcctggactcctccctcttcctcactctcctctccctccctactgcactga

SEQ ID NO: 123493 - DNA, 306 bp, Homo sapiens
cccacgcctcccctgccgtggacagccccctgctgccatcaataggactgttaagaaccttctttgtgataggcagtgataggtgctgccaagtggaggatggtgccactggtttccttccccaagagagtgcagtcttttttgcaaaaaaacatgtgctgtgtcagggagggtgaggtaacttggccgctggtggaatccagaaaaaagtattctctcccaaattgtggcagcctcttggggtcctgtccgagaggacactgacctcaggaaacactgggtgggaattctagttcttcccccatg

SEQ ID NO: 123494 - DNA, 216 bp, Homo sapiens
tgctgggattacaggcgtgatccattgcacctggcctactgttggtgttttaaacatttttttccagaattccactgttgggaatgtgtcttaaggatatgtgaaaatgaatgcagagaaaagatgtttatcgtaacttattttaagaggaaaaaaaagatgtaatacaactattgagataggatcttgttctgcccaggctggattgcagtggcg

SEQ ID NO: 123495 - DNA, 474 bp, Homo sapiens
tgttcctagggccctctgatgcacaaagctttctaatttgaacaggaaagcagatgctcaccttagttttcttcacatacctgttctttacacctatttatctttactagattattactttgcctggaacccactcctacccctacacccggaaccccctcctaaccctacgcctttcccatctaaccccttcccagtcttagtccaggcctcgactcctcaagaccttccctgacgttcctcccctgcctcgccccacccctcctagtcgcctcctctgtgctgccacctggccctgggcatgcttgagtatacaccattaacgcagctgtcccagttcagtgagcttttccagggtagggatcaccatctcttcatctgtgggttgttggtgccaagcagtgctagcagtgtctgggagaatgttgcataaatccagccttggagtttctctgccctcacccttacagataa

SEQ ID NO: 123496 - DNA, 764 bp, Homo sapiens
gaaccactcaagaattattttgggaaatgaattagtagaactcactaagctatttgaatatgttagtagcagtatagtgaagtgatcatagaaatctaacatcttaatttgaataaccctaccccttatttgctctgttatcttggactacttaactagtctttctaacctcaatgttatgatctgtcaaatgaaataataatagtgcctactttataggcttatttgagacaacataagattctgtttattagtactgtatctttcacatggtaaacattaagcgaatatcactgctattattactctgcttttaaaactttaaaaaaaaatgctttcaggctagggacaggggctcacacctgtaatctcagctgaggtgggaggatcacttgaggccagaaatttgagaccagcctgggcaacatggcaagacccactctctaaaaaaaaacttttaaaaattagccgagtgtggtggcatgcacatgtaggcctaggtgttggggtggctaaggcaggaagagcactggaactcaggagtctgaggttataataaactatgatggtgccactgcactccagcctgggcaacaaagccagaccatatctctttaaaaattaaaaaatggggccaggcgcggtggctgaacgcctttaatcccagcactttgggaggccgaggcgggtagatcacgagatcagaagatcgagaccatcctggctaacacagtgaaaccccgtctctactaaaaatacaaaaa

SEQ ID NO: 123497 - DNA, 550 bp, Homo sapiens
ctcaaataacaatttagttgaaaggccttagagcctaaaggtggctcttaggttggagtaaggatatttagtctcggcagagtgggcatcactattccactctgtgactccagggatgtgggggtgtaattgcaaagctggtgaatgatccagcccagtgaggccactccaatgtttctgctgtcccagaagggggagataatgtcatgactatctagaagggaatgacttgcaaacatgaactccaaaatggtaaaaggaagaaaaatcactaattttaataaaacccaatagaccagaatgtgtagtttgcaggagctccccaggtgactcagctcatttgttaagattttggtactgctgcagcaaaggagaaactgacatttgcatcatgactattcctaagtggtcctcaagcttttctgctgaggggggagcctgagacacaagtgagaacaggctggtgcccgagtgagtcactgtgatggagtgctggccgcatggcatccacagcctatatcatttcagggccagctactcctgcctactg

SEQ ID NO: 123498 - DNA, 408 bp, Homo sapiens
tctcttcctctatgcatccacaagcatttataaaaaaagtttcattgtataacatctgatatggcatattggcatattctaccactattccacatgccaaatcttaaattgtgttatatttatttgtatgaatttcttttccctcctagttggtaggagtttccttgagatcatgtctacttattctgaatcctggagtgtctaccagagttcaccactcaaacagctattatattgtggtgttttgtgtttttcactagactgcaagggcctaatgaggaagacatgttctctaactttgtatcactattacctaatcacaggccaagcaggtcctgtggcagagcacgtcatgagaaactacttgccttggtgctgaccattaagtcagtgtccaaattcacagtt

SEQ ID NO: 123499 - DNA, 563 bp, Homo sapiens
aggcttacaggtgctcggtggtaagctgagccactcagccgtgtagctttcaccatgttttacaggccaaaggaggtcatgcatgtattcttggtgtagagctgagcaccaaaactatttattcaggattgttgttatttctccttagcaacttggcaagatctggacactgaggaggtgtgtctcttatccccctctttagaatgcaggtcaacgcaatagatggtggtaagcttcacagtaggtaccatttatggagctcttactatcggctaggtctttttgtcaattgttaactgtaataggagatggatatttatagaccccttttatagataaattgagtctgagagttttaagtattaataacatgtgccaacaagtaagggggcaacactgagattcatagacggggctttcttgtactaaaggtggcgtttccttatccactatggtattctgtcagctaaaaataaaagtgcctataccaatataaggggctgtcacatccgttggacactattgtttcttctaaaaaggactcattattactcctagttcca

SEQ ID NO: 123500 - DNA, 351 bp, Homo sapiens
aggattacaagtttcctgattctcccattaatctctccaaacacgaaactcttagttaagggagtagcatttcaaagaagacatcactataatttatcgtttataaatgaaaggtgcagagaccttttcttaccaatttgtggacctcttcgtttttctttcattctttcttcctttctttccagtgttggtaaggttttggcctgctgtactccaggtactttttgatgcttgagatgtataagtaaaacaaagactcctatccttgtggacaatcatgtgaatgtgggattatcttctgccttaaagcaggagaataactggcttatttgggcagtagcaaggaggagc

SEQ ID NO: 123501 - DNA, 584 bp, Homo sapiens
tgtgatggtcagctcttgggtatggttatcttgtgttttgggtggagggatggactctttgtgtcaaagccattattctgagggacatgcagttgttcatatatcatttctaaaattctaatgtaaccttccctatatatgaaaatgggaatgtggctgcattgtgggataactttttagtaaaagcaaaatttaacttctgagactgttcagtaaaagggaaaatattgtaggaattacccttatctcccttgttaacactaaaagaattgaactggctgtacttcctctactttgatagtcatctagatgcagtttgtatatcacagtttctgagttttatcatccacgtggcctcttggcattttcatgcatcttgctgaattagtaaaattataatggaaagttgtgttttgtggctgtgggtatattctagaataaagtttttatttttctaattaacaggtttttttcccaccacacagaaaaatgttttagagctctgcatagtattaattctggctgcattcaaggtggcaataaatgatcagcagctccaagtcgtaatggatatatgaacagat

SEQ ID NO: 123502 - DNA, 312 bp, Homo sapiens
atagagttaataaagatcaagagtagtaactaaccttgagatcagcaaggcttattaatttttactgtggaccaaactgaagtattcattgtatgctactttatagcactctgaataaaacatccatgtttatatctacttttctagaaactatatactataaatgtgaacaattagttaaaatagaatcttttaggccgagcatggtggctcatgcctataatcccaacactttgggaggctgagatggatggatcatttgagaccaggagtttgaaaccagcctagccaacatggcgaaaccccatctct

SEQ ID NO: 123503 - DNA, 329 bp, Homo sapiens
cattttccacactcactttaggatgcctatatatatagtgtgtggtgtaatatcataaagattttaggatatgtagattacacacacacacgcacacacacacacatatatacatatatctatatactttactgcatactagagatacagagaaataaaaataaagactatctttgcctacaagaagctttcagtctgagattataatccaggatactattttgggaaagcatttgtaaggcttttaggaataactcatatgtaatagttaaagataagttctgttataattcccataaagatgggtaaggacaatgttactgtggaga

SEQ ID NO: 123504 - DNA, 509 bp, Homo sapiens
agctttatgtccttaacctcactgagatcccatttactgtctattaaatggaatcattccctctgccacaaggctgtcctaaggtcataatgagacatgcatcaagggcctaaggatacataatagagccttgattaactcgtctttggtactaccgtaagtactagtgagaggctgcccacccagcatccagttcatccacacactctcctttctagtagaaaggagaactcccatttttctttcacagttactgtattacacatgggtgtatgaagcaattctgcaccaatgagatttgaggtgagtcagctttggttggaagttagttctgagttagtcctttgttaaattaaatttggggtcgggtgtggtgtctcacgcctgtaatccaggcactttgggaggcagaggcaggtgaatcacctgaggtcaggagtttgagaccagtctggccaacatggtgaaaccccatctctactaaaaatacaaaaagagccggggatggg

SEQ ID NO: 123505 - DNA, 691 bp, Homo sapiens
tactttgcacagggagtgctaagggatgctgcctcgggtgtcccacgaggaacatgttatcatccaggtttggaagtgtcttagctcaattatttatagcctcaggcaggaattctatcattacaggcatgaaaatgcaccgcaaaatgatgatgaatttggaatactggaggtactaattttgctcagaatgaagaaagagaggaaaatcaatatgaaagtcagtttgtctgtccccacctccctactgtgtgacctcaagcaggctacttaccctctctggtctcaggttccactaatgaaaaggaaatcataatgatccctacaatattaaaagattaatatgtgcaaagttgtagaaaagggccagacacttagtaaacactctataaatgtcaattgtggctgttattacttctacaatcttcctaccttttgcatgtcattgagtcatcatcttcaaattgtgcgtgctcttctttgaaatgtttcttgggcccctgccttccttccacccagccttatgccttcccaggccttgtcacttcacccagtggctgatgctcacattcatcccccgagaacgtgggcaactcttcttcccgtgtgaaaagtaccctgtggaaaagtaccctgtggaaaagtaccctgtggaaaagtaccctgtggaaaagtaccctgtggataagta

SEQ ID NO: 123506 - DNA, 490 bp, Homo sapiens
taaacagcttttgattatctgctagtggaatcatgctattgctaaaacctattgttctgtgtatattaattcagagaaagtagaaactgagctacagaagatctatgctcaggcaggactagttatctgctctatacctgcagtcccctttagactcatttgttgaattcttcaatttcaattgccttattctgggcacttgggttactggctgagcaccatcctctagggaggcctgagtatcctcctagcccaggttctcccagtgatcttgtgaagtgctgtatcaaagtggcagggattctcagcaaactaggaatagagagtaactttctcaactcgacagagaacatctacaaaaaacctacagctaacattatacttgatgagaacctagaagcctttctgctaagaacaggagcaagatagggatgtcacctctcaccagtgcttttcagcatagtactggaagtcctagctagtgcagtaa

SEQ ID NO: 123507 - DNA, 442 bp, Homo sapiens
taacacagtgttgcccaaagccccaggtatgcaaaaacagacaccatgagtcatggtgttagcataaactatccctctgtcccacccaaggcccagatgtgtacagatactgttatcaggcaggatattccaaaggcttagagcttaaggagtggtcaagggccagtttttttctttggaatgttcaatacttaaggacccatgccagcagagttaaggctttactgcacgtggccctacttctgccaatgaacttggagcttacgtagcatcttttttttttttctttttgagatggagtttcgctctttttgcccaggctggactgcaatggcacgatctcggctcaccgcaacctccgcctcctgggttcaagtgattctcctgcctcagcctcccgagtaactgggattacaggcatgtgccaccatgcctggctaat

SEQ ID NO: 123508 - DNA, 480 bp, Homo sapiens
ccataactctaaactgatgtaagcctgcaacagctgtaaagtcatcagggattcatcaggtaacaccaccaaagttaaggttgcaatattttacaaactcacaggctgaaaaattccttaaaaaccatctggctgggcatggtagctcacacctgtaatcccagcacttcgggaggccaaggcagtttgtttgcttgagctcaggagttcaagaccagcctgggcaacatggcaaaaccccaactctaccaaaatatacaaaaattacccaggcgtggtggcatgtgcctgtagtcccagctacttagcaggctgaggtgggaggatcacttgaacccaggaagcggaggttgcagagagctgagatcagcgccactgcactctagcctgagtgacagagtgagaccctaccttaaaaaaaaaaaaatcatctaatgcagtagtttgcaagctttaagtagctatggaattctaccccat

SEQ ID NO: 123509 - DNA, 177 bp, Homo sapiens
gcattcaacagctttccacacacccccaagcacctctaaactaggggcagctacaagccgcagtggaaaggcagggattgggcagaagcagcacacacgctagacacacagaggggcttctgtggggaggctgccctgcacagggaccctccgcccggcacggggacccttcgccca

SEQ ID NO: 123510 - DNA, 318 bp, Homo sapiens
cttcagagtaagcaaaattatcaggcagaaagaggggcattacataatgataagggggtcaattctgcaagaagacataatccttgctgtgttgcacctaataacagagcatcaaaaatacatgaggcaaaaattgttacaattgcaaggagaaatgatgaatccactattagagatggagacttcaacatccttcttccagaaatggacagatccagcaggcagaaaatcattaaggatgtagttgaaatcagcaacaccataaataactggatataatgaacatctgtagactgcttcactcagcaatgcattctt

SEQ ID NO: 123511 - DNA, 282 bp, Homo sapiens
ggagtgagactctgtctcaaaaaataaaattaaaaacaaaaacaaaaacaaaaaacaaacacacaaccatgactgcaccaagtctctgttttagagcctgacttgtttgcacaatggtcccttgtttgtatactgcttttcagctgatctttaacagtactggggctgggtgcagtggctcacacctgtaatcccagcactctgggaggctgaggcgggtggatcacctgaggtcaggagttcaagaccagcctggccaacatggtgaaaccccgtctctat

SEQ ID NO: 123512 - DNA, 551 bp, Homo sapiens
gacttggcaaaacttgaataggtctgttggttggatggtagaaatatagtaatgttgatttcctgatttttgctagctatattacaattttattggattcagtccttgtttacagaagacacacagtatgtaggggttataagaagtcagctcaggaactttcaaatcatttagcaaaacaaaagttcttcgtactttaattccaagacttctataaatttgagattatttttaaaatacttaaaaaaaaactcctttaaagtctctcaacatgctgtcctattaataatagatttctaaattttttatttttatcaacgttttgtgtgcccatagtttgaagtattaaattgtttttatttattaaaacattttttaatgtcactccattcagaggtaatgaagtgttaattttttttgtttgtttttgcttttttttttttttttttgagacagtctcgctctgtcacccaggcagaggttgcagtgagctgagatcacgccgctgcactccagcctgggcgacagagcaagactccatctcaaaaaaa

SEQ ID NO: 123513 - DNA, 394 bp, Homo sapiens
ggtaaataaagctagctgagctcttccttacagtttaagatgaaaaagaaaaattcaaactttactgttcaaacccagcaaattcacaggtttctcattagcttctctacagtcactggtaaaatgttttgaagagtagtttcagaacttcacacaattatcagaatctccaaagcctgggaagtatcatgatgaatgagaagagatcattactgccaaatttctgagggaggtgaagatcaatagctaatatcactaccaaacacagaaatagtatttacgtgggtaatccttgctaccaagggctgccagccttgggtcaggaaacttcccaacaccagtacaagggaatgctagctgaggcagtggggctccaggaatcatgcaagctcca

SEQ ID NO: 123514 - DNA, 317 bp, Homo sapiens
cttctttcacctctaactagactattcaccaaaaatttttaaatatataactttcaaaaggtattttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgcactccagcctgggggacagagcgagactctatctatctcaaaaaaaacatgtcagggtagcagcttgtgggggtgaagcacg

SEQ ID NO: 123515 - DNA, 606 bp, Homo sapiens
atttgccagtgattgcatttctttattaaattactgtgagtggatcaaggttccttataattctctaagatttacctgcagtctatacacaatcaaattagaactctagacacacagctctaccacacaacttatcttgatgaggtttgccacattttcctggaggggtggtacaacagggagtggtgggagtcagactttgctgtacatgattgagtcagtctcacctcatcagggaactgaggaacatcagaacacatatgtaggaactcatttcacttttcttcctcttgacatgatgctatttttgttcataaaattactagttgttcattacaaattcactcactcattattcattcaaatagttactgaataactactacaagccaggcactgttataggcatttgaggacacagaagtgaaccaagattcctgtctttgtggagcttacaatctagtggggcaaacagacatgatacacctattaaagtaagcatccatctataaggtgtgttagaaagtgagatgggctacaagaaatagaaaacactgaaaaggctgggtgctgtggctcacatctgtaatcccagcacttggggag

SEQ ID NO: 123516 - DNA, 794 bp, Homo sapiens
tgagtagtggtattcaaagtagcaggtcaatgaactgtttgtacctatatactatgagaaaaggaacctatactggacttgttttaaggaagaaactataaattttttttaccccatgaatttttaaagaactattctaaacatttgttgaaagaaactaacaagagatctgagaataaaatacctgggaataaatttaaccaagaggtgaaagacctggacactgaaaactacaaaaaattgctggcagaagttaaagaggaacgaattaaatgaactttgttacttcacttcactaatgtgtcaaattgaagaactccttttatcgtgtcttgtaaaacaggtctggtgttgacaaaaatccctcagctcttttttgtttcggaaagtctttatttcttcttcatgtttgaatgataattttgctgaacatattctagactccttcagaaatgcaacacagaggactctagcccaacgcataatctacactccaaactgaagtttctccttcaaactttgtctgctttaccatcctgatgagcttgccttcacattaactcaatgacccatgttgccctgttcaccgaaatcctgaaaccaacactgaggtagtcctggagcctggctgtggctctgcccaactttcctgagccacctccactccttgctactactggtcacagtggagagatacacagaggacaacaggcaaggaaaaaagagagctgaagattatcattatttcctcactcttttcatcaaagatattatctcctggtcctgaaatagta

SEQ ID NO: 123517 - DNA, 260 bp, Homo sapiens
cattattgaagcattcactagtatcaactttggggttacctggccacatcctctgacctacctataagggtatcacagctaacggagcctctgtttctcagaatttaggcagaagcagttcaatttatcacaaactactctatatccagcataagtgcccaaataaaacaattgctaaagttctttaggcatttactgtttgttagttagatatttagtcctcactacaaatctgtgatacaggtattatttttattaac

SEQ ID NO: 123518 - DNA, 466 bp, Homo sapiens
aagacggagtccagcttgcccacacctcaccaggcaagcctgcccagcaccacgtgtccagccatgacaggagagcagctcagcaagtgctgtcggttgcctcgaatgctgctgacaggtccaagggggtggggacagaaagaggctgctggaggtggcaataaggacttggctggggacctgcaaagaacagtttctgtgaggcaatcaggatgggagccagcctggaatggactggaacatggatgggaacagaggaatagaagacagcttgtgcagaagctgctctccagaagcttggctgtgaagggaactggagaaggcgtgatcattggaacaggatgtggcatcaggggaggacatctttttgaatagttgggaaaatctgctgggactgcatatgctgacaagaattatgcatcagagagggaaaaaggtgacaatgttaactgccagatgagaagac

SEQ ID NO: 123519 - DNA, 221 bp, Homo sapiens
tcgtcccgatcaccgtcgcctctcctctggcggagagcaccagcattcccactggtctctgcttttcctcaaacgcatctctgtgtaaatctcccctcaggatcactctgtggcccccactgctctgggtggaaccttctttccagtggtgtttcagtcccctgggtctgcctcactcctcaccaccgtcttgtgcttctgcactgagctccagccagacc

SEQ ID NO: 123520 - DNA, 662 bp, Homo sapiens
gaagggcctggacactgaggccgggctgtctagttgaagtcctggccccattgctcaccagttttgaccttgagcaagttctttaactctgtgcctcaagtaagtgagagtaataatagtagcccaccttatggcattgtagagaggattaaatgagttcatacacataaagcacttagaaccatgcttgcctggcagttgtatgtccagtgaatgttagttatcattaatggttttatattaattgtaacaatctagagttacccatcgggtaacttaaatgcttgttaaataaatttgaagttttaaagacttgcgtcccatcattagaccattgtgctcgttgtctttagattagaattcacttttatagtaagaaataatctattgttatatgtcaaaaagaaataatatttttctcccctctgtgtgtatatatagttactgattgtgctactctgtaggagaaatacaaaggacaaaagaatgtattcctgctatcctacttttctgctgtcacactaaaattgtgtgggaggcttaagtgagttgaaagactggattatggtagttgagggaatgggttttttgttagtttaccattttttaaaatacttagctagaaagcattctgaattattgaataaattacgtcatttatt

SEQ ID NO: 123521 - DNA, 270 bp, Homo sapiens
cagagatagacctagagtagatgtggttagtactgccttctagctctgtgaccttgggcagatcactttaacctctctgagccttgagtcctcttgtgtaaaatagtgatgatgctatctacctcaaaagattaagaagcagaaagccaggccggatgcggtggttcacacctgtaatcccagcattttaggaggccgaggcgggcagatcacgaggtcaggagttcgagaccagcctgactaacatggtgaaaccccgtctctactaaa

SEQ ID NO: 123522 - DNA, 294 bp, Homo sapiens
cttctttaaaggtagtgtaaccagaatatggatgaaagcctaagtcagcttgacctccagtaatgaacgtgggctgtaacacagaagctcagaggttgttgcccagtttggtgtaacgtgagatgttggattagaagcaggtgacacacctaaatgagattagggggagaagaggtagtgtaggaccagttaatgcaggaagagagtagccacatgttcctccatagtccctgaggaatcacactgcattgaattaccatgtagcacagagcagcaatgatcacccttaaccat

SEQ ID NO: 123523 - DNA, 341 bp, Homo sapiens
taactgaatcataggggtagtttttcctatactcttctggtggtagtgaataagtctcatgagatctgacggtttgataaggggaaacccgtttcacttgattctcattctctttcttgcctgctgcgatttaagacttgtctttcaccttccaccatgacagtgaggcctccccaaccacatggaactgtgagtcgaattaaacctctttcttttgtaaattacccagtcttgggcatatctttttgtgtgtgtgggggggacagagtttcactcttattgctcatgctggagtgcaacggcatgatcttggctcactgcaacctccacttcctgggttc

SEQ ID NO: 123524 - DNA, 170 bp, Homo sapiens
catcacacatagtattgtgtctatattaaaagcacctagatttttccttacttagttgcgtgggcttgggattatcttgggaaatgacctatttgtcatttactattgagtgtaaattgttttagaacatactttaaaaccactaacattaaaacctaattttaattacc

SEQ ID NO: 123525 - DNA, 421 bp, Homo sapiens
tattaaatataatgtttaaaaggtgaactgttaaaagcaaggattacatagtgtttatcttctggaggggtgctcataattttcttttttttacaatccagaggtcttctattttattttttttaacaccgattatgccatgaatcaatccatagggaagaggttccagcagctcaagctccttcccatttgttctcacacagtgcgcttctctgggcagagcagactggcacttctgctgaatccagattcacatatacgtgaccaaagggaacaactccatgcttcctaaaaggcctagaagacatctaccaggagcctctcctctttccctttgtgtttgtcattttgtcgaattactggaagacggtggttctggccaaaagggccataataaacttttattttcttgtttctgtgt

SEQ ID NO: 123526 - DNA, 320 bp, Homo sapiens
gtaaaaagcctgtcctttcccattgaaatccatggcacctctgttggcatttactggctacctatattgtgaatctgtttctaggcactattctgttccattgatctatatgtctgttcctgatacaacgattgattgatttctgtagttttatggggcatctcgaaattaggaaatatgcctaccttttggaacttgttttgggccaggcgtagtgactcacacctgtaatcccagcactttgggaagccaaggcgggaagattgcttgaactcaggcgttcgagaccatcctaggcaacacagcaagacctcgtttct

SEQ ID NO: 123527 - DNA, 470 bp, Homo sapiens
atggagccagatggaggatggaaacagaattttatttgtgtgctcttttgtttctagggaaaaacaaaagcaacacaggtcactggactctaaacatatgaagtttgactatttacagaggaagctcttggattcatttctagatctcttccttcccagccctgatttccttccctttctggggagaggcagctgtgaagagctgccaagtctctctgcccactcaccctggtggcactgccagctctcctctgttcccactgtcatctttgggtcctggccctcagcccccatcgcctagaccctgcactagtcccccagctgctcccctccaagggctgcttccctcccatccagagggaccacattgtttcccaagtagtctcccaagagcacgctgaggtcctgggcacagctttgctcaggtgcgtggagtggccccactttgtatgcagaaaagtctaggctca

SEQ ID NO: 123528 - DNA, 335 bp, Homo sapiens
ctcactgcagcctcaacttctgggcttaagcaatcctcccacctgcctcatgagtggctggggctacaggcacacaccaccatgcccagctagtttttgtatttttactacagatggagttttgccatgttgcccgggcttgcattcttatttttaagtaagtctttgaaatccagtgtgtattttacacttatagcacatctcatttaggactagccacatttccaatgctcagtagccaaaagtggatattagctaccatattagacaatgcatctctaaggggtgagattatcgaaactttcactttgtattttacatattattttgttttc

SEQ ID NO: 123529 - DNA, 304 bp, Homo sapiens
gggcctgcttccttctgagggcaggggcagcactttcctttgatattaacaatcgtcctaacagcagatgtggagtggatattagatacagagtgcacatatatgggctttaacccccagacattgttagtcctcatcacagatctatggtcctggcattcatacctccatttacaccagtacttagcacggggatgctaagtggcagaggagggtaggagtccaggagtctgtctctctggaaagcctatgccccctgaccatgttctcactggctgactctcatgttctcactggctgactc

SEQ ID NO: 123530 - DNA, 232 bp, Homo sapiens
cctttctgctaaattgaagaaattaacataatttactcttctgtaaatagggggatggtctgcattgtgctcatttaatcattggagttcaaattaatgatttgctggggtcctgtggtgaatcttgagtgattaagagggagaactcagtccttggttcagaaaagttagcattggaatggatcctcaacaggccctgaaggtaggaagtgttctgatttagagagctctt

SEQ ID NO: 123531 - DNA, 1265 bp, Homo sapiens
atttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattcc

SEQ ID NO: 123532 - DNA, 1557 bp, Homo sapiens
atttttggggggagtcagatattacatttgattagtttactacaaattgtaataaaatgcttaagtcatttgaataataaacatcatctacatcataaactctgtacaacagatgcttttatgaaatgaagccagttgtttttcatgttttattgtaatatactaggcatttatgtattaccgtgcatttctttttaaatgtgtaagtcttatgtaaatggatataaatatgattttttaaaaaataaaatatatggttcatggagtctcgagtgcaaacatttgacaattccaagtactgtttgtattttaccattccaccatttttacagtttttggattgttaatagtcaaatcaatatgtttccttgaagcatgtttcatgcttcaacgtgtttctccttcaagtctgtcaatacttaaagctgaacaacctgcctctgatcatgtaaaaaagaatgatttaacctggaaccggagccaaaaatagagctttaaaggcaatcagggatgtcctatatctttagaaatagcactgtgatggcttgatctccttttcaatacaaaacaaagccaagctgtttacaagggtcaaaagcaattatttaaaaatttatattaaaaaaccataatcttctcttgttacctgtggaccaagaaaaaaaaaaagataaaaaaacttctttactaagaaccacatgttcattcaaatatcttgaaatgccagccagtactggacagtgaatgtcaaccaccgcagagtctgaggctcatttccactagagaaaacgaaacccaagatacctttcccttttgtcaatgtaacagggcattagccagactcatgtctaatgttataagcttttagccgagatggccttgttgcgacttccctgaagtcagttttatcagaggaaataaatgaaagacagaatgattaacatatatagtgtataaaagtatagaagagtaatctcttccctgtggctttatttggtggtgttactgttgtttattctttgtttatatgggagattcaaagtaaagcctatttaataataccatttatctaactgctgattttctgctgcttgatcttattaagcgcaagacctgtcattagtaatttcttttctgtattttaatttgctatgtttgcacgtacattacatttgttttgatgtctatttttatttaacagattcagtcaaaaggtaatgataacagaaaccctttccattgtcaataaaaaaaataataattccagttctctgtttaagctttgttttctagtcacataaggctcgacaatttacttaaactatcaggaaatgtgttctttgggtgacccaaatatttagcttcaaaattgagtctgccacaagagggagatctaaacttgcttatgggagtgatcttaaaatttttttctaaaaatgtggcctgagtaggaacaatgagaagtagctttctaagctcatctaaacatgggcatcttgattcatagaaatgaaatagaatataggaactacgacattataatgccataactagatt

SEQ ID NO: 123533 - DNA, 727 bp, Homo sapiens
ataaaatatactaacactaatgatagctgatgaactttttaaaatagcagaaaaatctcacagtgtttcaagaaagtttatgaatttgtgttgggctgcattcagagctgtcctgggatgcatgctttataacaatgcaaaacagactaacacagtggctgaatggataaagaaacatgaccctactatatgctaccttcaagaaacccatttcacctacaaagtcacacacagactgaaacggaaggggtggaaaaatatataacatgcaagtggaaaccagaaaaggctaggtgtagttgtaattatatcaggtaaaatagactacaaatcaaagactgtaaaaaaaaagacaaagaaggttactatataataataaaggggtcaattcttcaggagcatatcacaattataaatcgctatgcacctaacattggaactcccaagtaaagcaaatgttaataaatctaaagggagaaatagactgcaatacaataatggtaagagactttaacaccccactctcagtaacagataggttatccagacagaaaaccaacaaaaaaagtagtagagttaggccaggcacggtggctcacacctgtaatcccagcactctgggagccccaggtgggcaatcacctgaggtcaggagttcaagactaacctggccaacatggtgaaaccccatctctactgaaaatacaaaaaaaattagccaggcgtg

SEQ ID NO: 123534 - DNA, 115 bp, Homo sapiens
tggagtagtggagagctgcttggctccagcaggggtcaagaaccactaaagggattcctcagcttctcatccagttttcctactccttatgctcctgtttggtgactggaaagaa

SEQ ID NO: 123535 - DNA, 413 bp, Homo sapiens
atctgtagtataaacaaagcagacagtattaaatgcagttgacctagccaggaccattcacacaatattatctgatatgcatatttttgttagagttactttcgagttagcctggggaatcattgccacctatcattgctatcatattttacattttaaatgtagtctttggtagaatgacaggtaaaacatctggaaagcttaaatgcactgtcagaatgattcctaagagtaaatagaccaggaatgccaatgcaagatctgtaagctatagaaatgtaatttttaaaataaaaacaggtttattcttacatatgccatggctagatgtttaagctttttttaaaaactcattcttttttctccttcattttgcccaggaaacattctgttatattctaattgttcttact

SEQ ID NO: 123536 - DNA, 160 bp, Homo sapiens
tgtgacctcgtttcctacctttgcccttccttcattctgctcttctcagaacacacttagccagttttctcacctacgtcaggcatttttgctcaaatgccaccttctcagtcaggccttctataatgaccccacttaatccctcctccctatcctatct

SEQ ID NO: 123537 - DNA, 436 bp, Homo sapiens
tttacctggggaagaagggggagatagcagggagagaggtgtggctcagaaatccaggctgcctcttcaaaggccaattgtttccccgtgtaaaccaggaggtgaaatctcaagttcagaagaggagacaggcatttgtgagtgaggccagggcggggagcagaggggtgggatcctgggaatcgtttctctggttgcagggaactcccggtactgtagccacaggccagggttttccgccctgtgctatttgcagaggcaaaacccggacctcctgagggaggggtgaggacttgtttggaaggagcattttaaaagacaagtcattctcagaagagtttgcttggtagcattgttaatgatagaacaaactagaaacaatcaaataacagtagagtaggtagataaaccgaggtatagtcctacagtgcctagc

SEQ ID NO: 123538 - DNA, 171 bp, Homo sapiens
agtagagtaacatcatgtagtatacacctaaattaaaatatattttcttattctgaattcatgttttttgacaatgaaataatttttcttttatttctaaaggaacaccccaacctaagccctccctaaacaaaaaataacatcaaaggtttgaagtgaaaaataatttct

SEQ ID NO: 123539 - DNA, 291 bp, Homo sapiens
ttcagggggtgtaaggacccaaagactcagtcactatgggcatgatgggtgtcagacacagagcaacaccaccaattctagcccccattcatggtggccagggagctcctaatgggctgcctactctagtcagaggaccttggtgattatggctaaatctggttgggaaatcagaggctacaagtagaggactcctatattataaggatattaaaaatcaggaagaaatgtatctaaactgcctagtacatagcaggtgcaaaataaacttttttttctcattcgttctcc

SEQ ID NO: 123540 - DNA, 348 bp, Homo sapiens
tgaaacctcatctatactaaaaatacaaaaattagctgggcgtggtggcatgtgcctattatcccagctactcaaggcaggagagttgcttgaacccgggctgagatagcaccactgcactccagcctgggtgacagggcaagactccgtctcaaacaaaaaaaaaaaaaaaaaaaaaaaagggcccctccgtgggttaaaaaggccttttccagggggagggtgtctcagaatttagtgcgcaactatccacctttgagtaggtgctgaccgcttcacccaagagtctttgtttcctcaaagcctaaatcccgtgccgggacacacagacgtgttatttggagaaac

SEQ ID NO: 123541 - DNA, 238 bp, Homo sapiens
cagatttttgtgatttcccttgtgattttctatagataagatcatgtcatttgtaaacagatagtttaacttctttctcaacttgaatgccatttaacgtacttgactaattgccctggccagacaatgctgaatataaatgagagtaaatatacttattttgttcctgatcttagggagaaggcattcagtctttcaccattaaattatgttagctttggatattctgtagatggca

SEQ ID NO: 123542 - DNA, 294 bp, Homo sapiens
attggaagaagttttattggtcagacatcctgttccatgtcagcctctccctctaggatcttttgcttcctgcaaggagtggggcctggtactaactcaatctcagccggtcacggtggttcacgcctctaatcccaacactttgcgaggtggagacgggtagatcgcttgaggtcaggagttcaagaccagtctggccaacatggcaaaaccccatctctaccaaaaacacaaaaattagtggggtgtggtgccccatgtctatagtcccacctacttgggaagctgaggtgg

SEQ ID NO: 123543 - DNA, 256 bp, Homo sapiens
gcatctggaccacccaggcctgcagtggtcagggagcctgaatgtggcagtgcccgctccgggggactctgaggagggtgtatggacacatttcctgcacacccaaccctgctgtgctccacaggaccaggacacagatgctgtgacctcagcgggctccacccccaccgcaggaggatctgcacgcaatcaggagaactccagccgacaaccagggctttctggggtgtggggtggggaaagactgatgtttcag

SEQ ID NO: 123544 - DNA, 285 bp, Homo sapiens
aggcacagcctggcagctcagctcctctcacaaatcgttctctctgttctcacgagattagcatttctaataggatcaggaattctttctaattcattgattattaatcctgatgtttgcaaataatctctcctgatttgcgcagaaccaagaacttaatgctctttcagggtttaaatttatttattattattttgttgttattcagtggaaaggtccaattttattccaccagaaattgtctggatggctctcctgctagataattaaagctaatggagccca

SEQ ID NO: 123545 - DNA, 609 bp, Homo sapiens
tgtaaaattccctcttagaactgcttttgctatatcccatagattttcatatgttgtgtttccatttttacttatttcaataatttattgaaaatttctttattttttattgacacattgatcaggagaatgttgcttaatttccatgtgtttgtagtgtttaaataatttctcttgatattgaattctggttttattccattttgattaaaaaatatattgatatgattttttctcctcctcctccaaatttttgaatttctgagacttgtttagtggcctaacatgagtatatgcactattctggagaatgtttcatagctatttcttctctcttttggtttccagatgcatggaatatactttttttcatcccttcacttgcagtctatgtgtgtctttataggttaagctggtttcttgtaagcagcatatagttgagtctttgtggttgcttttaatccattcagcaaatctgtgtctttaaatcatagaacttaatctgtttacattcattgttattattgatagataaggacttactgctgccatcttaatacatgttctctagttgttttgtaacttatttcttccttttatcccttctta

SEQ ID NO: 123546 - DNA, 733 bp, Homo sapiens
caaatgttggcaaggatgtggaagaactggaattgttatacactttcagagggaatgtaaaatagtgttgctgctgtagaaaacagtttgacagtttctcaaaaagttaaacatacggctgggtgcagtggctcactcctgtaatcccagcactttgggatgcttgaggccaagagttcaagaccagcctggccaacatggcaaaaccctatctctactaaaaatacaaaaattagcctggcatggttgtgcaccttagtcccagctacttggaaggctgaggcatgagaatcgcttgaaacccgggggtggagattgcagtgagcctagatgatgcctttgcactcttgcctgggcgacagagtgagactgtatctcagaaaaaataaaaaatatataaatagttaaacacagaattagcatatgacccagcactttcactcctaggtgtataccaggaagagttgaaagcagggactcaaacagatacttacacaccagtgttcgtggcagcattattccaaactgaaaagatggaaaaatcccaaatgtacatcaacacttgaagaagtaaacagaatggtatttatatgcaatggaatatttttcagctttaaaaaggaaggaaattttgatatattttgcaatacggatgaaccttaaaaatactgtgagtgaaataagccagaaacaagaggacaaatattgttatgattctacttatgtgagatac

SEQ ID NO: 123547 - DNA, 368 bp, Homo sapiens
tacttcacagtagtggcagagtttggactcttcacaagtactgatgccataaagcaccaaaaacatttagtggctccttcctcctccacaatattcaaaatcatgtccactctgtagcaagcactgaaggacaaccaattgagcttttcaatcaactgccgattttctcccttttatgttaaccacagaccatctgttgattctcaagaatgtctagcccttctctgcctaaatcttaaagatgaaaagcttatacattatttaagatctagctcaaacattttggcttccacaaaatcttttcagcatgcctaatcaaaattcactgttttctcatttgcattctcattggaattgtacgtaattct

SEQ ID NO: 123548 - DNA, 338 bp, Homo sapiens
ttctgggagtctggacccagcactgttgaaaggaaatcacccagggcagatggtccagggtttcaaggccaaacttgcccctgtatcttttggttaggttggaactgagattttccaccttcccaaatggggacctccaggatccctgtgaaaggcaagtgtcactggaggctggtggttgcctgctccctcaaagcactgaccttaccgcttgattctgtcaccttcccacacatctttttgtctctgggcaccaggaggcacctgcccgatgccatcctcctggggttccttggcttctaggcgcttgactgccctctcactcccctttggctggc

SEQ ID NO: 123549 - DNA, 141 bp, Homo sapiens
ctatttggttttgttggattccccaacaagaggagaccatccttgacctgggaaggtgggaagaggtgagggcaaagtgcattaatccacaggcattttattagcatcagcacagcactttctactccgtgggaattggtt

SEQ ID NO: 123550 - DNA, 209 bp, Homo sapiens
tttttccaatagcagttttaccaaatgttactttaaaaacttactacatattatccatactagaaaatatatgtaatatgtgcaagttatgaagtctaacaacaaaatgaacacatgcaaacccagtatccaaattaaaatgaaagcattgccctaacatcccatctgcttctgtgtaccttccttatctaaagtgctctgttcaccct

SEQ ID NO: 123551 - DNA, 503 bp, Homo sapiens
acccatgtcacaacaactcggaggagcagcagtttgcaaaatacacacaggcacttctagcattctgtgattttaaaactcggaggaatagagcttgatagatttttagaaatatactagatgatacttctgcttaaaatctgaactggaataatgtcagtcagaaagagatggaaatgtctttgctatggatattaaaagcccggaagtaagcaatcaatcatttcaacacaatgacaagcaggaaaaacagaagcagatcatatggcaggaacttgcagtatgaaaagatgacatctggaccagtgtggcacggtgccagtcatcatggtcagcactaaatgaaaaacaaaagttaaatgaatgaacagactttctcttggccttaccaaactaatgatttatttctcttgtagtgaagaaggattgcaagtcaataccagatacaattattcaattcaacaatatgtattaagccaggaactgatcgaggccctgggaat

SEQ ID NO: 123552 - DNA, 193 bp, Homo sapiens
cttccccagaaaaggatatgatactcataacttgattcagaagctttctttattatactgtttgtgtttagcctccaggtagtttgttttagcttaactcttaacaaatgttgaatggcttgtttcctactcatttcagatggaataatcaccctttctatattgtaagttcataaaggttttgttgctcagt

SEQ ID NO: 123553 - DNA, 155 bp, Homo sapiens
tctcagtttatgttgattttgttcccttttgtgtgtatgtcctttttattttaagtgtgaccttttaacattggctgtaatctgagatttttttttcttaacatattacttattgccaacattggtagggagtgccatctccactatgcttttag

SEQ ID NO: 123554 - DNA, 596 bp, Homo sapiens
gtatatagttcagtgtcattaaataggattaaataggattacagctgggcatggtggctcacgctcgtaatcccagtaatctggaggccagagcaaagggattgctcaagtccaggagttcgagaccagccctggcacagtgagaccctatcaaaaaaatttttttaattagccagatatgagtggctgggactacaggcacatgctaccacgcccagctacctttttgtattttagtggaggcggggttttatcatgttgcccaggctgatctcaaactcctgagcccaggcaatccatctgcctcagcctcccaaagtgctaggattacaggcgcgagccaccgccacgtaggtcttggggatcaaatttcaacctgagatttgaggagacaaaacatccaaccacagcaccctcccatcctgctctgaggcctcagctgttggccttctctgactgataggcacagccttttctccttactgagaccataaaaaatgagatattttctttatcttcctacttttttttactccatctctctttttttttttttttttttttttgagacggagttttgctcttgttgcccaggc

SEQ ID NO: 123555 - DNA, 470 bp, Homo sapiens
ttgtgtaggcatctcagggtctggcggaaggatgattgattccatcctgcctttgttctatatctgatacacaagtttacaaccagtacctgttagtaaaatatttaacaaactccagttacaaatgcacaaagggtcagccttagttaataggccatggttttattacccatatgtccaaactgcagccatcttggctcacttttctcttttcttctgacactatcatcaatcatctatctgtctatctacaatatgttttcttaaggtccctgaaatagaaaaaaaaaatcatttcaagatgtttttcaagatttgaggggttacagttaaaacatgcctatttatgggaggttctaacactgatctaactgacatagctgcctttgcacgtacacattcttcagccagaacaaatatttagaagaggctgtgtcaacccatttttccttgtatttccacattttccc

SEQ ID NO: 123556 - DNA, 783 bp, Homo sapiens
gattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagatt

SEQ ID NO: 123557 - DNA, 598 bp, Homo sapiens
tgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccaggatttgatgggattgtttctgctgggaccccctctctgctgcgtctcgtgcaaacgttgctgtgaagggatgcca

SEQ ID NO: 123558 - DNA, 401 bp, Homo sapiens
acagatgaatgtcatcattatataaatgacagttgaagccatgaagtggatggaccaatcagggagagtatacagagggagaagttaaaactctgaggaatatccgtcagcacttaaggcttggagaaaacattgaaggagcaggcagaggtaccaaaggagctaagaaaggcaagtagggccgggcacagtggctcatgcctataataccagcactttgggaggccaaggcaggcagatcactaggtcaggagttcgagatcagcctggccaatatggcgaaatcccgtctctactaaaaagtacaaaaaattagcagggcatggtggcacacacctgtagttccagctactggggaggctgaggcaggagaattgaacccgggaggcagaggttacagt

SEQ ID NO: 123559 - DNA, 590 bp, Homo sapiens
gaggcattgctctaggggtcaggcaccatgccccacagtggcatcactgcttgagagcacccagaacaatgaaaggcagcctgtgagccaggggagggtccactcaaaccaagggtgtatggagcaaactgcgtaagcattgaggccccaggagagatttgcacaggagatgcaggtgcccagtatgatcaatccctctccccagacctccagccatcatttgcaataaccgaagttaacattacctgatgctttgcttctggggaaccagtgtgcacaacctccttaaaaaaaataagggtttggctgggcttggtggctcacacccataatcccagcactttgggaggccaaggcaggtgaatcacctgaggtaaggagttcgagaccagcctggccaacatggcaaaacctcatctctacaaaaaatacaaaaatcagccaggtgtggtgctgcacacctgtaatcccagctactcgggaggctgaggcaggagaattgcttgaaactgggagatggaggttgcagtgagccgagattatgccaatgcactctagcctgggcaacaagagtgaaactgcgtctccaa

SEQ ID NO: 123560 - DNA, 463 bp, Homo sapiens
cccacctaggggtcaaggagctatcgtcaaacaggattcctgggttcaaatcccaatctccacctcctactggctgtgtgaccttggtcaagttacttaacctctctgagtatcagtcacccattaggtaaatggaggggctagactgtaaacattaaatgtggggatgtatgaaaaagcctcagcagtgcctacaatgactattctcattcatccattcactcgaaccattatattcacccagctcctaatctgcaaagctaaacggtattatagctgaggatagggtgaaggtgaggtagaaaggacagcaaagagctatcacaacaacagggtcatggtagtgagcaactaccggaaatggaaggaaaacagtatcccttctccatactctcaaccacgactttagttgccggacagtcagcccatgctgggcactgtgcaactaaacccatttgttgca

SEQ ID NO: 123561 - DNA, 328 bp, Homo sapiens
ttcagtttgagaagatgaaaaggttctggagctagatggtagtcatagttgcatagcaatgtgaatgtacttagttcctttgaacttaaaaatggtcaaaatggtaaattgttatgtaaattctaccacaataaagttcagaaaagttaatttgtaaaataagcataatggttcagcaaacaaaacccaaaatatcttccaaagacctgattgacagtattaccactaatgaaagaacgttccacatcaagagatactggtcagcaaagaaaatttaagaggagaaaggatgggctgggcgtggtggctcacgcctgtaatcccagca

SEQ ID NO: 123562 - DNA, 943 bp, Homo sapiens
caacctccgcctcccaggttcaagtgattctcctgcctcaacctcttgagtagctgggactacaggcatgcatcaccacgcccagctaatttttgtatttttagtagaaacggggtttcaccatgttggccaggatggtctcgatctcttgaccttgtgatctgcccacctcagcctcctaaagtgctgggattacaggtgtgagccactgcacccagccttatttatctgatttcttaaggtagctttgtaataagtaaaaacaaaacaaaacaaaaaaaaccacacatacaaacctagatattttctgtaaacatttttaatagatttcttattttaaaggacttttctttttggggaaaatttcttccaaagtaggaataactttctacaattattcagtgcttttattgtaattgtataagttaagaagcagggaagcttatgcctgtttgcttgtttgttttgatttacatttatctcttcctacttgtctttttattgttttattgaaagttgaaaccactattaaatgattcagacatataagaatgtataatgtatatgtacagtttaaagattaaatataaaatgaacatctgtgtactgaacacctgtgtacctttctctcagctttaaattttttcttttaaaataaaatacgtatgagataatattttaagagtacgtgtaagatataaagacataatgaacagccttgtatctaatacccagtttgagaacataatcctttttatttctttatgtcccttcccacactctaaccactacctttcttacctttgcttttcttttagttttgccagatctagttgtatccctattttgttgttttgttggtttttgaactctaaatggaatccttctgtatgagtttatttgtaacttcctgtttcccctcaaccttgttatcaggatattc

SEQ ID NO: 123563 - DNA, 349 bp, Homo sapiens
tgtcaaagagaatcttgacttacacctaaggtcatgaaaatattctcctgttgtattctagaagctttgttagtttacctttcacgtttagatttataatccatctggaactaatatgaggtaagagtcaaatttttccccatgagtatccaattaatctattttttctttaaaaaaagccctttttctattgtcctagaatactcttttttgcataaatcaagtgtcctttatgtgtaggtctgtttatggattctctgttctattcagttggtctatttgtctattcttgtaccaattgagcactgtattaattacaggagctttatatcttaataactgggagaat

SEQ ID NO: 123564 - DNA, 721 bp, Homo sapiens
atcgggactgaacggtcacatactcatggatacgtaggttgattccggacagcactatctttgctggggagcgcatatttcaacccataacaggggccaaagagggaagcatttcctatatatcaatccagatatttgcaagatctattgtctatacagtgggaaaccattgaaaactttgagcaggatgaatctaacactttagagaaggctccgtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccatcatattggattaggggcccacagtactccagaatgacctcatctttatttaactaattacatcttcaacgaccctatttccaaataaggtca

SEQ ID NO: 123565 - DNA, 673 bp, Homo sapiens
gagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccatcatattggattaggggcccacagtactccagaatgacctcatctttatttaactaattacatcttcaacgaccctatttccaaataaggtca

SEQ ID NO: 123566 - DNA, 347 bp, Homo sapiens
accacaaagcgaatatactttcataatcaccacccaggtcaagaaataaattgttacctgtggccctaaaatccctccaggcactccaccatctttatccactcactcctctccctcaaaaccactagactactaacatcatagacaaagctagcatgcctttgaactttatataaatctaatgatgtaggattttgtgtgtatgtgtatttggcttctttcatcagcattgtatttgtgagatttatccagattgttgcaagtagttgtagttgtgcttttttacacagatttaatttttatatttttcttatatgttcgaacagttaacctgcttatctattatt

SEQ ID NO: 123567 - DNA, 515 bp, Homo sapiens
gagtatacatagaaagggtagaggtataaattggagcaatattttagaaaacaggttggtatgattcagtaaagctgaagacaggaaaactctatgatctagtcattctttcagaggcatttgaacaagagtaactccatcttgaataggggctgggtaaaatgagaatgagacctgctgggctgcattccctggaggttaagcattcttaatcacaggattagataagaggttggcaggattggtatcacaagatacaagtcatagtaactctgctgataaaacaggatgtggtaaagcagccagccaaaacccaccaaaatcaagatggcaacaacagtgacctctggtcatcctcactgctcattatatgctacttataatgcattagcatgctaaaagacacttccaccagcaccaggacagtttataaatgccatggcaatgtccagaagttgctctgtatggtctaaaagggggaggaacccacagttccaggccatccctcccacttt

SEQ ID NO: 123568 - DNA, 336 bp, Homo sapiens
tttgagtttctttgttctgtttttttgagtgctggtggtggcctggtacattaatttcacaactcattaggttgtgatccactgtctgaaaaacagtaatttagggcatcacttttcctgatattggcatgctaaatattacttcatactcagtttggttccacaagtaagcacacactgtatataaagaactgcttggcttgtatgagtcacagggtctctgcatccctgcctttgagaagcttacactgcagtagggaaggtaaacaatttgctgtgtgtaaagctaaacgaggtaatagagataaatgaaaagcacaatcgaagtatagaggc

SEQ ID NO: 123569 - DNA, 331 bp, Homo sapiens
tgtattgaaattgcacactggatcatggatgatttttattttcttcattatgttcgttattttacaaattttcaatagtgagcataaacttttttctcttttgagaacagtcttgaaaatagatccaagtacaaaagatgatacaagagtaatgacaaatattttctcacatttcaagttttttaataacagaaataaaacattatgaatacaattattcccattccaccttcctagctttctaaatataagcatagggattctttctaaacataaacattataaataaaagtagtgtggccgggcgtggtggctcatgcctgtaatctca

SEQ ID NO: 123570 - DNA, 239 bp, Homo sapiens
ggatgatgagtaagccgagtataatagctactgctttcaagatttctcagaatccattagagtttctattgttttaatgactgtgatgagttcagtaagtcatttctgagttaggcaccacttatctttgtgtactgaatattcttaaagccacagttacttccttgctggggttataaagcaattctgaagaccaaatcatgttgcctttgtacatatccattgaggtttctctctct

SEQ ID NO: 123571 - DNA, 417 bp, Homo sapiens
tagtgaataagtctcacaagatctgaagggtttatcaggggtttccgcttttgcttcttcctcattttctcttgctgccaaaatgtaagaagtgcctttcacctcctgccatgattttgaggcctccccagccatgtggaactgtaggtccaattaaacctctttttcttcccagtcttgggtatgccactgcccagcagtgtcaaaacggactaattcacaagaaatggtaccaaaagatgggattggagagtttgtttccactttctatattctccttcccagaagccctcacctcaacttcctctaactttgacacttttaaaagcaataggtatgtttctcttccacagattagggtgtgcttttgaccttgtataatgtcaatgaccttatatattttttgtaaaaatgaaa

SEQ ID NO: 123572 - DNA, 388 bp, Homo sapiens
gaggctgtggtgagtggatcacttgaggtcaggagttcgagaccaacctggccaacaaggcaaaaccccgtctctactaaaaatacaaaaattagctgggcatggtggcacaaacctgtaatcccagctactctggagactgaggcaagagaatcgcttgagcccaggaggcggaggctgcagtgagctgagttaaggggtagcaccagagctgagaggccaaagaagagaccctgagccagcagacgagatatggggtttatttaggggaacttacgtacagggatggtccagtgattgtaggctggacaggagaactgccaccacttgtaaaaagcatgtagttcatgtagcattttcacttaacatcctttccctaacaaccccc

SEQ ID NO: 123573 - DNA, 301 bp, Homo sapiens
cttgcattatataacttttgaataatgaaatcaggattgaaattcaggtttctaaatttcatatcccagtacagtctaggttgatttgtgggaacgcctccttcaattatctctggttctttttttgcacctggttgcatgaatattgcaaaactccagtatgaagtatctatccatatgataaattagatcctcagatcaaatcccccaggttacaagtttataattttaggtgttaaacatgtaataggtttcttctagcttatctgagtgttaacatgaaaaactaacaactttattt

SEQ ID NO: 123574 - DNA, 189 bp, Homo sapiens
ctaaaaattggggaaggtatgcttcctagctgaggcagggattgtgaaatgcaacaacttgctgggcatggtggcacaagcctgtagtcccacctactcaggaggctgaggtaggaagatcaattaaggctgcaatgcatgggagtaaccatgcacttcagcctgggcaataaagaaagacccccatct

SEQ ID NO: 123575 - DNA, 781 bp, Homo sapiens
tactcctcaaactcctcctcctcagccgtggcatcctgatattgctgatattcagacaccaggtcgttcatgttgctctcggcctcggtgaattccatctcttccatgccctcgcccgtgtaccaatggaggaaggccttgcgcctgaacattgctgtaaactgctctgagacacgcttgaagagttcctggatggccgtattattcccaatgaaggaacacgcaagaggaccttgtgcatgaataatcttgtttccatattaccacgagtgggtaactaagcagaattagtaaaagacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaacactgaattctctagaccaccagttctaaccttcaaaaagccaaacctgtttgtgagctgtccttcaaatactactgtagaccccagtgtttattcattaaattttttaaatatttgttttatttggaatcaaagtatttgtaattttagtattcccacttaatatcagggagaaatgtttaaatctgtctatgccatatgtgcctctggcttattgcccaatatacgtaccgggcaggctaacttt

SEQ ID NO: 123576 - DNA, 419 bp, Homo sapiens
tctctccctggcccctcttctctctgtggtaggtaggttcaaattacagcctaacctcagccatctctgttctctttgctcaagcatatgggtcactgctttgggttcctacaccagtcagacatccacaggctcccagatacagacatgagcctaggatgaggtaatatacccgattaggctctgagcctaaaacacgttccatgaaattacctgagccttccttgcacagtactgtgatctaagatctaacacataatcaagtcatgcactttgtttcttatttgctattgttacatgtgtacagtgtccttaggagtctacagggaagagggataattggcagagattggcattggcagaatcctgggttctctaataaccacctttcacccccagcagtactctctagagtaaga

SEQ ID NO: 123577 - DNA, 385 bp, Homo sapiens
aggacaactttccccaaactgaccgacgtcaatcttcagatcgaaaaggcacacaccggctggacgcagtggctcacacccgtaatcccagcattttgggagcccgtggcgggtggatcacctgaggtctggaatttgagaccagcctttcttacctcatccctggcttctagactctgcccagtctcctatcgccagcctcctgtgtgcactgtctacaaagaaaggccctgtggtcgctcacacctataatcccagcacttcggaaggccgaggtgggcagatcaggagttcgagaccagcctggtcaacatggtgaaaccctgcctctattaaaaacaaaaaaagtagccgggagtgttggcaggcgcctgtagtcccagct

SEQ ID NO: 123578 - DNA, 713 bp, Homo sapiens
cgcggcgttttgcccccgccgccacggctttttgccgctgtcgccgccgctttttgcccccgccgccgcggctttttgctgccgcgactttttgccccggtcgccgccgctttttgtcaccgcgactttttgcccccgccaccgaggatttttgtccccgccgccacggctctgagggcaggagcggcagactcggctgccagctctactggcgtcctggcaagggcagcgccgaggggtgctcctggtccagctctcctggctcagggattctttgcctaggcgccggcgccccgggctccttgcctaggcccctgtggcctgcatagagtggcgctgcctgtggaggcggtgggagagaagaaggagggcggtggtgggggtgatgcggcggccacggagggtggcacaggggctgcggccagccgggcgctgcagcagtgcgggcagctccagaagctcatcgtcatcttcattggcagcctgtgcgggctgtgcaccaagtgcgctgtgtctaacgacctcacccagcaggagatacagaccctggagctaggtgatgatattctgatctatgagatgcaagaagatgtgatgtgtgggacatccatgaaaactgattaatgagacctgacacaaattagagatcaagcccactacgaccaccaccatttttctcttctatcctatttttttgtgacctctagcatgac

SEQ ID NO: 123579 - DNA, 351 bp, Homo sapiens
cattatccaataaacattcaaatattttcacacacacacacaaaatcttccttcacctcttgctacacctcagctcgtgttcattttcttccctctttttattaaatctctcaaatgaatactcaatattatttgatattactttcctcctttccatctcaagaaatttctcaaagaaactgaaaacatttcctgattttctttttagactttgaagccacacccccgtggcttgaaatcttcactttatcacttcttcaaaaggaataatcactcattatttcaattttctcatttgtaaagaggggatagtaatagtacctaaacatcccagtgtttgagggaagagta

SEQ ID NO: 123580 - DNA, 789 bp, Homo sapiens
cagagcccggccaccaacagaactgcggcctttcgcaaccaggaagctccctaacaagatgggaagctactgcttttgtcccaaactccagaaccatgacacccctgctatatctcagaagccaccgtggtcaggaagttactgcaactgctacaaccagaaccacccctgtgcccactagaatccacacaaattaaatggcttccccaacactgcctttcaacacacacacaaagctactgattagacacagggaaactatctccgactaggcttgcccgcaaaaacaatagaaaatgtaggctgtgtctcactgccaccttctgaatcccacatgagtgtatctgaatggccgaactacgctcacatccagaaccctcagtgcaagggcatttgggaagcacagttttaattgtccagcctctgcagtacacaaaacattctagaaggcagttgcattggccgggcaccctggctacgcctgtaatcccagcactttgggaggccaacgcgggcggatcagctgaggttgggagttcgagaccagcctgaccaagatggagaaacccccgtctctactaaaaatacaaaattagccaggcgtggtggcacatgcctgtaatcccagctactcaggaagactgaggcaggagaatcgcttgaacccaggaggcggaggttggggtgagccaagatcgcgctgttgcccaccagtctgagcaacaagagcaaaactctgtctcaaaaaaaaagcagttgcattaaatgttgagcatcgatacactgtat

SEQ ID NO: 123581 - DNA, 436 bp, Homo sapiens
cctaacttaagaaatacttttgtatcgattcattaaataagaaaatgtctgtgctgtttctaatattacaagctgtacctggataaattcctctgggaaagctgaaacccatatacacaaaacaaaacagctcatagggttacagcaggtctcttctaattccctatggtgatttaacttattcaatttgttttctttaagcctagattcacaactcaaagccattatgcaaactgacattgtcatattaagtttaccttttattttccctttctaaactttgaatctgggccaggcacagtggctcatgcctataatcccacctttgggaggccaaggcggacggatcacttgaggtcaggagttcaagaccagcctggccaacgtggcaaaaccccgtctctactgaaaatataaaaattagttgggagtggtg

SEQ ID NO: 123582 - DNA, 315 bp, Homo sapiens
agtcaggaaccccatcatctggggctgtctctgctgcaagccctgcctgggcctgggcccctggggctgtggccggtgcagtggcctgtgctgtttctcggcacctctcacttccctgggaggcccccaccgcctcctccaaaaataacacctggggcggggcagggagcacctcgcaggcctggcctgggaacctcgggttgtgactgtctcttcctgtgggcagggcccagggctttcttcctggtgcctggagcctggcacaaagtaggaccagacacaagattgaggaatgaatgaatgaaggatgaatgg

SEQ ID NO: 123583 - DNA, 437 bp, Homo sapiens
tgggccctggtccccttctctgtccatccttacttccttagggatctcatccagtgtgtcggctttaagcagcatctaggcaaaggctcctaaatttataggtccagtccagatctctctttcaaactccaaactcaagatatatttgcctagtctgcatctctatttagacgtctaatggtacttcaaatccaatatggctgaagctggactcttgctgtccccactgtagccttctccataaaccataaagccatcctgtagccttctccataaactgtaaagccatccagactcacccctttctgttgtactctacacccaattcatcaggaaatcttgttggctctacttactaaacagatccaaaatctggccacttctcacacctccactgtcactatccaggtcctaccaccttcatgtctcatctggag

SEQ ID NO: 123584 - DNA, 220 bp, Homo sapiens
aaccacacctgagcttatgttaatgagatgatttttgcaaagtccctagataaccacaggactggtggccaattgccaggggaatcaaccctgtgctcatacagttagaactcaaaaccccaccctcaacctccagggaaaggagaggggctgaaggttgcactgataaccaatggccaatgacttaatcaatcatgcttacctaatgaagcctccataa

SEQ ID NO: 123585 - DNA, 157 bp, Homo sapiens
ctgggctatttggtaaggaatgaagttggagatagtcttctgtcccttacaaccaaaggaattctaactaatagtttgccaagttttatgtttataataaaaaatgacatgctttttcttttggatttttaatgcttttgaattaaaaatgctagaa

SEQ ID NO: 123586 - DNA, 551 bp, Homo sapiens
  misc_feature (515)..(515): n is a, c, g, or t
  misc_feature (534)..(534): n is a, c, g, or t
aagaggtttaattggctcacggttctgcagggtggacaggaagcacagggcttctgcttctgggaggcctcagaaatctttcaatctttgtgcaaggcaaagaaagagtcagttgtctcacacggcaagaggaaaacatgcagagtagggaggtgacatagagttttcaatgaccaggtgtcatgagaagtcactcatgattgtgaggacagtagcaaggggatggtgctgaaccattcatgagaaatttgccttcaggattcaatcaccttagaccaggatccaccttcaacgttaggaaatataattcaacatgagatttggtgaggacacatattcaaattgcatcatcaatctttgaatataaagacatccacagcaggctttatccagccaaccgtggactagtactagtccacggtgggctactagtccacggttggctatgtggacagcaagagtcgttttcgcggaagcggagtggcagccaggcctgtcgggccccccgaggccgncccatttcccttccagcanactcaactagccaaccg

SEQ ID NO: 123587 - DNA, 407 bp, Homo sapiens
ggctgcaacagcgcgcggcggcggcggcagaggctgaagcagaagccgcggcggagccggggaagcgggggcgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggac

SEQ ID NO: 123588 - DNA, 252 bp, Homo sapiens
catcttcttgccatagcaggactgcagtaaatctcctcaccatgcacggcacagtggtactgtacagattcttcttagcctccctgtgcagcagtctttcctccaggatatagggttttgaaatgagggtcttatagcaatcaaacaaggaaagccagataattttttatggccagctccaagatagaaaggcaggagaagattcctgccttggggagagaaaggagcaggagaaaggggaggaggagatgg

SEQ ID NO: 123589 - DNA, 257 bp, Homo sapiens
catctgactttatctgtatgatcttaggcaactcattcaatctccaaagtctcaagcgtctcgcctgaaaatggcaattatcaccaccagaggataacatgatgatcaaatgagatcacatatcagaaagtgctttattttattttatttttgagacagagtctctgtaacccaggttggagtgcagtggtgcaatcttggttcactgcaacctttgcctcccctctcctcccaggatcaagaggtcctcccacctc

SEQ ID NO: 123590 - DNA, 162 bp, Homo sapiens
tatcaaagtctttcttcactttatagtatattccggggaaattttaacatttgcaaaaatatcgttatttgttaaatgaagtatgcctttccatatgaatctgactggcaaagtaccaggtgtcaatagctacattcaaggagtagcttttcttattaagga

SEQ ID NO: 123591 - DNA, 295 bp, Homo sapiens
gttgaatattttacttgacaacatagcagttaccagggagatagttcacttccttctttctcagaatgtctgatgataaactgtgcacattccaaaatcatgaattctgtctaccttcctcacctcccagtatttgattgtgctagtcttgtctccatggtttgtgttctttgtcttctgtgaaatgcctggcagagcgtcagcacattctgtttctttcgacattcgtgttcagtattctcccatacctggatttcagtggatccatcttccattcaaatgatcattgtccttt

SEQ ID NO: 123592 - DNA, 301 bp, Homo sapiens
gaatgttactgaatagtggcagaaaatggaaactgtggttaaatagcagttcagtgtctgagcagaaatgtagaacatgatgattagatgcccaacaccattcagaattctggccatcccagacttactgagatgtgtattattataattaatgcgcacacctcaaatagaaattagctcaaatagctgccctgtggttggtaaaatccacgtggctctctgagcgtgtcacttgaatccctatgcttggcctgctcagccctgggtaaagcatctaagcatccctctaactcatgtcttt

SEQ ID NO: 123593 - DNA, 420 bp, Homo sapiens
ctcagttgagtaggcctctgaggtttcccagcaagatatctggagggcggccaccaccagaggaccctcctccacacctgacgggctcagggctgtgcttcagctcctgggaaagatcctgggagggaggtggcactggctcccatcctgtcctataaatgaggagactctccttgtccaggcacaggcagatatggggtctgtgaatcagcacctggctctttaaacctagaaagctttcaaaatcaggcaacctgggactaactcaggcctcagactccgcatctcctgggcgtggagttgggaatctgggtggaagctccagctggagcctcggggcagtaacactgccaggtgagtgttctctttgcttctctctttcctggagaccttggcctgagtgcttgtcaggtcagaatt

SEQ ID NO: 123594 - DNA, 325 bp, Homo sapiens
acagccacacaaggaaagcaagtctgaaaaagccacatcgtatgtggatccaaccatatgacattctggaaaaggcaaatgctgagacaataaaaatgtcagtgactgccagggatgtgaaggtggcaggtggggaaagatgaacaggacaaaccccagggatttgtgaggcagtaaaactattctgcatggcactagcatggtgaatacatgacattatacatttgtcagaaggcacagaacgtacaacacacagagtacagcttaatgtaaatcgcggcctttagttaacagcaaattcctcacactgttgcaagatgttcat

SEQ ID NO: 123595 - DNA, 245 bp, Homo sapiens
aaagtgagggaaattttcaaaagtcagaaatggcggcaactaaaatcctaaaatagtaatactttaaggctgtctgggacaagatgagatggtggttattgctgttgtgtaatagttttgaggtttgatacaatttaagaatagaagatgaggcctgaggtttgccttgaagcagttagatggagctaagagccttggaaggctatccttttagaaaaatggggcattttcaaaaataaaaaaat

SEQ ID NO: 123596 - DNA, 191 bp, Homo sapiens
aaattatcacaacataaatttattctgtcacagttgtgaaggtcacaagcctgaaatcaaggtatcagtggggctgcactccctctgaaggctgtaagggaaaaattatttcttgactcttccagctttggatggccccaggtgttcttcactttgagcctgcataactccagtctctgccttcttcacat

SEQ ID NO: 123597 - DNA, 397 bp, Homo sapiens
agtgacagatacaaatagaacacagcaaagtaacactagcgaaaataaaagcttcgatcagaaaggaattatactcatagcacaccatgtggatcagctgtgactaatattttacagtcatgacaatgtaaagactgaatggccaagactactcttcccagcctgttagagtggccaccctgcaggctgcaaccctttatgagaaataaagctctcctttccaagttaaaacaacaacaacaaccaaccaacactgaatgaataatactgtaacccaacattggcatctaacaatacagggggaagtacatacagagagaggatggctataagatagcaaatcctcattttccatagtaagaaattaataagcatcttaaactgggggtgaggggtg

SEQ ID NO: 123598 - DNA, 367 bp, Homo sapiens
caattggtctgaatttcattcttgtttctgccctactgttgctgccagggcatgtcaaatgaagatcagaaatgcccccaccccagggcttaaaggaacctatctttttctttttttagacggagttttgctcttgttgcccaggctggagtgcaatggcatgatctcggcttactgcaacttccacctcccaggttcaagcgattctcctgccttagccttgcaagtagctgggagtgcaggtgcctgccaccatgcctggctaatttttgtatttttttagtagagacagggtttcaccatgttggccatactggtctgaaactcctgaccttgggtgatccacccatctcggtctcccaaagtg

SEQ ID NO: 123599 - DNA, 583 bp, Homo sapiens
attatctcccaccaggtccctcacacaatatgtgggaattgtgggagtacaatttaagatgagatttgggtggggacatacagccaaaccatatcattccacccctggcccctccaagtcttatgtcttcacatttcaaaacaaatcataccttcccaacagtcctccaaagtcttaactcacttcagcattaacccaaaagtccacagtccaaagtttcatctgagacaaggcaagtcccttccacctgtgagtccgtaaaaacaaaagcaagctagttagtttctagatacaatcggggtgcaggtattaggtaaatatagccattccaaatgggagaaattggccaaaacaaaggggttacagggcccgtgcaagtccaaaatccagcagggcggaaatccttacagatatgtggacataagcatatgtttccctgctctgtcagctgagaagtccttgaagcagtgatatcccagcagcaatgagcatacctagaggagcccagatcatagtttctagtatcattttccaataaaggacccagaaatgactgattccagaactgggtgagaagtaatat

SEQ ID NO: 123600 - DNA, 739 bp, Homo sapiens
  misc_feature (205)..(205): n is a, c, g, or t
  misc_feature (304)..(304): n is a, c, g, or t
  misc_feature (353)..(353): n is a, c, g, or t
  misc_feature (379)..(379): n is a, c, g, or t
  misc_feature (412)..(412): n is a, c, g, or t
  misc_feature (433)..(433): n is a, c, g, or t
  misc_feature (444)..(444): n is a, c, g, or t
  misc_feature (453)..(453): n is a, c, g, or t
  misc_feature (456)..(456): n is a, c, g, or t
  misc_feature (559)..(559): n is a, c, g, or t
  misc_feature (587)..(587): n is a, c, g, or t
  misc_feature (594)..(594): n is a, c, g, or t
  misc_feature (602)..(602): n is a, c, g, or t
  misc_feature (676)..(676): n is a, c, g, or t
gaaccaggctggtctcgaactcctgacctcaagtgatctacccgcctcggcctctgaaagtgctgggattacaggcatgagccaccgcacctggctactttacctttattttaaagtcttcattttagaatactgtatgccatagctttcaaaaataatgcattttattatcaaagactataggaaaacataaaaaagaaaattntgaagattttgcagccatggagctggcttgttccaagacaaaaaccagggtttcctagagttgcctttgttcctgacaaattttttggtgttggtgctnggtccaaaatgttcttataatcaactcccttattataggcaataactcnaggaaaggactgtgtttatacatcanaaaaccacaataacaacaacaacaacaaaactnagttagatatactgtagcacntgaggtgatangtgctatangtngtgtctaattagtgatgattgatgagtgctttactttccaataaaatgtgatttttagctactggcgctcaagataatgtctttcactatgtcattgtacttnaaatctaaccctagcaactccctctttnccaaagnccattaangttttttcttttttttaccctagaacttaaagtataataataataaaaaagaaataacatacttttacattatntgtcctactgtgatacttatttctaagtatgtggaccatatactctgatcaccctatcatatt

SEQ ID NO: 123601 - DNA, 230 bp, Homo sapiens
ctgaagccagagaattgcttgaacccgggaggtggaggttgcagtgagctaacgcagcagaggttgcagtgagctaacgcagcagaggttgcagtgagccaacggggtggaggttgcagtgagccaagattgcaccaccacactctagcctgtgtgacagagcaagactctgtctcaaaaataaataaataaaaatacagtgtaggccaggtatagtggctcatgcctat

SEQ ID NO: 123602 - DNA, 303 bp, Homo sapiens
tggtcgcctccattgtaggccgctccctgctcagtcagctcctggcactgagcctcctgcttttcctcccactctgtgcctcctccacccaactctaagcatcaggggctggtctcggcccccttcctctccatttgcaatctgcctaggcctaggccatcgcttaccttagataccatccccagcaccttgactcccaaagtctctctccggcacagacttccattcagctcaagactcatacctgactgcctacttgacctcaccacttgaaagcctccaggaccttaaaacagagcctca

SEQ ID NO: 123603 - DNA, 242 bp, Homo sapiens
cacggctctgcctccagtttccatcctctcctctgtggcctcagatatccaggctatacaggatgtctatctgattctcccctagcccagcacagagcacagcctagatcatggtcgctatacccaggtgttgagcatctatccccgggaactgactaattcattacagaacaggagttcagtgtctgcaaaggccttttacagttagctgtatctgaaggttatcaactcatctatgttaa

SEQ ID NO: 123604 - DNA, 806 bp, Homo sapiens
agcgtggtagcaacactaaaaacacactaattccatttctacatagaataaactaaagagaaaagagaaaacaatttgtggagaaaagtgaagataattagataggttgggattgaggggaagggttaaaggttaaaaaaagaaaaattgtgcttctccattctggaaagtccccagctttttctttgttttgttttatgtccaaactgtgtacatattggattctttcctactccttagtctatcagtcaatcatcagttgagacttgagtacactacaccctaaagtcatgagttacttaatgggtagttggaattcagtacctttagtgtgttttattctctaactcacctacccgaataatttgattcaaaatagactaaaaagtcttatttttattggatgatatgagcaggcactaaatacagtacagtattaaactttgggctgacacagtacagaaccagtcaagatagggctctagcctgttaggagattgcttttactcttccaagtcagcgttctcactgggcacggtggctcatgtctgtaatctcaaccctttgggaggctgaggaagggggattacttcaagtcaggagttcaaggccagcctgggaaacatagcaagatcttgtaggctgggcgtagtggctcacgcctgtaatcccagcactttgggaggccgaagcaggcggatcacttgaggtcaagagtccgagagctgcctgggcaacatggtgaaactccttctctactaaaatgcaaaaattagctgggcgtggtggcttgcacctgtagtccc

SEQ ID NO: 123605 - DNA, 860 bp, Homo sapiens
gtcatcacgcccgaccagtgttagtttttcgtgtatactttcagtgggtctttgtgcacatgaaaaattcaagaagtatatgcaaatgagctttttctaatgtactaaaatatacacccttccatcctttggtttattacatgaagaatgtagtaagaaacaagagtttctaggtgaatgaatatatttctgtggattttcaatggtagtatctgtatttttaaaataaaaataaaaacaatcacacctagacacatcatattgaaactgcagtaaattcaaaataaagagaaaattttgaaggcggccaaaggcaggggatgggtgaggagacacaatacatacaaagaatcaaagatgagaattacaggacatgtctcattagaaactatgcaaaccagaatacaaagagtatagaaagaaaaaaacaacaacacataattccatacccagcaaatacatccctcgaaaatgaagatataatgaaaactttttaagacaaaaactgaaaaaattcagtagcagccaaccagcagtacaagaaacattaaagaaagttcttcaaacagaaaggatgctatataaaatttggtaaacttgcaaagtaatgacgatttccagaagcagttaagaatttaacttttaattgctctgaaagacacttgactcctaaagcaaaaataatagcaatgtactgtggctttatagcatatgccaacgacaaatgcttgacaattggacaaaagtttgaaggaaggaattgggagtgtacagttgtataagtaaagagtatatattcaaaatctcattaaccaaacaccacctgtttcccaaaaacctagtgaaataaaataaataaa

SEQ ID NO: 123606 - DNA, 418 bp, Homo sapiens
gttatgatcactgtcatgtgccctgtactaagtcctttacaggtaactaccacatttcatcccagaaacaaccctgtgatttcagtactgctgtcatccccatttcagattcagaaactgaagtttacaagggttaggtcacttgtccagagccacacactaagaggaggctgcaatttgagtctggacggtctgaggacagatcccatgttctcaataaccatgaaatagttttgaatgcagcttagcaaaagctgaatgccgtggcgctcacattggaatcacctcagaagctttaaaaaatgaggatacccaggccagacgcggtggctcatgcctgtaatcccagcactttgggaggccaaggcggggggaatcacctgaggtcgggagttcgggaccagcctgaacaacatgg

SEQ ID NO: 123607 - DNA, 539 bp, Homo sapiens
agagaaaggggtctgaacttaccaatgaatccactccatgataacgacattaatccattctggaggacagagccctcacagcccaatcaccactcaaaggtctcctctccctataccattataatggcaatcagatctcactgtgagtctgggaagaggcaaacattcaaaccatggctgctactaagaggcatgcgttgcagccagtttatcttggaagactcacccagaatttaatttcttaaaattcaatatccttatgagggcaattggtaacacctgctgtgaatattttccaggctacaattatacaacaacactccatgccaaaaattgttaaggaccttgatcaagcatttgtccttatgttcaagcagctcagaactgttttctgtggaaaaccttggccctgcccatctctgcaagataggcaaccatccaggctttaggcattcaggtggaagatactgaatttcataagacaatgtttgtttgattcctctgtgcttccagtttcacatcatacctgaaaaatggaa

SEQ ID NO: 123608 - DNA, 443 bp, Homo sapiens
aacaacaaaaatttttgtcttgtttgtaaaatatgaaatgttttaatatattacataaaaattagtatgcatatacatgtctaaataatagagctatatgtagtaaagaggtgactttgacacagtttcagtggagtggcaaaaagcgtgactggagggttaggagtgagggggagaaggcataaaggagagggttgtgaggagagagttggaagaaggaactgaaatgagaaaagccacctctgaagaggcttgagcatgtttacagcgtgctagaaggtatttaacaataataatagtataataataattcttatttatataccaggcattcagtgaaggtccattttgcactgtctcatttaagatcccatgttcttcactgtatgttaaccagggataggataactgacagataggataactgacagagcgaagcctcc

SEQ ID NO: 123609 - DNA, 349 bp, Homo sapiens
accctgtgatcatttcccaccaccctcatattctctgaactttaggctgcagcatgattactgcaaaaccatccagtaggtgtcatcaaagatgtaacccttaacagtaagacctcaaacactccagactgtgtagtttctgagcaattctgattgtgggctcaacttggttcccatcaaaatagtaggttacaagaccaaaccatgaatgctgcatctagaaagtggattaatgacgcagttctcaaactgtgtgctgaggcaccctggggcattgctggatatttatttattccctttgcccctctgtgtgtgtgtgtatttaacagatgggggtctcactatgttg

SEQ ID NO: 123610 - DNA, 348 bp, Homo sapiens
tccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacgg

SEQ ID NO: 123611 - DNA, 516 bp, Homo sapiens
tccctgactactacagcatagttttctctgtttgttcatttcctccttctccattcttttactgtacataaaagtaactggtatatgtgcacaagcacactgcattttttttttaacagccaacggtatgttttgattgacatcaagtggagacgggatggggaaaaacactgattctgtgaaaacacccccactctccattagtggcatgctcatcctgctcttcatattccagtaagttattttgctctgttttaacaacaacaaacaaacaaacaaaaaacccataaaaatccttgcataccttgttcaactggagaattttcatgtttttaattgatcactgtaaaaccaaggacaattttataacttttttgtatgtagctgttatatgtagggcaatctgtctttatctagggataaactactctaaaaaaaaaacaaacaaaaaggaaaattaagcgcgaaccggggcctcaacggggagaagtaggaatggttggaaatttcggccaa

SEQ ID NO: 123612 - DNA, 311 bp, Homo sapiens
tagacaggcaggtacataattcttaggcagcatttagaataactccaggcagtatctgctaataatcccaatgcctgtatccttacatgtatatatatatagaaatacttggtgttctatttatcatccaagataacttcgcaataaacatttgtgtattacggtataaactgttcctttaggtaaatatatcaatagtcattatttagccatttccatattaatgattgtattagtccattttaacactgctgataaagacatacccatgactggacaacttacaaaagaaaaaggtttattggacatac

SEQ ID NO: 123613 - DNA, 248 bp, Homo sapiens
ttaataggtaggaatataatttagagcagctattaataacctccttagccatataaccatgggattcagaaaggctaagggtttttgcacaaggaaagaggcaggaatgaggcatagcattggcaggagcaaaagaaagagaggactagggaaggggaaagataaaagaaccttcaagtgcctctgaacctccccagaaaccaaaatatgataaagcagttatatcaaaggcatttaatgataaggtg

SEQ ID NO: 123614 - DNA, 714 bp, Homo sapiens
gtgtcccaggtgactggatacagtggagtgaattagaaatttgaaattattgccctgaggggacctacattcttcttgttggagtgcgtctgtgtgggataaggtagacaaataatataggaaattcaaaaaattgtttcagaccatagtaagttctatgccagaaatgaatagtccatatgataagaggaacagacattgtgagatgttggatctataggaaaagaggaacagacgccatgttcaggccatggtgcatgtacaaaagacctttttctgaaatcagtgcaggcagtgagtggccaggtgtattaggatcttttagatgtagtttaatgaagagtttatggcttaaagtgagacagtattacttcagagctcagcttctctccttggattttctctcagcaaatgggagaagtaacgtctgcccttcggagttgttacaaggagacaagataaacacagggtccaagtgcttggtaaatggtaagtgctgttattagagtcaggtgttctagtcacaggtcctcaacagatacagctttggcagtaggaggtgcagctgacctgagctgtttttaaattaaaattaaagccacctaggtttcattagtcagctagcagagaggaggtctgggggaccatgcttaaccagagtcagatgcttggaggtcattggactctacagggattctgcacagtcactgggac

SEQ ID NO: 123615 - DNA, 511 bp, Homo sapiens
tatttgccagggattactaatatcttcagaaaacctttctggtgtgtcgacttcattttaagactcggaagaaaaataacgtagtttgtaataagaatatttttactttaaagcaaacaatattctgcaagcttttgtgataaaatatacaagattttatgtgtttttatgcttgggcagaaatcttcatgttctacctcagagcctgaggagaacaagtttattttctaagttaagggcatgtgagtagaaacatttgacaaacagtggtctggcttctaaccagttctaatccacaaagttaaacaataagagataagaaaaacagaacaaaaagaaacaaataacagtggcaaatacttatgctgttcctgaaagactactccataggtaataaaaactataaaaatggtcagtagtcaaaacagtctgactaagccaggtctgctcttcacgtggaacatgggctattaaaccttgctctgagatatagctcggatttctctattcc

SEQ ID NO: 123616 - DNA, 262 bp, Homo sapiens
tcctcggggcagggagtttgtggacgcacaactgctgtgggcccaaacttgattctgggcccaagaggttccagtcacacagattcattcagcagacattcactgaacactgagctgtgccaggcctgggctgacagattcacagttgagctggggacacagatattactcagataagactatgattgtaaactgtgataaatacaacagagaaaaacaccctgggaagatagaattgagaggcttcccaaggaggcaatat

SEQ ID NO: 123617 - DNA, 293 bp, Homo sapiens
aatcctttagcaagttctgtcttctctatcttcaaaaacactccaaaatttatacccttctctccatctccactaccagcaccctggtccaagccatatgatctctcacctagactatttgcagtagcctcctaactagtcttgtttgtttctactggtatccacaccatcataccctccattatagagactagaaaaaaattttaaaaatgttaattggtttgtgtcacatttcttaaaagcctctacgtggccttacattgaactcagaatgaaatccaaactccttgccc

SEQ ID NO: 123618 - DNA, 123 bp, Homo sapiens
acagccttgttgtgaggggcttcctgggatggaccccaccatctctgcaccttcgccactgcaagatgctggcctcggtgggccagccagcccctctactgagcccacccccatcctgggcat

SEQ ID NO: 123619 - DNA, 406 bp, Homo sapiens
caagcagtccaacatgattccagctagagggaaggaacgtcagtgtggaagggaatgttgggtcagggtggagggttcccatggaggacatttcccatttgcactggaagccttcattgtatttggcagaactctgtaagcatttagaaatcttggcaggttcatttttaattgctcacctagttcttttacttttctttgtctcacatcgcacctctaggcatggcagggtgggggccctctccaggcagcctgtgggttcaccatggggattcccagcagatagtccccaaggtctggtgtgcagatctccaactccctgcccaggcaggtcaggggagagctgatgccctgagggctttctgggcagcaaatcaaaggccatgccatccccagggaagcaaag

SEQ ID NO: 123620 - DNA, 168 bp, Homo sapiens
tcaaattgaggatgaggcaccgtaacttatgaaaagccattctatctctagaacatacccaaatcctcccaccagagccactctagtccacacaaccattagcacccacctgaactaccgcaatgatccccctgctgggatttctgcttcttccccctgctttgcatc

SEQ ID NO: 123621 - DNA, 453 bp, Homo sapiens
taaatataaaagctatttttaaatggctgaaattattctcttcccccttgttctcagagctgcatatacttatagcagttattgaatgaaaacttaaaatacatggaattaaaaattatattattaacatagaatatgtggaaataaatataacactgtgattcacagaactggctgtactatcttatgaatctgcaacaaattgtctgtatcaaaatttcttagtctgtaagggactaattgcttatatgtgtctctcacgaagtttggagataatgctctcctctgatcacacagttgttacttactacctatgtgacctttggtaaagtatttcacttgggtgttaatttccttatctgcaaaatgggaataatcatgtatctagtttttgtggttgtgaagagcaaatgaattatgcatttatattaataaaatattaagcacctgtgt

SEQ ID NO: 123622 - DNA, 411 bp, Homo sapiens
ccaggattttatttaggatttggctttggaaaggcaaaatatcaaaagttatcagaaatgtcaaaagatttgagtacttgattaaccaacattacaggtcactgtgaaacaattcttagttatttatttaacctatatgacactaagagatttcaaaagtaaatatagggagcaacacaattgtaagaaacaaaaagagaaacaaaacttagctcttttaatatttagaagacttggttctcttaaatagtctaggacatgataaagacaaaaagcacaggaaggccaggagtagtggctcatgcctgtaatcccagcactttgggagaccgaggttggagaatcacttgagcccaagagtttgagatcagcctgggcaacctagggagaccttgtctctacaaaaaataa

SEQ ID NO: 123623 - DNA, 457 bp, Homo sapiens
agaggatccccactatcatgtggtctacaaaaggatattgcatggaggaaatagagcagttgttctcatctccactgaacagagaaccagagaaaacatacagaatttgagccagcaaatccttaatttaagtttctctgtatacataaaaaaaaaaatctcttttcaaaggtaggggctattattcaattacttagtcaggggcattccagcctgtttccctaggtggtttgagtgtaagacccagcatccatctgtctgatttaggctgatgcaagagaaatggggagccaaataaacacttcttgctggctagatgttctgacttctctttcaggtccctgattgatgggttacagttataaagagtaaaaatataaaggcactgtggtgtgacaggtatttaaggattgctgtatcagataagactgagattctgcttttcatagaccacaat

SEQ ID NO: 123624 - DNA, 327 bp, Homo sapiens
ttttgtagagacaaggtttcactatattgcccaggctggtcttcaactcctgggctcaagcgatcctcccacctcagcctagaaattgttttatacacacacatacaatggaatactcttcagcctttaaaaagaagaaaataacatcacttgcaatggcatggatgaacttggaggacattatgctaagtgaaataagcagatacagaagaaaaattctgcatgatctcatatgtggaatctaagaaagtggtagttatgaggggcaggagggcaggagaaatggggacgtgtttatcaaagggtatgaagtttcagtaatacagg

SEQ ID NO: 123625 - DNA, 768 bp, Homo sapiens
gtagaaaccaaaagaaaggacacattttacctcttaaagtacaaagtaatcatgaagaaaccctaaggttttcttagatacagttttctagatatagagcaatttcctcctatgagagttcttgtttaattgagtagtaaaaacaaaatatttacaggagtcaaggaacgatgtgggctgatgacagagagtagttggactttgaaataattataggatttggattagagggtggaagggtgggaacagcacaaataaaacaagtatcaatacttgtcaatggtggctaaggggatggtgaaactaaaatatagaacaaaacactcctagatgatattcaacattttgttaatattactgtcatgaaatcagctataggcagctcttagctcttgtaggaactgagattcagatacaatagtccatgagaacttaattttccaaataggctcctgctttttcagaaggacattttgaatcaggagtcagcaatttttttttttctgtgaaaagttaagcaataactattttagaatttgtgggctgttcagtttctgttatagctactcaattctgctgttttagcttgaaggcaaccaaagctgattcatgaatatgccctgaacaattttagttcattctatggctatgttccaataaaactttatttgaatttcatgccattttcacgtgtcatgaaataccacttttcattttttcccatcgcttaaaaaaaatgtgagaatcattattggcccactggctaga

SEQ ID NO: 123626 - DNA, 343 bp, Homo sapiens
ttacaggaaaaccgttatactcctgtgagcgagataccccttggaatcatttacatagcatgtacattatatcgggtattataaacaatctagagatgatttaaagtacaggatgatgtacacaggtcatatgcaaacactatgccattttatgtaagggacttgagcatccacagactctggtatcctcgggaggtcttggaaccaattccctgtggataccaagggctgactctatctccatgattcattaggagaaaggtctcttggaacgaagtaaaggtctgaatcattgactatgcctaaataaatacagttccaagttctaagtacatagcagagt

SEQ ID NO: 123627 - DNA, 528 bp, Homo sapiens
gggaacaggggtgggggcgcactggccacctcaacccgggtctttgcgggggccaggagtgctgactttttactttggaccaaggtgagagagagccagcccctgggctgcctcaaatgctgtccatgagggccacctgcaggggtgagagatttcagcaggaggaggctggagggagcgaaggatgactgggctgaggaagggggtcctgagcatctgaacagaaccatgttcgccacccaaagggaacagcgaatgaaagacttttgggcagttggacagggtctcccaaatacctacagaagtgcctcaggagagaagccagagggcattcaatgcctccagaatcttccactggcaaagaacccaagagatatcatttgtgtctctgtctccacacagagaatgcctgtgcaaccccaccaggcaagaaagaatgttctggaatgttccccctttcttcccttcctaaccctaaatatgtaagtcaggaaaacagaaagaagacttactgagcctccccaccac

SEQ ID NO: 123628 - DNA, 606 bp, Homo sapiens
cagtgctaaatagttaataagtggtgaaactggaatttgaatccaatctgcctgccttcagatcatctgctgttccagagaaagcactaaggatacatttattgaatatttagatctaaataaattgctttgtttttattggggttctgacacttagaaatgggaaggagtaattagaagaaatgaggcagattggactgatattctttagtgggagtggctgatgatttaggagctatgggaacagggaatatcacctttgttgggccatgtctaattttacatatgaatgcggggcttgagtttttctccagtaggcatatgactccagcacttcccatttggatcagtcatgattagacttttatattttcccctcacaaatggaaataaaagagaacaaatgtaattttcctgaggtgactagggagtcttaacgagaagaggaaaagcaggaaaaaatagagttgaggccaggcgcggtggctcactcctgtaatcctagcactttgggaggccaagatgggcgaatcacctgaggtcaggagttcgagaccagcctggtctatatggtgaaaccccatctcaactaaaaatacaaaaatt

SEQ ID NO: 123629 - DNA, 325 bp, Homo sapiens
gggcctctggaaagtgcagccccgcacccttttctccaaaggattgttctcctcacaaaggaggaaacttcccaccttatcagatatccggcctcttactgaagcacagacggtgatgaaaatttatcccagaaatatcagtgctgggaggttatggtgaggtcacggcaaccatcccccaagacccagacaagacactgcctgagaaatgcacctgtggctgcctgacagccttaagccacaaggccccatgctgccctccacacacgctccctgttaatattgttttctgcccagaaaaggaacacagcgggcactctcattc

SEQ ID NO: 123630 - DNA, 245 bp, Homo sapiens
gtgtaagctgctacagaccacaaatccgttttccattcagtttcagtttgttcttaatcagcctagggagatgaagagcggacattatcttcattatcataatcggcattcccgttgggcaggtaggctcacaaagaaatgagcttagaagtccctcagcagatactatcaggtttcccagctatcctgcgaagtgcctagtatcagcatccacacatggaggttaagggactgtcggaagcctc

SEQ ID NO: 123631 - DNA, 272 bp, Homo sapiens
atctcaagcacttgttaggaaagatcattagaaagtattttataaaaatctaaattctacagcagacatactcaatccttgctgtgttaaagaatcaatcacttaacaagctctttaaaaatactgctgtccagaccccaacccggattaactaaactccagtccttggtggtgggcccatatgttaatgtgcttttaaatcttcccaggtgattctaatatatgtttagggctaagaactattgctctagtggttcttaatgttagctgcc

SEQ ID NO: 123632 - DNA, 305 bp, Homo sapiens
ctgtgtgcggccggcgcggcgcgagagggatgcagccggaaggcgcgggccctaatccggccttccctccctaaaccccggcggaaaagaggccgcgctttgtcccaccgctgcctgagaggcggaagcgggggcagccgtccggcggggtgcggctttggggagtgtcccttgctgcgctttgcgcctaccgtgaacaccgcgagggcgcctaaggtcgcggggtctcccttcgcccgacgccccgcacccacgggcatgcctgctaacacccccgctgcaatttgcatttttagtcacccgcc

SEQ ID NO: 123633 - DNA, 828 bp, Homo sapiens
agggtttatattttaaggttttgtagtccaacccaatctgatgtttgaaacttgacttttattaaaacaaacagaacaaccttcttcaaaatattagatttaaacttgtgttcagaataacattttaatctattttatctttcaagaattgagttttctttctttccatttttttcttttactattagactgctggtgattggattatcattattttagaatactgacttagatatgaaacagggcaacgatacatatatttctaactctttgataagacctaggacttctgatagatacaaactataggaagatcataactttatcttctattgtatcttaatctttatcaaattgataacatgctttataacaacagattctctattaagtaaattgagttgctaattttcctagttgacctagttattattttttaaatccagaggtttttgttgcctttctctgtataagctcttactagtcacatccgggaactctgagaggtagtgggaaggagaatctggtctagaagagagggcctaataaggagttccttaaaaaaataaaaacactacactctaaagctgtgaacggcttttcttaattcttgcttagggggagagagttaagggcatgagctgtatgttaagatttgaatacgtacttttctgcagtgagctaagtgatttttgtcatgctcttcatgtttggccaaaaggtacagggaaactaactttatctgttggtgttgtgtagcatatttttgtgttttacaaatttagagactaaaaaatcaacccaagggggagcttcttggtgatggag

SEQ ID NO: 123634 - DNA, 604 bp, Homo sapiens
aaagagtaggaggaggaagaggaagaataaccagaaagagaacaagaacagaaagtgggaggtccatgccactgtagctgtcctgaaggatctagttaaggaagacctcagtgtgtggtgacatacacaatgagtgacaaggagccccaggtcacctcccgtttaaaggacatacaaacgagaagcttcttgtcgatgggatctttcctgagtgggatcaaaactttgatccacaaattggcctgcagaactacagagtacacaagtgtaggctgaaccttaccctgaggatgtcatcagctgactgcaaggggccaccaagcccaaagtctacaaaaccaaggcagtgaagaaccacccaaaagaaaaagatgaaaaacggggaggaatcggacaccagggaaaagaggtaatcagccacccatggcaatatggagacacggcagaaagaataaggaaatgccaacttctcctcgcagggttcagctggagtccttctaatttccttagaaacagtaagcctgttttccttaaccatgtccccgtgcataactgaccctgccttcttggctgattgtgacctccataaacagaagcggacgaa

SEQ ID NO: 123635 - DNA, 867 bp, Homo sapiens
ccaagtgtttggatgcggtgggccccactggtttgggcctaacctcaagcggctgctaatggttccatgacacttttcccgctaacacttcacagagatgtctgactgatgtccactgctcagctgcaccgctgagctggtgagcattcaggcagagcacccacctctacttttctcaccccgaaaatcagagactggttctcagctggtgcagccaccgccccagcgtgccggatgcaggactttccctgcgaacactggacagtcccagcaaagcagacggtgggtcgctctgtatctctgaagaacagctgggcctgcgtgtgtcattctcaggcatctggcgcagggcttctcctccaggaaggtggctgctcagctccgggcactgccaggggccacggaccccgcatcctttccaggctgttccgcagcatctgccctcatactcacagccaccgctgcgtgtgtcccagggattctcagaatagaattctgtgcctctctcgcctctggaagtgaccgcgctctgtaggaaaatatcacagcacgccggcctcgaaaggccacgacgtggccctaaactgttctaagtatgtcagttacttagaacaatcagaaaggggcagaacaagctggggtgtggagtcaggggtcagggcacagacagcatctcttgtcttgcagagagaatgctagcaatttgcaagttacttgaaaaggtttgtgattttccaacgccctgagtaattctagccaaaatgcgtgactcgcctcacactagatgcttgctgtaattgtgtctctgtattaaactgaccgttctttggagcttcagaatggaccaggaggaaaaggtaaatacca

SEQ ID NO: 123636 - DNA, 710 bp, Homo sapiens
gtagaggcagggtttcaccatgttggcgaggctagtctagaactcctaacctcaagtgatccacctgcctcagcctcccaaagtgctgggattacaggcctaagccaccacacctggccatttagtgttattttaacaaatacctaatattaatggtggcttaagcaagatgatgttttattgctttttcatttaaaagtcaggggcagttttccagagctgataggatggttttataaacaaggggccctgtttccttctttttgcaccaacattttcaacgcataacctgcatctcctgggccgtagtggctgcttcagcttccaccatcacatctgcgttgcagccagctggaacagaagaggaaaggtagagcctgtcccagcccactaagggcataacctggaagttgcccacatttcttctgctcacatcctcattggccagaacttggtcatgtggtcagtcctcactgcaaaggaagctgggaaacgtagtttttatgctgaaggctacattctagggaacactgtggctcttaccataagagaaagaaaaggaacctgggtacagcaaggtagctcgcagtctctgatgtgtgtttgtgtgcagtacctgaggaatttggctccgatgtggggacttgatgaggagcctggtcattgagggagtaacaaattgccagtggggactgggggcccttatctga

SEQ ID NO: 123637 - DNA, 456 bp, Homo sapiens
gactgtcattagccggaaatgtttctgttctaaatcttcaaatgattggggagaaatgacttgacaggttcctctcaggggtgtaacagccccaaattcagacgttctaggctttgcagagggatccacatgccttggtcctgccctcagacctgccgaatacacagggctaaagattgtcactgactttcacaggcatgaccaaggcccagcccatctccgtcaataaagaaaggctggagtgtgtgcccctcactggttatgaaagctaagagaagtgcaagtcggagagacattcaacagtaagttgaaggtagtgtggggggaaggttgcaaggttcccactgcgcaggatcttacttggtctcacaacagttgtcaacaactcccaggggatgggaaatgtgattccagaggtttgcagggtaaatgcaattaaacaatttttgaagaaag

SEQ ID NO: 123638 - DNA, 666 bp, Homo sapiens
ctgcccccatgattccattaccctccactgggtccctcccacaacacacgggaattcaagatgagatttgggtggggacacagccaaactataccaccatgactgtagtctcttgtgtgggctcctttcactcatcataatgtttctgagctccattctccttgtcatgtgtatctgtaatctctcctgctttaatgttgggtagtgttccattctgcagcaatatcacaatttgcttatccattctactgtctggggtttttccccagtttgaggctactaaaattgttataaatatttgtttataagtccttgtgaacacaggtgtttttattcctcttgaataaataaatacctaggagaggaatttctgtttttttttttatttttatgggcacatagtaggtgtatatatttatggagtacatgaggtgttttgatacaggcatgcaatgcgtaataatcacatcagggtaaacaaggtatccatcacctcaagcatttatcatttctttgtgatacaaaaattccaattatacacgtttacttatttttaaatatactaaaaattatcgttgactggccaacctgttgtgctatcaaatactgcatcttattcattgtatttaactctacttttgtacccattaaccatctccatttccc

SEQ ID NO: 123639 - DNA, 587 bp, Homo sapiens
cattctgccaccacagcatctagaaggggttatactgatggcctcccatctctcacctgcccccgcttttggattttgcttctgtggcattgccaacaccaccatctggtaatctagaacctcagaaagacttgtccatagagatgagattgtatgtagtttagaatacctttaactttcgtatatataatgcttgctctgatgatcaatatattgaaagcgaatttgcttcataagccactgttcactccctgtctttgaaatcaacaacgtaagttttaaaccccgcaaggatttaaggagatagtagacagtatcaatgcctggcatctgaattaagaatatatttagtggagaagttttaatacaaacctcaatgaaaaagcatcaatatcatattcagcctaataaaatgttttaatgaaaattgtcatggcgtttgacaacatctctttattaattggtcttttccattattattttcttagtagcaaacacactctggttttagctctcattagttatagtcctcattggattcacattttgcgacttcagctgtgtttatcttctcattggtctcagtt

SEQ ID NO: 123640 - DNA, 155 bp, Homo sapiens
cggcgtgactagaggatccccgcactgtagatcgattattgatcagtttggggggaacatttttttaaaagctaattagtctttgccgagtggaattactaatgccgttttacacttagcacttagcggtgcttttcatcttcaaagtgctttga

SEQ ID NO: 123641 - DNA, 491 bp, Homo sapiens
atgagaaaaaccgaagctcagggaacatttccaagaccaagagctgagaacgctgcggagctgaaatttaaatccagtttgtcagacccccccaatccgacattgtcccctcgtcctgccatggcccatatcccaggaggacctgtcaccatcctccaccttggtatatttatgcctcccgttggtctactgtctggtgccttaatcactgaaggctagcgtcatgggcatgcattccttgctttgcgtgtgcgcatttgtccatgtaaggtataggaacgttgtgtggtcatagcaactccccgacccaatagctcgcactgccctccgtatggggaaaaactcgcagaccggccagaggctttgcctgtatttgggcgcactgaggcctttgcttttactggcaggtatagaaggcgactctgagattcagccagcttgctcagccgtcagagtaaaaggatgatgtgagttctttgcccctgctacag

SEQ ID NO: 123642 - DNA, 420 bp, Homo sapiens
tctacgggtattacttaggaggagaagacggagtgctttcaggtccctgcctgtagtttccttctgtggtgggaggctttgagcccagagactgagaaggactggggtggggactttatggtaaagttggttggtttcaggcagtgggtcctaattatgttttcctagattacttacagaactgactaagattgcaaaattattcagggtgtgattttgaaacaggtgctgaatgagtaggaaagacctagaaggctgcttgacttacttaagccagacccttttgttctctagagaagcataatttttctcatgcagaatgatgggagagggttttaagatttacgaggcttcacagggagtctggctgtgttgttcactgtccactgtgtatgtgtagagtccttactggaatgcctc

SEQ ID NO: 123643 - DNA, 165 bp, Homo sapiens
catgggaccacaggaaaatgaatggacagagttgaaatgttaggattcctggacaacatcaagggcccaacttgagggccgtgggcgtgactgttgagggtgattgtgatgtttccccagccacattgagctgtaggagtgcaggtgaagaggaggcagagaatt

SEQ ID NO: 123644 - DNA, 276 bp, Homo sapiens
aggtcctggggatgcagcagtgcacaacaccaaaccaaaaaaatctttgattttatgtcttcaaggtggggaagagagccaataaacgagccaataaacaagccaaccgtgaaaatgatgtcaaatgctaaggagaaaaataagccagggaaaggggttaggaagtctatgtgcatgtgtatagtggggagagggggtgaagagtggcaatatagatagggtggccagagaaggacggactgaggtgagagagtgaacacatgcctctccggagga

SEQ ID NO: 123645 - DNA, 509 bp, Homo sapiens
aaaaagctgggaaaatactcataaaaatgtcacaagaaaggctaacatccctaactcgtaaagagttctactggttaatttaaaagtgagagaatcccagtggagtaatagatgaagggtgtgataggagtagccatttggcaaaaaagggactacacctagctcattaaagtgtgaaaaaggtttatcctcccaatttattaaaatgtgtattatctacatgattctgttggaattgagagtgaatgaggttgtacaaactaagtcactctgatggagatggagtttagagacggagtctcagggaaggttagtgcggccggtcagtgactgctctttctggcacagtgcatacgtccttggtaggacctacattttaaaacttatttttttattgacttttcttatggaaaatttcaaacctattcagaagtgaagagaatagtttaatgaacccccatgtgtcaataccaggcactccaaaacagtatacttttatctatatccca

SEQ ID NO: 123646 - DNA, 660 bp, Homo sapiens
tccctttctcactggggcattgaggacacacatgaaagaggcgagggggcgagaaacaatgctggcatctccatcctgggaagaggctgggaagagtgactcagtcacaaaaaataaacaacaccagcttttgtcttagaaattcaccctgtttgacttcatggattcccatcggtctgcaaggacccgggttagcctgggatcctcttctgtggctttggtgagcagatccccactccgcctcctcttaggacgcctagtcctgccgtgattggccttgggggcccgggggtgacctcaagtgtccccagccaggccgcccaccccaatctcaagaagaaacagggtgggaggaagcagggcaatctcagcacccatggcagaggaggccacggtggaggaggccacgcctggctcagcctggagttggggacgtgaggaggggctgagacggtcaccccaagacccccacttcaggccagctcagagggtccagggtgggggtacttgggagaaggcttgtgagggggtccctgtggccttcagggaatcccaccccatttggatgttacctccaggctggtcctaggggctgggcacccacaggccagaggccaaggaaccaggaagtgccccccgacatgcgcttggggagcccca

SEQ ID NO: 123647 - DNA, 222 bp, Homo sapiens
gagacttctcaaaaattaaaaaaattaaagagaccaagatttgggcaatggatgtgtaaactgctaccgggtagtattgtttctaggccgtcccatctggtagagcaaggaaatatttgtttatggttatttttcttatagctaacatgtactgtatttactataatggaaaaaaaacattttccttttgaaacatgcaaatgatccactgtccacagagac

SEQ ID NO: 123648 - DNA, 502 bp, Homo sapiens
cactctcatgaagggcagcatttaggtgctattaaagcacaaagcaggactttgaatatttcacactggagcccacatggcttatgttcctaattcaaatttccagagggtctaaaatcaactgaacctcaaagagattgtttctctggaaccatccaacttcttagaggttcattttccaaatttaatcatgtgacattgctgaagatttaagaataatagcacttttgtctggtcatcggtatttctaaatagcttgaaatttcactccttctttgaatattctatagctacagactttccaagttgaccaaaatttatctctctctctgttcccaccctactcctctacgccctacaagggagatgggtactatatgacatttctagccttacctttgcagtagtaagctaaaaccaaaggttctcattttttttcattccattcgttaatccactcactcatttaatggatggttcatgacctcacattagctacagt

SEQ ID NO: 123649 - DNA, 421 bp, Homo sapiens
tggaggcccattcctcctgaggccaagttcctccctggctgtgggccagcataagcgaacaaggcgtgtacttccggaatgctatggactgagtgtgtgtctccccagaatccatgatgttgaagccctaaccctccagtgtgatggtgtttggagacgaagcctttgacaggtagttagagtcatggcggtagttagttagagtcatggcggtagttagttagggtcacggtggtagttaggatcatggtggtacttaaggtcatggtggtagttaggggttatatcagtagttagggctatggctgtagttagggtgacggtggtagttaaggtcacagcagtaattagggtcatggtggtggttagggtcgtggtggtagttagggtcacggctgtagttagggtcatggtggtagtt

SEQ ID NO: 123650 - DNA, 453 bp, Homo sapiens
tggaggcccattcctcctgaggccaagttcctccctggctgtgggccagcataagcgaacaaggcgtgtacttccggaatgctatggactgagtgtgtgtctccccagaatccatgatgttgaagccctaaccctccagtgtgatggtgtttggagacgaagcctttgacaggtagttagagtcatggcggtagttagttagagtcatggcggtagttagttagggtcacggtggtagttaggatcatggtggtacttaaggtcatggtggtagttagggttatggtagttagggtcatggcagtagttagggttatatcagtagttagggctatggctgtagttagggtgacggtggtagttaaggtcacagcagtaattagggtcatggtggtggttagggtcgtggtggtagttagggtcacggctgtagttagggtcatggtggtagtt

SEQ ID NO: 123651 - DNA, 260 bp, Homo sapiens
tcgagccggtaccgacgctctctctgtggggtgtgtcagactgtaaggggatgaatggaaatgctgctattttaagcacagtttttctggccagaacaagctaattctaaagcatgaggaacaattttctgccacaaagagttaatctgtaatactcagcagctcatttccaccttgcagaaagcatcggagtgtagagtcctgctgtttcatcattcacggactcgaaattcgttaccaggaaagcaaagcatttatta

SEQ ID NO: 123652 - DNA, 374 bp, Homo sapiens
atttgtttcgtccctgctaatgaaggtgttaaataaacttggatgctgttattgaagcttaaaaaataaatggaagctgggtgcgatggctcaagcctggaatcccagcactttgagagaccgagatgggaggattgcttgagctcaggagttcaagaccagcctagacaacatggcaacaccctgtctctacaaaaaattacaaaaagtagccaggcgtggtgatgtgcacctgtagctatgtgtacctgtagtcccacacagtcgggaggctgaggtgggagcctcccttgagcctggcaggtcaaggctgtgatgagccacgatcatgccactgcactccagcctgggtgtgacagtgagatcccttctta

SEQ ID NO: 123653 - DNA, 440 bp, Homo sapiens
caggctgcagtgcagtggtacagtcattacttattgtagcctctagctgctgggctcaagcgatcctcctgcctcagcctcctgagtacctgggactataggcgtgcaccatgcctggctaatttttaaaattttgtagagacagaatttcgctgtgttgcccaggctggtctggaattcctgggctcaagtgatctgccggtgagccaccgcgcccagcctgtctttaaaaattttaaaaagaacatcccactcagaccagcgttaacaataacatactttaggtggtcaaaaataataaattttgttgggtatatttcatcacaatttttaaaaagacaaatggagcatgccccgccctcccccccaaaaaagatgaatagcaacacaaacaggatacgggaaaataacattttggggtctatactcaaggtttttgg

SEQ ID NO: 123654 - DNA, 329 bp, Homo sapiens
gctaggtttataggtgtgagccaccacacccagcctacatgtaactttgtagtagccagattttaaaaagcaaaaagtaatgggttaaatgaattacaataatatattttacccagtatatccaaaatattgtcgtttcaacttataagcaatattgaaaatttactaataagctattttgtatctcatagtcttcaaaatactttatacttaaaacacatctcaagtcagatagtaaattttcatcagaaatacttgatctgtattctgactttctgaaactgatagttgaaaaagttaggttcacatacccaagctgttccattttc

SEQ ID NO: 123655 - DNA, 646 bp, Homo sapiens
atgcagtctcggctcactgcaagctccacctcccaggttcaagcgattctcctgcctcagcttcctgagtagctgggattacagtgggattacaggcatgcgccaccatgcctggctaatttttgtatttttagtagagacgaggtttcactgtgttggtcaggctggtcttgaactcctgaccttgtgattcgcccgcctccgtctcccaaagagctgggattacaggcatgaaccactacgcctggcctctttatggcttttaaaaagttatctgccagttcaagctcctttctctttttcattcattcattcattcattcatttatatcttttcatgtgaccagtagggtataaacagcccttaaagggcatatgtctggcctttgaaataattgtttggccactattaggtcttagggcctctggactattgagaagttacgtagcttcaacctgagtcacacattgtatatttgcttttgctagtctttccacattttatctgaaggtctgtttttacagaagccttgagatatgaagatccctgtgcccctgacccctccccattaggagtgttttttgtatttagaaattggtctcctgagttaggaagctccagcgttcccctcaggcggtctgagaa

SEQ ID NO: 123656 - DNA, 917 bp, Homo sapiens
tactatgcttatttttaaaattgaagaagtagtataagcaaagctattaggtaaaaaatggtagatatttttggatgtgtcaaatatgggaccctagggtaaatcaatagaaatgcaaagttgattagcagtcacctaggcttcggagggtttcatggatgacagataaagcctatgggttttctttgggggatgagaaaaatgttctcaaattcattctggttatagttacacaacatgaatatactaaaatccactgaatgctatactttaaatgggcaaaatctgtggtatgcaaataaaaaataaagctgtgataagaaaaaaaagtggaaccacaggaaaaagcagtataaaactattgtttcccttgatgcatcactttagcttaacgatggtgtgtagtcctggtgttgttattccacgggagggaattttagagtgtgcctctttatcgctgctcttctctgtctagtacttcatcacttctgaattcatgacttgctctcagatgttccaactagcattttgtatgaatttaaacttggctgcatctgagctgtttctgtcttaaaacattggcttcttggaattcccaagcaaccggaaaatttcccaatattggaaaagaaaagatcatgaaaaatcctaataaaaacggtcagaaatgctgataaactaaacaaagtaagtcttgaagacaagggtaaaatgcctttaggaagtgtgtccaaaactgttcactgcattgatgagtctgaaattttccatatcatcaagctaatttattttcttcaatttgattgacttttagaatatcaacctccaggcacaggcagtatatacctaaatgcagtgtactcactgaaactgtaatggtagacataagactctggaatttaaaattccagatgacc

SEQ ID NO: 123657 - DNA, 599 bp, Homo sapiens
tctttacttgacaaagggcagttttgtcaagagtagaaccaaaagtgatagcaacttcagggtgatccccagcttctctgtgcctaagagtgacagagctttccagtgttcagtgtaagaggctatagcatttaagttggatgaaatgctcccctttctatctttctcccatggaaaaagccaggtcagggttaaatctaattttcctctggctccaagactctgctgcaaatcgtattactgaactttgcttgggaatatagcaaaccccagtaagtggtctcactataaatagctggccatgcatctcaaggtgaccctctccagcaaccctgctgtatttcttcaatacatttgcttcctaataccccaagatggtcacttaattatcttttcctttttcctttcctcctcaccattcatgttcacattctgatgaaatttttcaaactgtaaaaggaaactggaagcattcagaggagaagcccatcatcatctcaccatcactgaattcctaaacctaagtgcatctgtactcgaatattccccctttgattaaaatgaaagaaaatctcttgcacttcatctgcttgcaaatt

SEQ ID NO: 123658 - DNA, 544 bp, Homo sapiens
acccaggaggcggaggttgcagttagccgagatcgtgccactgcattccagcctgggtgacagagcaagactccatctcaaaaaaaacaccaaaaaacaaaaaagaagctatactatgagatcttctaccccaaccatgtgctcctgcactgtccctctccctccacagtccacaaaagaagagcagagataagaggggaaatcttggattccctgacctactataatgtgctgtattttggggtggtcctctccctaccccacggtgggctccaagatcatcagttacagagactaggggtaccaaaaaagaaaaaagaaaagaaaaggtttggggtaataacttttaaaaagtgtaatgtcttgtgaatatctgatcaggcagtcgacttacagatttggcctgcaccaatctggacagaggaaggagaaactgagcaagaaggagcagcactgctgttaccccactgtttggcacagatatgtcttccctgggtcatacagtccatagaaattgctggtcttaagccctcttgccagttcc

SEQ ID NO: 123659 - DNA, 365 bp, Homo sapiens
agtctccagacttcttttcatcctgtaaatctaaaactctatacccattaaatgataactcttcatccctcccttgccttagcacctgtcagccaccattccactctttgtctctatggatttgactaatctgtttatctcatataagtgaaatcatatgatatttgtcatttaattttattgtattgtagagatggatctcactctgttgcccagactggagttcagtggcatggtcatagccccctgcagccttgacctcctgggctcaagcaattctcttgcctcagcctcccaagtagctggaactacaggcatgcattaccttgcatggctaattaattttttttgtagagacaggatct

SEQ ID NO: 123660 - DNA, 407 bp, Homo sapiens
ggactacaggcatgtgccactgtgactggctaattttttatatttttagtagagacaggatttcaccatgttggccaggctgctctcgaactcctgacctcgtgatccgcccgcctggatctcccaaagtgctgggattacagttgtgagccaccgcacccggccaaggtagcaacttttatttgagaaagcttggaatcctgacctaagctccctgagttcccactgtggcttgtggccacctattgtgatactcactctctacccttggttttctgatctctaaaatgagactgtctacttcacgtggctgttaaatgcatcataatttccttccttacctcccttctttaaaggaaacttggaattttcaaagctactaaatggagtttttttgtgtttttttt

SEQ ID NO: 123661 - DNA, 518 bp, Homo sapiens
tcctgagagtcgggccgagccccgtgtgtttctgaagactctgggggtgggacacggcggggaggtggtgccccgcggaccccggggtgccaggcacggaaggcgggactctgggagaagcgtgcggaggaccgtggcgtcggcgtcccggatgtgtcggtcgtgcccggggaggccgggttcccctcgctgcgggccaggcttggctcctgattccctctctggtccctgtattggtcaacacttgagcgtacaatatcttgaacatgcttcttccaatgggttttgtttcccatttcctgcccctttcgccactcacggaccttgaggccagttgacggcccttctccccacgcctgtttcttttgaaagcaagtgtagacaccttcgagggcagagatcgggagatttaagatgttacagcatatttttttttcttgttttacagtattcaattttgtgttgattcagctaaattatgaaaaataaagaaaaactcctttgataaaaaaaaattt

SEQ ID NO: 123662 - DNA, 1041 bp, Homo sapiens
tcctgagagtcgggccgagccccgtgtgtttctgaagactctgggggtgggacacggcggggaggtggtgccccgcggaccccggggtgccaggcacggaaggcgggactctgggagaagcgtgcggaggaccgtggcgtcggcgtcccggatgtgtcggtcgtgcccggggaggccgggttcccctcgctgcgggccaggcttggctcctgattccctctctggtccctgtattggtcaacacttgagcgtacaatatcttgaacatgcttcttccaatgggttttgtttcccatttcctgcccctttcgccactcacggaccttgaggccagttgacggcccttctccccacgcctgtgtccccgcgttctgagaagtcctctgtcttcgtgtcactaggtccagaaagtcgcgccgggcagaggcgcaggcggggccggcagggccgaggaataagcgacaattctggtttttctcccctggccgtcgttcgccagcctccttcattttcctgagttcccgctgaagtatatactacctatgagtccaattaacatgagtattatgctagttctatcctactaaaaaaaacgtaaaaaaataactatatagaagctgttccagcaaccatagactgaagatacgaaagaaaatccatttatttaagacctgttccggtatccatgaggacataatttacctttcagtcaccacaaatttataggcatttgtatcctggactaaaagaaggggctgaggttgggtttgtcatcacagagggggtgggcctggaaagggtccttcccaagctgccccggctccggcggcccgggccggcagcctctgccagccagcgtcctcacggcctccccctcgcctgtttcttttgaaagcaagtgtagacaccttcgagggcagagatcgggagatttaagatgttacagcatatttttttttcttgttttacagtattcaattttgtgttgattcagctaaattatgaaaaataaagaaaaactcctttgataaaaaaaaattt

SEQ ID NO: 123663 - DNA, 326 bp, Homo sapiens
aactcctgacctcaagtgatccgcctgcctcagcctccgaaagtactgggattacaggtgtgagccaccgtgcctggcctgatgatggatgtttgactcctgcataccacggtgttcccatagcacggctcacccctcataaagatgtttatctaacctccccagtggtcacaggtttcacaagaaagtctgaggcaccactagctgcacattttcccaaaaaagcttgctatataaaggatattttctggaagacaagtgtggtgattcgctgtctctaggccagcagggacatcacttctgtttgtaagtccctattaaatgcc

SEQ ID NO: 123664 - DNA, 3665 bp, Homo sapiens
  misc_feature (1404)..(1404): n is a, c, g, or t
  misc_feature (1531)..(1531): n is a, c, g, or t
  misc_feature (1539)..(1539): n is a, c, g, or t
  misc_feature (2440)..(2440): n is a, c, g, or t
tgcagatgatctgcagcctctgcgggtccaggtcctgcttgccgccaggcctcctcctcctgcatgtgggggaagtagacctccgtgaagttgcagatgatctgcagcctctgcgggtccagctcctgcttgccgccgtccccgtagcagctgtcctgctcgcccagcttgcggtagtggaagagctcagggaagagccagtggaggaggaagacggcaaactcgcctgtgaagaggcttcatgcaggaactaagtgagggcctacatgtccaccacgtggtctgaggcgatggtgctgctccagtccagagacaggccctcctcctcgtctttgtggtccaggaagtggccggggtccactgctcagcctcaagctggcagcctggccaccgggctggctgttctccatctcccgctgggcccagaagtggctgaagaacttattcagctggggcaagcactcggcctgtcacacagccctctccttcaccgaggggtagtagacctccatgtagttgtggatgagctgcaggtgcagtgactccagcttaagcttggcctcaaagctgcaggcactgcagcctcgggagaagttgactgtggctgaagagcttggggaagagctgcaccagcgggcagcaggccaggaccccgcctgacaggctctggtccaagatctgcttaagctccatgcccgtgagctgctacggggtggtgggggtcggctggaatttggccaccatctcagtggggttcaccttcagggagagcaggtccactttgctgtgtagctgggacctgttggacgtgagggtgttgagcatgtagaacatctcctggatcaggaagtagatgttagggtcactgttggtggctgccccagtgctgccacagtcccacttctatggctcattcaggagcctaagcagcgaggggctgttgctggaatttgccttctggaagagctcatacgtgtttagcaggtcccccgagggagggttcttcttctccatgaccttgtgggagatgccatacagaggcttcttgtagtaaggggtggtggcatggttgcggggctcctccttgcctggccacacagagcccgagctcctgccttgccggcctgctctccattgccttggcagggcgagctgttctcgggttccacatgcctgctaggagcgcctctgggatcagctacctcctctccacgctggggatggagtctggctggccattgctgaccagctgagtcctggagggcagtaaagacgctgtccagaaggtgcttctcagaagtcctggaattcacggagcagcctagagcagcatctttggcctctgtctccactctcacttcttagaagttcttctacatcaattttttttggagatggttctgnctctgtcacccaggctggagtgcagcagttgctcagagctcactgcatccttgacctcccagactcaaaagagcctagctacttaggagtagctaggactacaggccacggccaccatgcctggctnatcttttnaattttttgtagaggcagaggtctctcattgtgttgcccagacaagtctcaaattctcgggctcaagtgttcctcccaaagtgctgggattaatggcgtgagccactgtacctggccatattttttttttcaaaaaattcatttgtagagtttaaaaagtatcttttgatcaagagttcttattgtatttatgtttgcaaatttcatttcccattctgttgcttgccttttcactctcagtgagttattttatgattacaaatccttattttttatgttattttattactatttattaacttatttatcttatttattagccttcaatcgttactttttgagtcttttttaaaatcttaaggtcatagaagtgtcctctgtattactttttaaaaactgtactgttttatgttacacattggcttctatatgaaataatttttgtgtatgttgtgaggttggatgttaatattcatttttatctgtaccgatgtatgaaagacagcacaatttattgaaaatgaatcttttcctcattgtactgaagcactatttttttcacaaatcagctaaatatattgtgtggttctctttacgagctctctattctgtttcattgaaatatctatacttgcaccttttccataatgtcataattaatatacatttataaaaactttatatctaatagtgtaagtcttcacattatattttttcttcaaagttatctatacactgcatttttatttgcattttatagtcagtttttcagttgccaccaaatataatgcagacaaattatgctattactaatcacagtattgtgattttcagtgtattacaaatatagatttatttaaaatactgaatctttcttctaataccaggaatgacataggancacagtacacctttatttctgttgaatatctttaatttctctcagtaaaatttcacaattttcagtaaagggattgcatatgatatgttacattttatattaggaattcaatgtttcttcctggaaacatttcagatttttaatattttatttgatttagactcactacatttggaaagctttaattgtaattttatttttaatagatatagagctattaggatttgctatttattcttgtgtcactattaatgattttctagaaatgtatctatttcatcaaattatttcaaaatttttgacttaaagttacttattacattctctttttctctcccatgactatagaatctataatgatttccttgttattattcatgatatttagaatttgtggatactcttttttttaaatttcatgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgaaattgacaattagattattaattttcaagctttaattttttaaacatatttatgtaagcatatgcatttatctccaagctgaggtttgcctaagcctcccatcttttaacaagcagtatttttactttcgtttttattaaattcaaaatatattttaatattcactgtaattactttttcgatccatgaataacttagaaatgtgatgcttaatttctaaacatttggtcactttcaaagtcttgctatagatttgcagcttaataacattgttgtacaaaaaacactgtcaaggatttcaaatttttggtatttattgattcttgttttgggcctaacctcagcctatatctgtctatctaacctatctatctatctatctatctatctatctatctatctatctacctacctacctatctattatctatctacctagatagacagagatatctatagatagctatggtaaattttgaaacacgttccaaatacattataataaattgtgtgttttgctatttttgggtgcagtttttatatcaaagtatttaatcctactgctttaaatttttctattattattgatattttgtatcctttttgctatcagttattgaaaaaggtatattaaagtctttatgattg

SEQ ID NO: 123665 - DNA, 3901 bp, Homo sapiens
  misc_feature (1404)..(1404): n is a, c, g, or t
  misc_feature (1531)..(1531): n is a, c, g, or t
  misc_feature (1539)..(1539): n is a, c, g, or t
  misc_feature (2440)..(2440): n is a, c, g, or t
tgcagatgatctgcagcctctgcgggtccaggtcctgcttgccgccaggcctcctcctcctgcatgtgggggaagtagacctccgtgaagttgcagatgatctgcagcctctgcgggtccagctcctgcttgccgccgtccccgtagcagctgtcctgctcgcccagcttgcggtagtggaagagctcagggaagagccagtggaggaggaagacggcaaactcgcctgtgaagaggcttcatgcaggaactaagtgagggcctacatgtccaccacgtggtctgaggcgatggtgctgctccagtccagagacaggccctcctcctcgtctttgtggtccaggaagtggccggggtccactgctcagcctcaagctggcagcctggccaccgggctggctgttctccatctcccgctgggcccagaagtggctgaagaacttattcagctggggcaagcactcggcctgtcacacagccctctccttcaccgaggggtagtagacctccatgtagttgtggatgagctgcaggtgcagtgactccagcttaagcttggcctcaaagctgcaggcactgcagcctcgggagaagttgactgtggctgaagagcttggggaagagctgcaccagcgggcagcaggccaggaccccgcctgacaggctctggtccaagatctgcttaagctccatgcccgtgagctgctacggggtggtgggggtcggctggaatttggccaccatctcagtggggttcaccttcagggagagcaggtccactttgctgtgtagctgggacctgttggacgtgagggtgttgagcatgtagaacatctcctggatcaggaagtagatgttagggtcactgttggtggctgccccagtgctgccacagtcccacttctatggctcattcaggagcctaagcagcgaggggctgttgctggaatttgccttctggaagagctcatacgtgtttagcaggtcccccgagggagggttcttcttctccatgaccttgtgggagatgccatacagaggcttcttgtagtaaggggtggtggcatggttgcggggctcctccttgcctggccacacagagcccgagctcctgccttgccggcctgctctccattgccttggcagggcgagctgttctcgggttccacatgcctgctaggagcgcctctgggatcagctacctcctctccacgctggggatggagtctggctggccattgctgaccagctgagtcctggagggcagtaaagacgctgtccagaaggtgcttctcagaagtcctggaattcacggagcagcctagagcagcatctttggcctctgtctccactctcacttcttagaagttcttctacatcaattttttttggagatggttctgnctctgtcacccaggctggagtgcagcagttgctcagagctcactgcatccttgacctcccagactcaaaagagcctagctacttaggagtagctaggactacaggccacggccaccatgcctggctnatcttttnaattttttgtagaggcagaggtctctcattgtgttgcccagacaagtctcaaattctcgggctcaagtgttcctcccaaagtgctgggattaatggcgtgagccactgtacctggccatattttttttttcaaaaaattcatttgtagagtttaaaaagtatcttttgatcaagagttcttattgtatttatgtttgcaaatttcatttcccattctgttgcttgccttttcactctcagtgagttattttatgattacaaatccttattttttatgttattttattactatttattaacttatttatcttatttattagccttcaatcgttactttttgagtcttttttaaaatcttaaggtcatagaagtgtcctctgtattactttttaaaaactgtactgttttatgttacacattggcttctatatgaaataatttttgtgtatgttgtgaggttggatgttaatattcatttttatctgtaccgatgtatgaaagacagcacaatttattgaaaatgaatcttttcctcattgtactgaagcactatttttttcacaaatcagctaaatatattgtgtggttctctttacgagctctctattctgtttcattgaaatatctatacttgcaccttttccataatgtcataattaatatacatttataaaaactttatatctaatagtgtaagtcttcacattatattttttcttcaaagttatctatacactgcatttttatttgcattttatagtcagtttttcagttgccaccaaatataatgcagacaaattatgctattactaatcacagtattgtgattttcagtgtattacaaatatagatttatttaaaatactgaatctttcttctaataccaggaatgacataggancacagtacacctttatttctgttgaatatctttaatttctctcagtaaaatttcacaattttcagtaaagggattgcatatgatatgttacattttatattaggaattcaatgtttcttcctggaaacatttcagatttttaatattttatttgatttagactcactacatttggaaagctttaattgtaattttatttttaatagatatagagctattaggatttgctatttattcttgtgtcactattaatgattttctagaaatgtatctatttcatcaaattatttcaaaatttttgacttaaagttacttattacattctctttttctctcccatgactatagaatctataatgatttccttgttattattcatgatatttagaatttgtggatactcttttttttaaatttcatgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgaaattgacaattagattattaattttcaagctttaattttttaaacatatttatgtaagcatatgcatttatctccaagctgaggtttgcctaagcctcccatcttttaacaagcagtatttttactttcgtttttattaaattcaaaatatattttaatattcactgtaattactttttcgatccatgaataacttagaaatgtgatgcttaatttctaaacatttggtcactttcaaagtcttgctatagatttgcagcttaataacattgttgtacaaaaaacactgtcaaggatttcaaatttttggtatttattgattcttgttttgggcctaacctcagcctatatctgtctatctaacctatctatctatctatctatctatctatctatctatctatctacctacctacctatctattatctatctacctagatagacagagatatctatagatagctatggtaaattttgaaacacgttccaaatacattataataaattgtgtgttttgctatttttgggtgcagtttttatatcaaagtatttaatcctactgctttaaatttttctattattattgatattttgtatcctttttgctatcagttattgaaaaaggtatattaaagtctttatgattgaagacgcggctattgctccttttagttctataaaaattgtaaatgtgtgttaactgtgtgtgagtgaatatacatacacaagtttgacaacttcctcaatagttgattcttttatatgggatgatgggatacatcttcctttcaagtaataatttctgccttaaaatctcttttgtctggatattaacatagctaaacaaattttcatttgggcttgtgtttggattaccctttta

SEQ ID NO: 123666 - DNA, 282 bp, Homo sapiens
gttaatttacactttttaaaaaatgtatagctgtgaagcctgacctggttgaaatatgttgggtaatttattaacaaaagctgtgtgtgaactatttaggagttccatttgaatttcctaaacagttggggaattagcttcatggagggcacaggtatgtatggtaaaaactggcaggcaagtggacattaattgactgaaaagagagcttcagtcatactggcttctgtacaagtaaaacaatcagttttgagtgatgaattatatctaaccctgtgctaa

SEQ ID NO: 123667 - DNA, 460 bp, Homo sapiens
taagagtagtttcgtgtaattctttacttaatgtcttaatttaactgccatataaaaaaaaagtgagcaaccttcaaatcacttatttgcagtatagtataatataagcaggctgaatctgtggataacattattgactgatttggaatacacttcataaaggtttatacacctttgtgctaaccacttttaagaatgttaataggtcaccttcttaaaaattgattcagtctatctcaacagagcaaagcttccttaaattggctttagaatttaagaatttggaaggaatatttaatgatagcaatacacagtgtatttttttatgattttcaggataactgcagtgagtaaaaggagtaataaaaccaatatttataatcatctggataaatatatggttgcaacataatttctcctgttgagaataaaaatggttggagaaatccactcttgtctc

SEQ ID NO: 123668 - DNA, 545 bp, Homo sapiens
tcctgtctcagcctcccaaagtgctgggattacaggcatgagccatggtgcccagcctcatgtgaggtttaagtctgtgttgctgggcccagctggaagtcactagtggctctttgccttcgcgggggtttgctggggaactcagagggcagtgaggcccaggctgtgcccacagggagctcccaaacagcttgcctttggcctgcgaggatatggaccgaggaagctcctgttaaccaggtttcaaaaactccatcgtatatacattggctcccctgggaggagacgtaggacatggagaatgtcagcgctggaaaggaccttagctatttctgacctagtcctttgttatgtcatggagaaactgaggcacacatctgggaaggccagacttggctcgccctggccaagccagtatgtcactgatgactccctggagggatagggaatttcccatggtttctcaactgcaggaagctgaaaatgtctcagcgtgcatggaatttgatgagcgttttgtccctgtgatgcgggggcagccgaga

SEQ ID NO: 123669 - DNA, 439 bp, Homo sapiens
gacgaagggtggcgcggagatgaggctgggggcctcggggttgggtgttagccaaagacacaggctgggtaggtgaagacaggtcaaggcctaggtatgaccgtatgtttggaggaaaagagactggaagggatgagaagagagtgatggcggatttgtgggtagaaactaaagaaggtgtggagggagacgacaggagcatgtgtataattcagggactaagaatgaagaggaacactaggagatggttctcaattgtccccaaaagacacaacaaaaacttgtcagggactatcagtacctctgaatgagagtccttccacttccagttacagggcaagaccaagttactcccaaaagagcaaggccaggctctggtcagctaggaacagcgtctgctcactaaatacctactgcttggctccaggtgaggtcgact

SEQ ID NO: 123670 - DNA, 545 bp, Homo sapiens
ccaaagctggagataagtgggtgggagggaaggatacagagagggtgacaggctgagggttcaaaaggaatgaggggtgatggaagaaaccaggaggtgcatgtgtgtgggtgccagagctgggaagggaagggatggggcaggttgcagaggaccaagacgaacatggggcagggtaggtgaagacaggtcaaggcctaggtatgaccgtatgtttggaggaaaagagactggaagggatgagaagagagtgatggcggatttgtgggtagaaactaaagaaggtgtggagggagacgacaggagcatgtgtataattcagggactaagaatgaagaggaacactaggagatggttctcaattgtccccaaaagacacaacaaaaacttgtcagggactatcagtacctctgaatgagagtccttccacttccagttacagggcaagaccaagttactcccaaaagagcaaggccaggctctggtcagctaggaacagcgtctgctcactaaatacctactgcttggctccaggtgaggtcgac

SEQ ID NO: 123671 - DNA, 524 bp, Homo sapiens
tgggctcagttccctcaagtctataaaatgggcatgatattattatgcctcctcatcagggagatgtaaagactgaatgagagaataaatgggtagaactcagcacagtgaatacaagcagcaggtgcttgctaatatcactgagaagcaagaaatgcctttttcttgatgctcagatcacctgtgtcacagcaatggtccaacagggagaagggaatggaccagggaggaggcgcagagcggaacacaaatcatcctctcccttccttgaacctgcattttttttttttttgagactgaatctgtctctgtcacccacgctggagtgcagtggcatgatctcagctcactgcaacctccgccaccagggttcaagcaattctcctgcctctcgagtagctgggattacaggtgtgcaccaccaggcccagttgatttttgcatttttagtagagacagggtctcaccatgttggccaggctggtctcgaactcctggcctcaggtgatcgcctgcctcggctt

SEQ ID NO: 123672 - DNA, 714 bp, Homo sapiens
ctttgttaccaaccctatctttctacttcgtatggctacaaagagtttctttctttttgagaatattcaagcttaattttgatgtggtttattctcatttgtttgcagggctgaagtataaacatctttatcttggtagttcttcctagcataccagtttaaaccaagaaaccttttaatattcgatttccacgcttttgatttgttttgtcatttttactctccgaaaaaatttctgaaaagctagtaaacttattaaactctgtgtgataatgtcttttccatcaaagacttaaaaaaatctttaaagccaaaagtttaaagactattcatttattatgtcaggagttagatatttaatttttaaaatcaaaatagtggataaccacttattttcctgggaaaaattattttttgaacctgaaaatgactttattttactcatcacaggaatacaagattggtaagggtttggctgggttcaaaataatcttctcctcacaaaatttgaagatattgctataaaggcttctaagtatccaatgttgtccaacctaccaccctcccttctacaaacctccaaaaatgcctcatgacccagtgagaatatcaatgagctgagatcttcaattcttcaactgaagtttttcctgctacttcttggctagctcactttccattttctagtaatttccacaaaaactgattatactt

SEQ ID NO: 123673 - DNA, 628 bp, Homo sapiens
ctctactactactacttcatgaatgaaagagatgaacttctcagcccacctataatctactgatcgtatgaggtttactgcccgctggctcagttggcacttcttagaggtcattagcatttcctaactcagtaaatgcaggtttttcctatcacagccttgctcacagcacttacagcctgtgccattcctgaaaatggtgtgcctgctccatatttcactactttgatcctaccaataagtcaacgattgagtaagactatttatcatagtcttggctatctggttaattcatcaggtcaacaatgatgctataatcagaaactgaagctgtcaaaatgtaattttaaatgatgcttctaggcagggagtggtggctcatgcctgtaatcctagtactttgggatgccaaggtgggcggatcatttgaggccaggagtttgagatcagctaggccaacacggcaaaaccctgtttctacgaaaaatacaaaaattagacaggcgtggtggcatgtgcctgcaatcccagccactcggaaggcgaggcgggagaattgcttgaacctgggaggcggaggctgcagtgatccaagatcatgccaccgtactccagcctgggtgacgga

SEQ ID NO: 123674 - DNA, 513 bp, Homo sapiens
agatgcagtacggatgtgggcctgtagcaatgtctaggtgaggcagggtatggacctatagcaaggtctaggtgaggcgggatgtggacctgtagcaaggtcaaggtgaggcgggatgtaagcctgtagcaaggtctaggtgaggtgggatgtggacctgtagcaaggtctaggtgaagtaggatgtgggcctgcagcaacgtctaggtgaggcggggtgtgagcctgtagcaatcagtgtttggagcgagttattaaagaggagatgggatttgtcaatagtgagtggggattccttggcccttctgggtttcctatccagaatgttccctgttggctaatggcatcatcatgggatcatttcctcaggctgggatctcccacccatctctcacactccacactcctgctttacagaacatttcctggagtctcatttcctagaatgaaacataagaagggcatctctgcacctgctccctgctgactgccctccactgcacatccgtactg

SEQ ID NO: 123675 - DNA, 503 bp, Homo sapiens
accccatctctacaaaaaatacaaaaattagccaggcacggtggctcacagacttgtgggcccagctactcgggaggctgaggtagaggattgctcaaacccaggagggagaggctgcagtaagccttgatcacgccactgcaccccagcctgggtgacagagtgagaccctgtctcaaaaaaaaatcaaattacaggctgaggctgttcactgggccagcaccaggagttggggccagatgagtgcagagagcaggccccgggctccctccaggtggtggctatactctgccccagcgggagctcacagagagtctgtggggctctgacctcacacagacaggtagcctctcccggggccacagccgttgccggggtcagcacaagcctgggatggctggttggctccctcctgcagcagccagttacatgtgtgcagcgtgcagtgtctataactcgtgtgctgtgtgcagtgtctgtgtgttgtgtgctgtgtgcagcgt

SEQ ID NO: 123676 - DNA, 291 bp, Homo sapiens
ccagctgtgctggtgtggtctcacagaaaggatggaggacaggaacaagatttccagatggctcttgttcagggagtttaagagggtagcttcaagaaaggagggagctggactcaaaaaatataaaacataatactttaaagtacaactttaaatgacaccgcagaattaaggaaacaatcaaagcagcagatctgcttccctatcagataggagaagctcattttgtagagagtgtgggccacaagtactgggaagcaaatgcacaaagaataataggtccagccaaca

SEQ ID NO: 123677 - DNA, 421 bp, Homo sapiens
tctacctggctccgggctggcattgggggttgtctgcacagagtcctgtgatgtgaactgtctatgggtctctcaggtggggataccagcacttattccagtggaggtggtgaagggtgcaatggactctgtgagggtttttagctttggtggtttaacgctctatttttgtgctggttggcctcctgccaggaagtggcaatttccagaaagcatcagttgtagtagtgtgctgagggaactgtgatgggtggggcctaagaactcccaagagtatatgccctttgtcttctgctaccagggtggatagggaaggaccatcaggtgggggtatggctaggcacgtctgagctcagactctccttgggtgggtcttgctgtggctgctgtggggggtggggtcgagattcccagttcactg

SEQ ID NO: 123678 - DNA, 752 bp, Homo sapiens
actcagtactagaagaaaactaccaagaactgcagcttcaaatcagtgccaatgtggatttcgcttcataccattgccaagcaagagatgtgcgctttaaggaaaccttggtttaccagacccgagtgtttgacataatgtcatgtgcatgaagcaaaggggtatttaaagcagatcaagagagtcaaggaaggcttcctggacaaggtagttccccagctgaactttagaggacagataggaggtaaccaagtaaagaagtgagaacaaagtgagagtgaaagaagtgagaatggggatagccaagtgaagaagcgagaatgaagggctctctctaggcagagagagcaacatctgcaacacgtacaaggacaaaaatgttcgatgtgattaattcaggacgtgtccagctggaattcagctggctctcagaagatacctcaaaggcagtcagctttgcaaaaccagatcaccaaggttcagctcaaaaagatcagcttagtcagggcacgatgcacacaggcagcaccctggacagcaccatggaccactgggccgagggttccccacagcccttctctgtggagccctcttcgggaatcatgccggtggggaagatcagaagttcaaagtaaaattctccccgttggacattggagacttcgagagcaaccttttctgccagattcccaacctgccacctggagagcaaggtccggtcctggtagcaaaagggcggagcaccttgccca

SEQ ID NO: 123679 - DNA, 214 bp, Homo sapiens
ccaggggtttcttttctgtgaggcaagattaggtgactctgaagcccaccccgctgcctttgactctcctccgatcgacggcccttctacaggacccgctgtgtgttcctcagctctcctgaggctccgttctgcatgcgtaaaatgaggtgacagttccccactcacagggtgtcatgagcgttcatcagatcttccgagtccagagagagcc

SEQ ID NO: 123680 - DNA, 193 bp, Homo sapiens
ctttcgaaaagcacaaaagggagctgttcgggataaaagaattattctaagacacaattatgatagtggctgtaaaacttaacaaatttactataaatcacttataataaatgaatttttcttttttaatttttttgagatagagtctcactctgtcacccaggctggagtccagtggcacgatcttggctca

SEQ ID NO: 123681 - DNA, 457 bp, Homo sapiens
aggaaattctatgttccccgtcatttatgcagactccagctaaacgtatgctagttgaactcatgccagctctgtggaagtgagggacagatacaagaaacatgggaactttccaagaaatgaagcttctttgctgccatgtcgatgatgcttgtttctgagaaactcaaatgtatggaagtgtagagtagagcttcccaaacagggtgccgtagttcacagatttgcacacaggggtgccagcataatgatctctgcagctcttggcacaccttggtatgtctggagtatgagatggacttaacatatgaatatacatataaatatatataatgtatctgtacatcttagggactagacaaacaaggtgttaaatgtgttcctctctggatggtaggtttatggaatcctttaatcattttacttatttgcttatttaaacttctgaatctgtaac

SEQ ID NO: 123682 - DNA, 676 bp, Homo sapiens
gggtcacgaattcagggggcatttggatgggtggttcaggcttgaggtttctcataaagtactaagcagacagtagctagagctagaacaaggagggtctgaagcagctcaagctggccagatacagctgtcatcctctctcctgtatccttttcttcccttttccctctttctctgcatactcccagggcctcgccatttggtctctctgtattagcaagtttgggcttcctcacagcatggtggcctcagggcagcaaaaggttttaggagtgaatgttctagaaactaaagtagacactgcattgccttttcatgacttaatctcagaagtcatagagccttacttttaccttatctattggttaaaatggtcacaatagccctctcagtttcagtgggggaggaggtagaccctgcctctccatgggaggggcatcaaagtctcattgtaggaaaagcacgtggcatagaaggtgttatgtagctatctttggaagagacagttgggcacatatggctccctggtgtccccgccattgggcagctccttgaatgctcctagttcttccctcctcctggctgttgcctctcgcctcctgcctgcttgtgagtctcctctgagtgttcccacagcaggccacatgcatttctatggaggtgacctgtcttttct

SEQ ID NO: 123683 - DNA, 344 bp, Homo sapiens
caacttctttgtctaagactaaagaacagggcagtcctcagttgatactcctcagtcagtgttaggtggaaatcaagagaaacctacatataaaatggaagctctgggtacatctcctactctttgataacacggatcactcagtggagacgctaaatgagacgaatgggacagaaaatgtaaaagattcacagatagcacacacacatttcatcctgctgtatatatccaggctagctgctaggaagagcttccaggctgtggcacctaggaagagaagcagctctgtagtactaaatatggccacagggtgtggagcttttccacccagccaatgactgcgc

SEQ ID NO: 123684 - DNA, 359 bp, Homo sapiens
ggagagcaaagtctgagtgggcacagggccttgcctaccgtgtctttctaggccatggatgatctggagagcacagatggcacggggcccttgacacatgaaccacagagccactaatgagtgtcacggtggtaggagaccaaaagaggggaaagaagacattacagaggctgggaagagctggagccaggaaggttccaggacaggggaacactgttaggtagaccccagtagacaagtaggcacagagttgacagtccagggtggcctggttgacatcttgcccccagcatcctggggactcagccaggaagatgggatttgggtgacaggtgggagagaagggcatgggagatttg

SEQ ID NO: 123685 - DNA, 535 bp, Homo sapiens
aggaggttgaggctgcagtgagccatgattgtgccactgcacttcagcctgggtgatacagcaagaccctgtctcaaaataaaataataaaataaaataaaataaaataaaagtccatgcttcccaaagtgatatagaaagtaaatgcaagccctatccaaaccccaatggcatttattattaaactagacaaaaataattacagatttacttggaaccaaaagagaccttaaacagtcaaagcagtattgagcaagatgaacaaagctgacgatattatactctctgatttcaaaacattagaaagcaatgccatcaaaacaagatagtactggcataaaaacagacataaagaacaatggaacagaatggagagtcccagaataaatctaatatatgcatacaatcaactgatcttcaacaagggtgccaaaaatacacaacagagaaatgagagtcttttaagtaaatagtgctggaaaaattggatctctatatgcaaaaggataaatgtggactcttacttcataccata

SEQ ID NO: 123686 - DNA, 817 bp, Homo sapiens
agcctggtgaattcaacattgattgggaatgaggtaaccacaaacaccgctgtctcaaatgaaaagggattcaagatctgacccagaaaacaagcatcgtaaccaccagataaaattttaatgataaacacaagatgctctacatacaagcaagactgaagtctctcatgctaagccatcaacgtaaggttttcttagaaagaggagccaccaggagcctctcgacccacagatcaagtttcatcctatcgatccacagaacgtggccatcgtgctctgtgctggcataatctgtaatgttgaacagaccccgagggaacagagaggcagagagagaaggactggcatctggactcgtagggggcctgcccttcgggagctccagagaagaaattcataattggctttgagagtcaaggctctcctttatttttaagttcttttgcgactctttcagtccagtctcagccttctgtcctcaagtgtcttctgacactctaggcagagatccctttaagctggaatgatctaagtaccttccggagttcacaccaaactgtagcatccgtgggtagaaaggagctgcatatcagttgatcgcaggcccacattttagcaacgagcatcgataacttaatggacagaatcgcaagtatctggaccatcaacctttctaaaactagttctgcagcactcccaagaagggctttcacctctaaatcatagccagtgaaacagaaactgaagaaaagcctgcctcctgggtacatcttgtttaaagcagaaatactttttttcataggcactgcatgccaca

SEQ ID NO: 123687 - DNA, 444 bp, Homo sapiens
acttgtaacccaagattttgtattactattaggataaatgtgtatctttcattagactttaattaatggtctatgtgtgttctctagccacatagtctagaaaagtcgtctctagcttctttttattgtacaccctgtccaaaaaaaatgtgcatactcccaatatctggatatttatgtatgaatagtaagtgtgcttaatatattacacattataaaacaaaattctttattaacaattaatactttacactgtttcaatttgtcttcccaatttcttagggtggaaccacccttcaagctctaacacaactgaaatagggtttatacgtctgtgaccaggagaaaaagagaaagcttggtcttgctgtacataaattttctcttcaaggagaagtacatatttcatgagaataaatagtttcagaatgatgctacagcaca

SEQ ID NO: 123688 - DNA, 301 bp, Homo sapiens
agactagaagtcatgctcatttcttccagaataaacagtaagctgttggatgattctataccatgtcagtggtgccattttggtagatgatggtagggtctatacaggggtcaaattcaggtttccattttattttctggagaaaagcatcccattgttgtgtcatctgcccatttccaagtactccctttctgtttgtttctcttgcctgtctttgcaccaactagtccctctgcaaaaatcctacctctcccccatctttattcacccacttcacttctcattctttttttcttatgct

SEQ ID NO: 123689 - DNA, 124 bp, Homo sapiens
ctgactcatcgggaggggctcctggcgtcatcgtggtggactggctgagcctgagctgggtcatcttgggagggaggatagagcatgggaggaggacaacgggagtaggcagcgagtgtgtctg

SEQ ID NO: 123690 - DNA, 222 bp, Homo sapiens
gcagaggatcccctctttacgagagaggtcagtagatttttagaagtgaagccaggtggtttaaattcaaaaggcaaatctgcccagaagactttgaactgcctaattccacacccatctcatatttgccaaatgaaaaatagtgaaaaccagaagccctaaaaacttaaaattctgggataggcaacaggccttattctcaatctgtattaaaaatgccta

SEQ ID NO: 123691 - DNA, 274 bp, Homo sapiens
tgatctcaaactcctggcttcaggtgatccaccagtctcagcctcccaaagtgctggggttacaggtgtgagccatcgcaccacgcctaaatatataaacctaatcagaagttgttataagtcttgtgaaggaaaagtacacaggtgttaaaaaggggaggctttcctgtggttagttcatcaggaaaagtttctctggcagttaaggggagacctaaaggaagagaaggagtagtcaaagaatactcaattaataacaaatgctttgaattgt

SEQ ID NO: 123692 - DNA, 348 bp, Homo sapiens
gatatagtcctacccacgacgacaacttactacagtgaaaggataccaagcacaatcagcaaagggaaagggtgcacagggagaagtgcaggagaccagacacaagtttccagagtcatctcatctcccagtagggtcacatagaacgcacttaattccctcacaacaaggtgtgaccacacatgtaaaatgctgccaaccagcggagctcagtaaaacctcatcacccatgagttgaacttggcactggtcacataagcagttctgcctggcatgaaccaaaattccagactcccaggaggaaagcagtgtgcagctttttgtttgcataagcagcttgggtatagt

SEQ ID NO: 123693 - DNA, 439 bp, Homo sapiens
  misc_feature (23)..(23): n is a, c, g, or t
  misc_feature (29)..(29): n is a, c, g, or t
  misc_feature (73)..(73): n is a, c, g, or t
  misc_feature (400)..(400): n is a, c, g, or t
  misc_feature (429)..(429): n is a, c, g, or t
cacccaattagcttgacacaggnacatgnctctgtactgaggcagctttagttctctcataaagcccagatgngttcacggccacttccatgtgtcaaacacactgggaaaaagccgcttgactttatgtcctggggcttctacttaggtcggtctggaaaaatgcaagcagttcagtgttcttttacatatatgagctctttatatagctcagaatgtgtactctttcaataaaccaaaaaaattagtccataaaatgttaggaatctagccagaaggccacaagcagccactgttggacagtcctggccactggcacaatccacacccaactttcaaacccgagtggctgggaacgtagatacgcgctaccacgcctggctcatgtgttttattttgnaaaagtcatttttggaaaactaaccttangagtctgata

SEQ ID NO: 123694 - DNA, 466 bp, Homo sapiens
ccttgctttatccacaactgttttggtaaattccgtgacactggccccagctagttgcatccgtgacacctactggctctgacttaaaaatacacccagaatccaactacttatactgcctccattataatcatctcttacttggattactgaaatagctacctaacaggtgtctcatctctcactctgtttgttgaatagccacctaattgatctccctacagactattctcagcagagaagccagagagagcatttcaaaacagaagtcacatcacaccccttctctgctcaaaacctgaccaatgtctccccatctcatttagagcaaaagttaatggctgtaccatgtcccaccttgataactccctgactcttcccttcactgacactgagcagggcaggtcctcaagctggactgccgggcacgtgaaagccccatgtcccctgcacgcacagctccctc

SEQ ID NO: 123695 - DNA, 488 bp, Homo sapiens
tgtttggcagatgtgaggttatggtcggtcagcgatgtctgtccacacataggcacgcctctggactcactgaatcagacaccctgggacccggctctgcgatctccgtcttccaagccgtgcaggtgatgctggaccacacttcagttgagaatgaagggatggaaattattttaaattgaaaactcctgaacagtcagcagccgcagaaagaaactacctccacttaagcagctgccccaggaagcagagctgctttgacccctctgggggcatttcctgcttggaggaagactaaacccccccacaccgagcagtgcagtacaggccgggcatggtggctcacgcctgtcatcccagagcttggggaggctgacgatcatctgaggtctactcgagaccagcctggccaacatggtgaaaccccatctttactaaaaatacaaaaattagccgggtgtggtggcgcactcctgtaatcccagcta

SEQ ID NO: 123696 - DNA, 302 bp, Homo sapiens
ttaaaaatcgagttatggcctagcatattgttacggtggattctgagttaaagtgaaagtacgagtcatgcttgctgtgttgtttatgcagacaaggaagtgtgtacagtggtctgaacattgtccaccttttatgtgtctgtcaccactgttggctacttcatcccctcaccaggctggataactgatgctttactactgactacccatctcattttcatgatttcatgctttagacatacaaagagaatctggaatcagatcctgtagtaaatcagtagctgtagtaaatcagtagccac

SEQ ID NO: 123697 - DNA, 505 bp, Homo sapiens
ggcctggtccagaaagctccccagcaggcatcaccttcatggcaccgagctacccgcatgcattgtattacaagtttaacttagaaaagtaacagaagtatattgtagaaaattagaaaatatattcgacccccctcccaaaaaaaatagctgtaactcatacttttaagtttcttacctgctttaactgcatctttaattatattgataacatcactggtaagaattaacatttatacagtacttactatatgtcaagcagtatgttttgcattttacatatacatgtaataccatggaaggcaggtattacccccagtttacagattaggaaactgaggctcgaagaggttaaacagccttcccaaggtcacatggcaaataagaaagtcagaattaaaagcctctacgtccacaacccattttcctgtcttctacactatggttcctattcccttgagtcctaaatctgccactaataatgctgaagaaagggggaagagag

SEQ ID NO: 123698 - DNA, 408 bp, Homo sapiens
ttcatgaaatcgactgcatgggttccaatcccacctcttacacttctcagctgtgtgactttgaatttgagttcacttctctgggcctgttttctcatccgtaaaatagggtaataacatctgccacctgggattactgtgaacgttaaactaatattcatagagtaagcgtgagtcaggtgtttgccgttattattaagcctcacagcagattgttcttaccgtccagaattttttttttgagacagtctctcgctctttcacccaggctggagtgcagtggcatgatctcggctcactgcaaccttcgcctaccgggttcaagcaattctccctgcctcagccgcctgagtagctgggattacaggcatgagccacagtgcccggccccagaagtgcgcctgggtg

SEQ ID NO: 123699 - DNA, 111 bp, Homo sapiens
tcagggggtcttggatcgtgggtgaggtctggacagggagggcactcagggggtcttggatcgtgggcgaggtctggacagggagggtactcgggggtcttggattgtggg

SEQ ID NO: 123700 - DNA, 172 bp, Homo sapiens
aattttacaacggttcacttttccagagacccttaatcaattttcacagaggaagatgcttctgaaacactcttaggaatgatgcttccatgtgggttcagacgccaggaattggttctagttgatacttctgctatttcctattgtagcttagaatgagtcaccaagcaca

SEQ ID NO: 123701 - DNA, 538 bp, Homo sapiens
gacgtcatgtttgagtcgacttctgcaggacaagaagagccaccagaaagaaggctaggcattaaggaacagcaagtgcaaagttcctgagggaacaagcgtgagttcttggaggaaatgaaaagagccctcattgtcggggagagggtggttcggctgcccttcttggaggaggggagaaaggggtggtgctgctgtgatgaggtcggggaggagcccagttctctgggacttttaggccctggggaagggttttggtttcattctaagtgtgagggggagattctggttgaggagtgaaatgatctgatttgcagtttttgaaagtcctgggctgtcccttagagaacgggctccaggggtcaaaggtggaagctggggcctgggcacggtggctcacacctataatcccagcactttgggaggctgaggcaagtggatcgcctgaggtcaggagttcaagaccagcctggccaatatggtgaaaccccgtctctactaaaaatacaaaaattagctgggcttggtggcgcacacc

SEQ ID NO: 123702 - DNA, 334 bp, Homo sapiens
tccacctcctgggttcgggcaattcttgtgcctcagccttccgagtagctgggactacaggtatgtgccaccacacccagctaatttttgtatttttcgtagagatggggtttcactatgttggccagactgatcttggactcctgacctcagatgatctgcccgccttggcctcccaaagtgctgggattacaggcaccagccaccatgcccggcccagccatttacttgatgggatcttgagttcagtaattaacttctctgagttttagtttctccatattccacaaatgtactgcctactcctactctgacctcaacttcctccactttc

SEQ ID NO: 123703 - DNA, 414 bp, Homo sapiens
atccagattcacttacttaccctagctagtgtaccctgtgtcacatgccccaaactcttccctgcccctaccaaatgttcgtaaacgtgatacggtagtatgcagaattatgaatctttagttttttccaatatgacttgtagaatccaacagggtattatagcaactcatatttcactctaaatctggaactctctatgaggagaggtccagggctgaaaggacccctgttctgagagatcttgacaccctaggccctgaatcacagccctccactcctttccaatgtcactcccgctgtccttctccaccttcagcaaccaccccctggaacctacatcgacttggttctgtgttgattgtgattaactgtgcagatacactcacaggaactcagtgctcttgcagggcttg

SEQ ID NO: 123704 - DNA, 284 bp, Homo sapiens
tttgattgtctttgctcttcagggtagtagataacaaggcccttatacctccattgtttgagtgggaactgaatttagttgtcaaggtacttggataggctgttcatatatacatatatatacacatacacatatatacaaatacacataaacacacgtgtgtatttatatgtgtgtgtgtgtatatatatatttttttgagacagggtcaaaaaggtaggtttttataggcaacgtcctgtttttgttttttttttgttggggtaacagcaatcctcccatct

SEQ ID NO: 123705 - DNA, 657 bp, Homo sapiens
gatgagccctataagtcacctaggagtctgcatgtggtcagcctagactacagtcatctccttccaacccaggactctccccaaacaccagtctagggcaccccagcttcttaatccgttcaggccatagctgactctgaattgcacagctaattcttttttatttttttttgaggcagggtcttgctctggcacccaggctggagtgcagtggtacgatctcggctaggcagcctctgctttccaggctcaagccatcctcttgcttcagcctcccaagtagctgggactacaggtgtgtaccaccaggcctagctgttttttgtagagatcaggtcttgctatgttgcccaaggctggtcttgaactcctgggctcaaacaatcctcccatcttggcctcccaaagtgctgggattacaggcgtgagccatctgcctaaccttatttactgtttttaaacagtaaacagtaaaacagttttaaacagtaaaacaacacagggccaggcaccgtggctcatgcctgtaatcacagcactttgggagaccaaggtaggaggatagctagaagccaggagtttgaggccagcctgtgcaacatagcaagacctcatctctactaaaaataatttttttttctgagtagctgggattac

SEQ ID NO: 123706 - DNA, 460 bp, Homo sapiens
gctggggggtacccctggtcaagttcctcaagctttctgagcctcagttcctgtaaagtgggaacaggatgcaaagcttacaggtttttcgtgatgatgaaatgaaaacacaaatgaagcatgtagagcttatggacctgttgccaggtaggtgtcaggaaatggtcattattagcacctaaggttctcatttgttgaggacatttttttttgaggtagaatctcactctgtcacccagactggagtgcagtggcgctatctccgctgactgcacctctgcctccaaggttcaagcatttttcctgcctcagcctcccgaacagctgggactacaggtgtgtgccaccataccccgctaattattttcatatttttagtacagatggtgtttcaccatgttagctaggatactgtctcgttctgacctcatgatccacctgcctcggcctcccaaagtgc

SEQ ID NO: 123707 - DNA, 606 bp, Homo sapiens
gacaggatttcaattcatcgcccaggctggagtacagaggcaccatcacaacctgccccaccatgtccggctaattttttgtagaaatggaggtggtggtgggggcaggtgtctcaccaagttgcccaggctggtctcgaactcctgacctcaagagatctgcctgcctctgcctctcaaagtgctgggattacaggtgtgagctaccacgccctgtcgaaaaggcatataaacttctgaagggcaagtccttctaatttaaattttggtcagactgttacaagtgaggagatggttatcttaataaattttcaggctgggcgtgggggctcaccgttgtaatccccagcactttgggaggcggaggtgggtggatcatctgaggtcaggagttcaagacagcctggccaacatggtgaaaccctgtcgctactaaaaataaaaaaattagccagttgtagtggcaggtgcttgtaatcccaactacttgggaggcagaggcaggggaatcgcttgaacttgggaggcagaggttgcagtgagctgaaattgtgctactgcattccagcctgggcaacagagcaagactctgtctcaaacataaat

SEQ ID NO: 123708 - DNA, 456 bp, Homo sapiens
tggccgactctcgaggatccaccttatgttctgacccacccttatgttctgacccttcattcatatacacatatgcatttatttatgcatttgttgaaaaagattttttgagcacctacaatgtaatgttccaaactctatgctagaattagagatgcaggggtaaaagaataaaagaagatggaaaaccaaacatggtcctggaggttacagtgtagtgaggggcaaagacatggagccaatggttgagctgaaacctcatgtgaggagttaactggatggagaaaggagtcaagagagttctaggtagaggaggcagcatgtcaaaggcacagtaaagggaggaagaatggtccatttcagggatggaagaaggctggtagattggaacatagggaaggagggaatgtgtgatacaagctggagctagaaaggtaggtagggtccaaaccatac

SEQ ID NO: 123709 - DNA, 608 bp, Homo sapiens
cagctaatttttgtattttcagtagagatgcggtttcaccgtgttagccaggatggtcttgatctcctgaccttgtgatctgcatgcctcggcctcccaaagggctgggattacaggtgtgagccaccgcgcccggccccagtacactcttttctagactgcacagaattactagagcaggcttgattatcaaccttgttctttatatgaatgtcaactgtttcaaaaaatcaaatacttccaaaactgaaaaacaaaaaacaaacaaaaaaaaaactccaccaggtagaaggttctaaatgcaatggtaggaatttcaaaaatgcataaaaactaaggcaggatactggaatcagattcttgccactcaaaataagaattatactttaaaaatgtagatgaaagctggcttcacttctccccacagaataaccaaaataaatatacaccatcgagattatcaccagcaatctctcagaactcatgaaagagaatcggtcagttcctggcctctgagtctggcgggtagtagggcaggaagaggctctcagaggcgcagctcctcaggaaatacaagacaaagaatattcacatctgtctaatgtgca

SEQ ID NO: 123710 - DNA, 632 bp, Homo sapiens
gctgccgctactactaccacatggaggctgggcacagtggctcacacctgtaatcccagctactcaggaggctgagacgggataatcgcttgaacctgggaggcggagtttgcagtgagccgagatgatgccactgcaccccagtctgggcgacagagtgagaccttgtctcagaaaaaaaaagtttttaccactttttgctgcttaaacttacacatacgattgattgcatcttgtccttgtttggcttcctaaaataatggcaaatatgtttttgaagaaggtagactttgcctcacatccttctttttcacttgattctagctagcctctttcttttcctgggattcttttggatccacgtctcaaaacttttttgaccgcaataagaaatatattttacactaatcctgtacacacattgaaacatttcactaaacgtgcagagtactctgatattcttttgtctgcagtatactatttcattgtcttaagaaagcagtcaatttccattgaactgatttcacagctgtttatagacccagggttttgggggaaaaagactgctgatctgaagaataggtcccaaatcatgccaactttgattgctttctgagtcagttccttccatc

SEQ ID NO: 123711 - DNA, 211 bp, Homo sapiens
atctgtgactccccttgactaatttggctgtatactggaccaccctgaagatcactggctgaagggataaaatgcaaatctcttggtgaaacccaaacagacctctatgacgcagcagaatagactccacactgccaaagacagggagtcccaatcactgtcatctatgtgcatggagctgtgcactgaggcagccctgagcctccatcca

SEQ ID NO: 123712 - DNA, 493 bp, Homo sapiens
agaaaaatctagaggagatactgtgggaaaaagggaaaacattaaaatatgacagttttaaacagaaaaattgataagaaaataaaatagtaaacatttaatgagtctagttaaactatttttggtatgaaatgataatcattattttataatttatatattattaaatgttttatattattgtacaatttaaaatacaaaatatatcaataattataattataattatatgccattttgaaatttagaaaaaagaattacccccaaactgtataaaaatagaatgtaaatcaggaagagagtactcagacttaaatgttttatcatccttgaatttctgaggattatggcattgcttaaatatttactctacatttaaaatgcatggcaaaatttcaaggggacccatttaaataaaatagtcaaagttaagaaaaatggagtttgaaaaagcaaccctcaattcatcaaagcaaaagaagaaaagagaaaa

SEQ ID NO: 123713 - DNA, 405 bp, Homo sapiens
ctatctggccactgaagtaaaaatcagatgttataataaaacaagttagtcaccagcatctctgaaacaaaagtccaagagaattggacattttcccaatgagagttttcccaaggaaaaaacatcaacatacaatgggaaacaaccctctgacagaaattcactttattgtaaccactctcagaatcacatgatccattgtgatgagatgtaccctgaatataaggggctcagaaacagcggggatccacttcccccgctgttttcagcagagtggaaacagctgtcatacgacccaacatctgcatcctcaccagcacccagcccttatcactggagctcaggactcaccaaactcattttcctcctaaaagctaactagaaaacaactgtttctaggccctc

SEQ ID NO: 123714 - DNA, 284 bp, Homo sapiens
tagtaaattaagtttcagagggattgcataaaactgtgatatcattgaatgtaacatctagcctaagactattctctgttcacatgggcttaggcatgacttctgtcattgatttcattacttatgtgctggtatgcactgctcgtcaccatggacctgccagggcacctggcaatgaagtccatgtagtctgtgtcctccttggatcaactccagacacctatgaattccttacatcattttcatcagattcttgccacagtggtacatagtaacttgttggg

SEQ ID NO: 123715 - DNA, 423 bp, Homo sapiens
caaggattgggcgggcaacttcccactgcgtgcgatgtatcttaggaaagccatttaaaataggagacggttactttccatcaagtccctggtatggtccatggaagcagggttgtcagtctcatttcagcattttagaggcttctcagggtttggaaatggaagaagagaagcagcaatatgtatgcattgcagagacacaggcgagccccaatttaggaggttaggaggtcagtgctaagggccttgttttctttgcttagagcatgagttgccatcttctctggacagagagtatttggttgcctaaaggtaaaatctaaattttgctctgggacaaattccaaaaaaaattagctttaatcaaatttacttttactttatctttctgaaccttcaaggtccaaaagcattggttaataa

SEQ ID NO: 123716 - DNA, 359 bp, Homo sapiens
tcagggactttattcagtaggtacttttgagttaaatctgagaggtctgcattaaaatgtaatcacttctgcactgtctagagatagtaatagcctattttctgagagaaaagagcctgaaaataaggcttcactgctgatagatcaggtggggatgtcgactggaaaaagcagctctttacagcaggacactctttcttctgtttgctcctgttgttgatactagcaattttgatcacaacaaagagtttctatgaactgtaaatttagttagaaattgatccagacacacactttggttaatcacctgctgtgtgccgagcggtgagcttgttaccacgtggccaacagcataccga

SEQ ID NO: 123717 - DNA, 358 bp, Homo sapiens
gccaccgtgcccagccttgcgtctctaattttcacgtaagtcctgaaacaagtacttcatttcttcagccgtatcacatattcttcctttttctttggaacacacacagtgtgctctctgacagaagtttatgcagctgttcctgaacctaagtgggcattagactcgcctggagggggctttggaaataaagatccagggcccatttgagactactgagtctgagctcctgagacctcagggatccctgggcaacccctgtgaaaacccccagttcatgtggggagttgggtgtatttgagatatcagctttgaaggaccgccatggtttctcttttagtgcttgtgagtaaagttt

SEQ ID NO: 123718 - DNA, 466 bp, Homo sapiens
aactaagcttcttcatgtaattattcaagacttagaagtaataatatgcctaaattccaaaagatggtttgaaaggaatcttactagttcatttttacattaaccagtgggcatttgcttaaatgagggagtttccatttgaatggaggttaatgtctacgaaaactagggagaagcatttggagagataacttttatccctaaggttttcacaatcccacaacctcatttttccgaagtcattctatactacctattggctttggttggttaatccttttgtataaggcaggtaatgcggcctttcctatcaaaggtaatgaaaccattagtgatcagatctcttgactatcagcaccaagccacaagagtggctgacacttagagtcaagtgttaatgtcaagctggctgtgacaagcagaggcttcctcagttcactttagctgaggatacttgtggttgaat

SEQ ID NO: 123719 - DNA, 653 bp, Homo sapiens
aattttttgtatttttagtagagacaaggtttcgccaagttggccaggctgctcttaaactcctgacctcaggtgatccacccgcctcggcctcccaaagtgctgggattacaggcgtgagccaccgtgcctggctgctaattttttatttttagtagagacggggcttcaccatattggccaggctgtctcgaactcctgacctcaagtgatccgcctgcctcgggctcccaaagtgctgggattataggcatgaggcaccacatccggccataataccataaaaggcataccaaaattaacatgtccaaaataggattttttatacgatcctgatctcagtccatttcagtgcctgtcactgtgatttattcaaaattgaagagtccttacaatcagtggccatactgtccactccccaatacccgtgcatgctgttccctacagcccaagtcagatcacaggtctgctaaaaatcctcagaaagctgttttagaataaaacgcagatttcttactatggcctgcaagttctaataggattgggccaaattggctttggcaactttattgtcactcagcagtctactcaagccatgctggccaccctgtcttcctttttttccaaaaagctgacttctctttcagagattt

SEQ ID NO: 123720 - DNA, 445 bp, Homo sapiens
acccgcctcagcttcccacagtgctgggattatagccgtgagccactgtgcccagctcaaaacgcatttttgatgtacataagcattcccatattctagaccagatcctttctttactggtctcctttacccaaagaaaataaatctatcccctaatatttacaggacattgatgctttcttatgcattatctgagagataaaaggcaaaatcttctggttttgtaagtgtgtccaagttcaactagactcatatctgttaatgccagcaaagcaggaggggggagtgttttggggagaaacaactcatcttttaaaaatatccttagtcctcgcgtgccggactctgagcaacgcgtacacaatgaaaatcacgatgcgaatcatccacattgatctatgtggcgctgacgtgcccctctgtgggttgatgcataaaacagggc

SEQ ID NO: 123721 - DNA, 264 bp, Homo sapiens
attatattttgcatcaggacaacacaaaaaactgacagtcttatttgtgccagtgccgtcctcagaactttacatggattaactttttaatcctgtgagataagccctgttattatccccacttcattgatgggaaagctgaagtctagaagggctaactgcccaaggtcgtataggtagcatgggcagagctgcattcaacctgagtaaaggaggtccccagagtctatactctcaatgggtgttccatacgcccttccctta

SEQ ID NO: 123722 - DNA, 529 bp, Homo sapiens
ctatggtgggatataagtaacacaatagatatttacatatagatattaaagctgaaggagcgcaagtaaaatttgttatgtgagacgtaacttacagcccagaacagctcagaagttttaatgccatccttaatggtgtcttaatgaaggctttctgcaagtagaaagttggctggataataggccattagaccatgaacagagattttaaatttatatttccttttcatcttctttccattaagccttgatggataaaaaattatgtagcaattgactgcagcctacatcagaccattttctgtggagaaaatcatgataatggtagttggaccctaaaactgtttgaaagttattttcatagaaagagatcttttttttcttcataaatcagttgtgttttatgaaaacataaatggttcccctgttttggaatgctgctgcaaattctttttgcatctgacgtataacttttaagcttcaaagaaatactataaactagatgaaataaaatataattggatatagc

SEQ ID NO: 123723 - DNA, 108 bp, Homo sapiens
tcacaaacccagaagaagaaaagaaccaatatcagagtaaaactaaatgaaacaaaaaaatcacaaaagataaatgaaacaaaaagctgttttttttgaaaagataaa

SEQ ID NO: 123724 - DNA, 432 bp, Homo sapiens
tgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcac

SEQ ID NO: 123725 - DNA, 223 bp, Homo sapiens
aggaggcgtgtatgcatatgtatgtctatactgtataaaataaaatgtgtaaaaataaaatatgtctttcaaagttgaataaaaatacaccaaaatgcccacggccgtttcctctgggcaatgagttaatggagaatttctaattctttttttgtactgctgtattttccacattttctacaataagcgagtgttcttttaaatcatgaaaagaagcaggcat

SEQ ID NO: 123726 - DNA, 356 bp, Homo sapiens
gcacatattttactgtgtaaagacagtaacattgttttcactgattcctttccatagaaacatttcttatcgggcttggaaactaagaattggttttaccatccttgctactgttgctggtactgttaccactgttactcagaagcaaaaagactcagacttttttgagttatttttacctgtcttagtataaatcataatgaataaaattaattaaaggaaaaacaacgagatcatgtcctctgcagcagcatggatggaggtggagaggccattcccctaagtggactcacatcacgcaccaaataccacatgttctcacttatatgtgggagctaaacactggctatacgctg

SEQ ID NO: 123727 - DNA, 717 bp, Homo sapiens
caccattgacatatctattccttacagaagctagcatagtgccgtgcacaacatagatgctcagtagatgcctgcagagtaagtgaataagctgtctttccattttgtttatctgcagatcacgcatcttctatcctcattttatctcggttgcctgttttcagcatagaaaagaagcaccaagttcacggtaagatatatttttctgtagactcagaaaatggagtgggtactaaaagcccttcatcaccactgtgcaatccacataggtaacgaaatgacacctgcaccccatacatttatacaaaccataaaacagcaggagtcatcacatggagctgattgatgttttagaagcaaagaggggctgggcacggtggctcatgcctgtaatcccgtcactttgggaggctgaggtgggtggatcacctgaggtcaggagtttgagaccagcctagccaacatagtgaaaccccatctctactaaaaatacaaaaattagccgggtgtggtggtggacgcctgtaaccccagctatgcgggaggctgaggcaggagaatcatttgaacctgggaggtggaggttgcagtgagccgagatcgcaccaccactgcactccagcctgggcaacagagcaagactccttaaaaaaaaaaaaaaaattcaaatgtataaagacttaaatctaagactcaaaatgaaaatactataagaaa

SEQ ID NO: 123728 - DNA, 622 bp, Homo sapiens
aacaaatgatatgttctttgtatttattgtacccaaactatcatctcaatttatctgcttgttcaacaaatatttaatgctagccaactagatgacggaaattccattcactggaaacagccatgaatgaggtccttccccatcagatgggagtgataaaacttagtgtggaaacatctggccttttatgtatttagaggatttttcaaaatcagtaaagctattctctagtattataaactgtcatggtgtggaacagatactctgagacagagttgaccaaaactgagttgttttttttcagaacacatagaagcaagcaaacccaaagagattttcacgtggaggaggaaatctgacagcttgctgtacacactgaaaaatggagtaattgggaaaggcaaggaagaacattcaaatctcatagaggtcaatgccttcaaaattaaagcatggagaggttaccaggagagcacctagaaagccagagatttagcagcaatggcacaagctggtagattggaaaacaaaaattagaagctattttcttttttcactattggggagtgggggagggaaaacatgcatctgattcacagattctgccatcaaatcctaacaa

SEQ ID NO: 123729 - DNA, 335 bp, Homo sapiens
ggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggc

SEQ ID NO: 123730 - DNA, 388 bp, Homo sapiens
tttggggggattattttgtttgtttttcattcaatattcctcaagtttggtagaaaactataccaggttatgttttgactctattagtctgccttagtgacctgccaacaatcctgagtgctctggtttggagatcttgcagggtggaatcgccacacagagctccactgcagaagttgtctctgactctaagagagcccatgcatatatggtggcttagagtctaagaatttgggagaccctacagcaagtaccagtccagagcttctagataaagtgaaagctctgagactctatttggggcattgaatacagactcggaaattatcatgtttgacaacctattatgaatgtgctcaaattttttggagttacagaacctttagat

SEQ ID NO: 123731 - DNA, 424 bp, Homo sapiens
gctggtctcgaactcctgacctcaggtgatccgcccgcctcagcctcccaaagtgctgggattacaggcatgagctgccgcgcccagccaactgtataataatttgtttaatcagtctcctgttaaaagacatcatctcagtcttttgttaatatagataatactgcattggctatctatacatgtgtagacacatgtatacacacacatacatgtgcatgcaaatacatctataggatagatacctcagaatggaataggcagatggaaggataggtacattttatattttaaacaatattgccaaaatgctctccagtatagcacctccatcagctgtatattagggtagtggtaaaatggtaatatgttagaattgcagctgccttacagtcatccagtccacctctccacaacatgggtg

SEQ ID NO: 123732 - DNA, 265 bp, Homo sapiens
gcaaggcaggtccagggccatttcatggactcagtaggcctggggtcaggccagggcagggcaaaggcaaggccaggaagaaggcagggccggggccaaggcagtgccagggcagggcaggaccagtgcagggccaatgcagggtgagggcaaggccagggcatggaagggcagggcaggatcaaggaagggccaggagagggccacggcagggtcatggcgagaacaagggtatggctggggtcaggaatatggtaggatgagg

SEQ ID NO: 123733 - DNA, 366 bp, Homo sapiens
tcagaccccatgtcccaggactcaactccctgctcacactgcccagccacacagcctcacttgctgtgcctcaaacacaacaggcacactgctttatcaaggagtccatgcatgctgttttcctgccctggaatgttcctcccttagatggctgcacagcttacttcccaggtcttttctcaatgtttcccctgacaagagctttctttgagtgtcctgtttaaaacttcttccctctacctccaccttgggcctccccagccctcttgtctatttctcagcattgcacttatccacatttaacatactatatattttatgtataggtctggcttgtctgccttgccctaccagaatacatattcc

SEQ ID NO: 123734 - DNA, 178 bp, Homo sapiens
cattcctgtgaggtgaatgttattatagaattctccttttatggaagaggaaactaaggcagaaaggtctagtgacaactcccatccttacccccggctcacaaagctaataagtggcagctcaggggtccaaatgcatgtggctggctccagcaagtgccctaattgctgtgtgatg

SEQ ID NO: 123735 - DNA, 219 bp, Homo sapiens
ttgcaagctttcttgtgactatacccaagctagtaagcaaaattttcctaggagctgtttcatagacagaagagtattttgtagatctaggttacatgcagggctgcaagcccagtttcagcttcctacctctaacaggactgagacctgtctcctttaatagagggtaacagaaaacctcacagttgactttggcttaagttcagggtacatggagat

SEQ ID NO: 123736 - DNA, 536 bp, Homo sapiens
atctccaatgtttatgagcgctcaagggaccacatctccagtttcctaatgacaattaaaagaaaatcatatttggcttagtataatttattttgaagtattttgtaaaatggggcacatcattattaaaactaaccaactggggactggctagagggaggtggatgtgggtataaaagggcatcatgagggttcattgtgatgttagagctatggagtgtctttatggtggttattcatggacctatgtaagtaataaattgtggagagctaaacacacacacaaaggagcacacataaaactgaggaaatgtgaattagatgggtgattacgtagccaaagtcaggatcctggttgtgatagaatactatagttttataaggtgctatcattagggaaaactgggaagagcatataatggatgtttttctactttttataattatttgtgaatcaaaattgtctcagttgaattctgcctttaggaaaatgctcataagaattatataaacttccaattaaataaattatgtcg

SEQ ID NO: 123737 - DNA, 938 bp, Homo sapiens
gaacttaccaaaaaaaaattgttctttaaatcaccagaaaagtgcagataaaatcccagacagtttcattaatgacaatgaaaggtgacagcccttgaatctatgtcataagttgattaattactttccaaacattattaaagatattagacgaataacttagactggtatccaggatcaaggttccttcataatccctaaatgggttttaattttcagagttagatgatcattatatgtgatttatttctttaacatctttagactgttggctttattgaaaagagaggagagtatctgtttcaatgtgttttcttttccctgaagttattccttgcagaattcaataaaaccggttttgaaataaaaataattaaatgctggcattttctgttaataagggcccatagacctgatgaattatataaacattacaaggaatttaccactgagttcataattatgtaaccatttaatgcccaaacctgcctactgacagtgaagacgttcaatgagaatggacattgtgcattaggataaggatgacctggagtgaactttcattcttgttttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccat

SEQ ID NO: 123738 - DNA, 607 bp, Homo sapiens
aacgtaataaagggttgtgttagactgctataccttgaaataatttcttataagtcattaataactgaagtaagcattaattgaacctttaaacagttaaacttacaataattattttgaagatcatcttgccttaaaaacttcaagatctttgaggggataatttgccatcttagtatttagaagaactgtgtttgtgtctatatgagggagatcagattataatagaaggtaaatgggtacagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagctttcctggaattttaaactattttctcttttgattaaaaaaaatagaggatgagatatgcactcattacaagaatattacatttcaggatttggtaaaatgaagagaaagttttgaatgggctaaacaggaattcaaggacttcttataatacattccagagctcagcaactctttttttatattgcctgctgtttgggattatattcatcattgctgccttcag

SEQ ID NO: 123739 - DNA, 378 bp, Homo sapiens
gagggatgggagcagaggagaaaagaggatgagctcaaaagatatcacacagaatcaacagacatgggggatcaagtcggtgactctgtaagaactaaaaggcaagacagaatctgaatcctcctgaagtgggtcatgcccaaaatatccctccacctggatatttattccacaaatactggctctttgggagcattttaattttctttttatttaggtttaaaatgtttggattattatgaaatactcaaatttaaaaaatgcagaaaactgtaacattcatcggcattaactatacagcgttttaaaatactaaccttttgggccaggcgtggtggctcatgcctgtaatcccagcactttgggaggccaagatgg

SEQ ID NO: 123740 - DNA, 316 bp, Homo sapiens
agaaaggtcataaatttcttgctgtagtaattgttccccgcttagatattgtaccccgctgtgtattgttccccgctaagtgattgttccctcgctaagtgattgttccccgctaagtgattgttccccgctaagtgattgttccccgcttagtgattgttccccgcttcttcccaaagccatgcctgtctttttctagctcgatatttttcaggagttaccggttgactctttgaaacaggtattctgctttcagtggctcttctgctttcttttttcttttttgtactttgaagagttcctactcttctttatt

SEQ ID NO: 123741 - DNA, 680 bp, Homo sapiens
aaaaccatgacctggcatttggcaacagattcttaaatgacaccgaaagcacgaccaaaagaaaacaatgggtaaatcaaaatttaagacttccagctgggcgtggtggctcacacctgtaatcccagcactttgagaggctgagaaggacagatcacttgaagtcaggagtttcaggtcagccttgccaacctggtgaaaccccaactctactaaaaaaaaatacaaaaattagtgggacatggtggcctatgcctatagtcctagctacttgggaggctgacgcagaagaatcgcttggacccaggaggcggaggctgcagtgagctgagatcgcactaccgcactccagcctgggctacagaccgagacccatctcaaaaaaaaaagaccaggggcggaggctcacgcctgtaatttcacactttgggaggccaaggcaggaggatcactgaaggtcaggagttcgagaccagcctggccaacatggtggaaccccatctctactaaaaatacaagtattagcccaggcgctgtggctcacgcctgtaatcctagcactttgggaggtcgaggcaggtggctcacttgacatcaggagtttgaaaccagcttggccatcaaggtgaaaccccgtctctactaaaaatacaaaaaaatagctgggcatggtggtgtgc

SEQ ID NO: 123742 - DNA, 680 bp, Homo sapiens
gtagtatatacctacccttatattgtcattgtatttttctactggaaagaagttaattatatatgttgagcatatgtctgtgaaactttggaaaatgtcttttaaaactgttaaacaaaactattgaagatagagaagaaaagaaggaaggcaagaaaaaagcaaacaacacccacatgagcaaaatccagtttagaagagcaataacaaaaaacaaattgaaaatatacaatttaatagtaaaattgctgcaccttatacaattcttaaaagaaccaaagatgagttaaattattattctctccatagtacaaccaaaatttcccataaaagttaacaaaattgaaagataccaatagaagatactactatcctactgctgtatatttgtatatacctttgactagcgttatgaaaattattaaaataagtgcttctgaatcttcatttcactgagaccatttatttactatcatggatggaaactttgttctgattataactcagtctatttccattaaagcaaaaccatgggaatcgatctttttaaatcttttgttatacagtcaggatagaataaaatagtaaaccaactgttcaatatatggtcagttctgttaagaaaatatctgcccatgttgcatattcatcagtgtaaaattgaatatctgtggatacag

SEQ ID NO: 123743 - DNA, 340 bp, Homo sapiens
ggacagtggttcagagaggttacgctacttgctcaaggtcacccagctcccaggcccctgctgtcttccaggccactgaggtcctaagcgtccttccaggcgagccactgctcacagcctgttcctcatgttctgcggcaggtttgtgtatctacatcttttccagttccctgtcgtcccccttcctacacctcgtcatccactatccctgtttgttttctctgttcctttctagttctctacctgctcctcttatttttatttgagacagggtctttctttgtcactgaggctggagtgcagtggcacaatcccagctcactggagcctcgacctccca

SEQ ID NO: 123744 - DNA, 682 bp, Homo sapiens
agcgggtctgtgatgagtttttcaaaggtcagagcagattgaacctttgtggtttcattttccctgattttgatttttcttatggggaacctgtgttgctgcattcaaggtgactcgaagaattcttccaaaaagcgtgtgaaaagggagccctactctactaccaaggtgacttcagggagcacattcaatgagaatacaagaagatatgctgtgcacaccaaccagtgtcggagacctcatggctccccggtaaagaagaagatgtacccacaagaagatgacttccatcatacaatcttcagcaaccttgaaagattggacaagcttcagcccactcttgaagcctctgaggagtctctagttcacaaggacagaggagatggagagaggccagtcaacgtgagggtggtgcaggtggcccctctgaggcgtgaatctagtaagctccccatggggacaccatccacgacatcacgaacgaggacgccgtccacgacaccaccgacgaggacgccgtccatggcaccgccgacgaggacgccgtccagggcatcgccgacgaggacgccgtccacggcatcgctgactgggacgccatccagggcctcgctgacagggacgccgtccacggcttcgctgatggggacgccgtcaagggcatcgctgacggggacgccac

SEQ ID NO: 123745 - DNA, 1152 bp, Homo sapiens
attatgcaaatggtactaatttagaaaaattggtttttcctcaaacaattttattcaaatacttcacatgcatcgtttacaactgggtctctatcatcactgaaacaacattgtgagtcctctaacagttccctcctagttatctaaggtagagcatgccttacattgagtagaatgctgtcagtggagattttactacatctcgagaaccacttgttaaacatcagggtttttttcctacatattcataatcaccataaataagtacttcttgtatttctctgttcaataattatttaaaagcctacttaatgatctccaatacttgttatccaaagtcataccctcaggaataattaatcaatatgtctttgccttttttcccctgattttgctaggtgacctttataagacagaaaattgccattacttgtgaccctttcacgacatattgtcttcctgaagagtattttgttcaaaaaggacaaagacaaaaacacaaggtgactctcttttctgaggaatgatatttttggaaaaattttgctttccattctgcatatatggtatatattactatttaatagcatctgtacccaccccctttttttgcatagagacggggtctcaccatgttggccaggctggtcttgaatttctggcctcaagcgatcctcccctccacctccacctcccaaagttttaggattgcaggtatgagccatcgcgcccagccagcatctgtacctagacccaacttgaattccccaaagaagttaaactggctccagtattttctcacaagatgctagaaggcaaattgtggcatacctataccttctggttggttagtgctgaaaaaagtacaggactacttttgagaagttgacgatgtggttatcattcaaagtttgcctataattgtaacttgggttttaatgggaagcagtgtagtactgattgttctgaagacaataatattgtcgaaatgccccatggctgcagaattactgtaagaatttcataaatcatgtatatgctgtgcattgtctggagactgaagaatgtttttcatatctatgacaatattttttggaagtttgtagatgctataatcgtgaataaaatacaaatttgtttagaagtattgaa

SEQ ID NO: 123746 - DNA, 526 bp, Homo sapiens
atttactgagcagccagtaagtgccaggaacaatataaaatccgataaacccctgttcccccttattcctttcattggttctgtgggtaaatattcccattttgccagcaaggaaactaaggctcagtgaggcgaagtaacttgccagagttaaagctctcacaagcagtagactgagtttcagctcaggtctggctaatttaacagcctctgctcttttgtgtgtcccagcacctgacgctgaggcagggacagtgatgagaagccctgacctatccccggagctctcttttacctggaagttgagtctactcataaagaaccctttctttccatttatatacctggcagcacatgaccgcctcatcacccccaactatctctccagagtagggcaattgcacagaacactgaagcctgacttgatttagggtctccaattgtgcatgaagttggaggaggcttcctgcacctcatctcagctcatgcactggtcacactaaaggtggctttcagaggtgagagc

SEQ ID NO: 123747 - DNA, 723 bp, Homo sapiens
agtgtgaaatagatgcaaaaatatagttggagattttaatacctcagtaatccatagagcaattgggtaaaaaaattaagaaagatatagaagattagagaaactctatgaactaaattcacctaatttagttataaaataaccaaaccaaaacaatacaactattctcaattgcacatggaaaatgtatcaagatagacaatactgggccacaaaacaagttgtaataaatttcagcgattaaaataatacagaatatatttctctgaccaccatagtattaagctagattaataacagtaaaatatctagagaatcttcaaatatttggaaaataaacaaatttttaagtaactcatggatcaaagaagaaatcacaagagaagtaaaaaaatatttagcaatgaaatggcaattagaatatagcatttgaaaatttgtggcatacatactaaagctgaacttagagattaatctatggctttaaatgcttatattagaaaaaagaaatatatacactaaatgatttatgctttcaatttaaggagctagaaaaatcagaacaaataaacacaatataagtaaaagaagtaatttgaaattagtaaagtagaaaatggacacaaacaaaaaaatgaactataaaaaattggttctttgaaaagattaatggacattacaaattatacagatgttaaagcacaaaaagggacattataaaca

SEQ ID NO: 123748 - DNA, 466 bp, Homo sapiens
ggcattgtctgatgagaggatttctagctttcaacagattctcacagaattcatgaccagaacaacatggggtaatgactgctttaggagccattaagtgggccattttagttccttgaagtcctctagactttggccactgtcagttcaggaaagatgccttctgaagattcctcacagagactgtacagctgtttgggatacataggattttatatttcatcttcagtgattcatgagcattacattgttccaaaacagagaaaggattatgtcattcccctgcataacaccttccatggctctccattccctacagtagccttgccaagtgtatgagatgctaattgaggtagactgtgggaggtgggtgtttccggtgcagaagaacccttgatatcaccttcacttcctgctatatggctgcgtatcaaaaggcaagttacttaacttcctgctatatggc

SEQ ID NO: 123749 - DNA, 665 bp, Homo sapiens
gaccctgccccaaaaacctccttcaccttcctgatggccactgtgtcctgagcagtgaaacgcccagctggatcaccagaagcagcacatggggcccgagggcagagagcaggtagcagtccccgatgttcttgtacagctcttgagtctggaccttggactcaaagatggagagcgtgtcgaccaccaggactttcctcccattccatgttcctgtctccacctggcatgtcctggttactgactgggcccccagcttgcactcaaacacaggctggccaaggatgctgttccctgtggtgcttttcccacagcctgttttgcccaccaggaggatcagcagcagcagtgatcctggagccaacctgccttctcctcagcctgtgagagcgggtgaagagtgagggtataaaaactgcattctgaggaggaggtgccaaaagacagaaggcaaaggcatccagaggcactggcaccctggcacaatgaagcatgcaggcctgggtgaaggaatacctcctgacaactccgggaatgatggctatgctaataatgggtatagtgcccgtgaagaagaaaatgagacactcactgaaaatctgagaagcaaagtaactgctataaaatctttttccattgaaataggccatgaagttaaaacccaa

SEQ ID NO: 123750 - DNA, 583 bp, Homo sapiens
attcctttgtcagatattttggtgttattttcttccagtctgtgatttcttttttccttttttacaacattatcttttgaaaagcaaaagccttgaattttgaggtagtccagtttatcagtatttgtcttaatgcttcatgctgtttgtcctatcttaaatttttgcctaaatcaaggttatgaagatattctcctatttttttcttccaaaaggtttgtagttttagctctcttactttagatttatgatctatttgttttttatatggtatgatatgtagtcaaagtttattttgtatataagtacccagtttttaaagatcatgttgaaaagaccatccttttcctccatagaatttcctctacatcttgaggtattttaaatgttgaaaatactctataagtatgggtctacttttagaatctatattctattttattgatttttatcaagggtcagcaaactaaggcctatatgctaaatctggctttatataaataaaactttattagcacatggccatgcccattcatgtaggtatcatctatgactgcaattgcagagacagatttcagtagtt

SEQ ID NO: 123751 - DNA, 472 bp, Homo sapiens
ccctcatcccatgtcacaataagctgtttttaaaaatgtatctttcttgggctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgta

SEQ ID NO: 123752 - DNA, 429 bp, Homo sapiens
gaggggaggaagggagtgaagagagggtagaaaggagggagggaggcaagactctggtgctgcacagttctacatctcagcaggtagagcaagaagtcctggggcccaggctgtcctctggaggagccctgtcatgtgggctaaggaggcctccacatccctgcctcttgcaggcactgggagcaccctgcaggaagtgtggcctccatgctcacgcagggaaggatttctgagcacggcaggaaatcccaaggatgttggtcgtttttgctccttgccgttggggacccaagaggtacatgttcatggccaccacagccagaacaaggcggatgaagagctcacctcagactaagtccagcggctggactgcaggctatgtcggtgggcaggaggtgcatcaggaagtggaccaagtccatcagcggg

SEQ ID NO: 123753 - DNA, 525 bp, Homo sapiens
agtgagaagtgtttccaaaaacagaagttttataaacaggaaaagcatgctttaacttggaagaaacaaaataaaaataaaaaatacttttcccttttagttgcctagcctggtgtctataagcccatggagatgagacgtctgtgtgtaacacacacatttgattttgctgacggtgactgtgggcctgtaactgggtgcccaaacaacctcctgggactgtgtgattctcacctttgtgaggagggggatatgtcctctgattaaaaaaaggaaccacaaaactccgctcatctttaatttatttattcaattagtgttgaagaaggataaccagactgagggcggggggggactaagttcactgcaacctctgcctccagggttcaagtgattctccatcctcagctactcggaaggctgaggcaggagaattgcttgaacctgggaggccgaggttgcagtgagccaagatcacgccattgcactccagcttgggcaacaagaatgaaactccatctcaaa

SEQ ID NO: 123754 - DNA, 440 bp, Homo sapiens
ctcagttctagttcttcctcatataaggggagaaaataattcactaacaatgaattattaaatttattctgcaggttggaaggcattctgtgcacatacttcctaaggcactgtttctgcactggggcaggcagccacagaaaacatggttaacacaagtatatacaatgtgcaaataagcaaaagaagggagcaggaactaaacctgtccctggcagaagtgagaaaacttccagaaaaattgatgtttaggctaaattttgcaagtaactttttaaaatgctattaaaaagatcacacggaaaaatgatggtaaactcttaaataagttagtgttcttccttactacctacagtatatcaacattagatgactctgtcttcagtattaacgcaacagaaatttttatttccatagatctgagatatacatactaagct

SEQ ID NO: 123755 - DNA, 394 bp, Homo sapiens
  misc_feature (21)..(21): n is a, c, g, or t
  misc_feature (29)..(29): n is a, c, g, or t
gggaaatagacactttattgnaacaattnacatttttggcaatatgcctaggttccagcaggcccagactagcatccccttgaaaaaatagcctgatggacacccaccttcaggataccggagatgaagcgtgagccaccaggcccagccaacagtagagcctttcattgttccatctttagagaggcatctcctgtgagcctttcattgttccatctttagagaggcatctcctgtgagactttccatcttggatgttttttttttcttagtaatatgttaaataatgacacatcttccaattgagggtgtatcttagatttgatgacatatgatattaatgccttcaagacatattgcagtaaagaaacttgttgaattcttccaaatatat

SEQ ID NO: 123756 - DNA, 237 bp, Homo sapiens
cagagttggaagccattggcctttacccacaaaaagggataacaccttctgggagctcaggtgcgtgtgtggcaccatagaccaggttgggctggtcgcttccatgcagggagggtgcaccattactcctggggagctgcaaaggtcacctgggaatcttgttaaattacagattctgctttggcaggtttggggtgggacctgggtttctgcatttctaatagatatcttagtgtt

SEQ ID NO: 123757 - DNA, 420 bp, Homo sapiens
gaggaaactgggccacagtaaggtgaggctgtctgcggtgaactatcggaagagctgcaaagaccacccaggcttcgcgactcagcctggcattatcgcaggagctccacaacccctctgggcacgccattggctggtgaccatttctgaagtaaggtctccattctccctgccgggctagtgtgccctcagggcaggagttactcacaggcagggaggccgtgcacctgggcacacatagccaggctgcagctgattgacgctccatgggtcaggagcggagccgcaggctgactccctagtgacaagctgaggagcagggcacgggggcaccacagaaggtgacaggagggtacaggctggacacccgaccccaaatctagccctcactctgaggtgctgttttcagtgtgcttactg

SEQ ID NO: 123758 - DNA, 784 bp, Homo sapiens
gtagtggacaaccaagttcagtctacacacattccacttggctgttgcttaaaaggtcttgtgatgtaacaacaaagtaaacttcagttgaagcacctttatgagaggcaatgacacatgaatcggaccccactgaaaccagtaatagggataaatggacatgctgttagggtataagacagccaaaaaattttctctcaggatagacattacagccctaataacacacttgattctttgctttagcctaataaggaaagcagatttccaatcagtgagaggagttcccctccgccagcgatttgggaaactgttgggagttgtggtggtagcagaacacaggagcaagccactcaggagctggacaagggtggtagcagtggggatgcagaaaggggacatactggagatgtgttttgtggtgagaagtagttcagattcagaacttgctcacagatttgcaagtaggagaaagtgaaatcaaggctaatagttcctaggtttttgtttataatttggttttctcttgtgattacattctttcacttcacagtttttattgagagcctgctaaatgccatgttacattcacggtgcctgattacagaggtggagaagataaggacctgctctcgcttgattaagagcacggatgctgaagctagtctgcttggattcaaatcccagctctgggctgaacatgctggctaatgcctataattccaacactatgggaggtaaaggtgagaggatcacttgagcccaggagttcaagagcaacctg

SEQ ID NO: 123759 - DNA, 172 bp, Homo sapiens
taccaataagggggtggtccatgagatggatgggtagaatagatatataacaaaaatcattccagggaagagaacacctgactatagccacaaagttgggaagggatggggcgtgtttagaaaagtgatagtttagaagcttaggctgcatataaggatgtgttctttttct

SEQ ID NO: 123760 - DNA, 410 bp, Homo sapiens
agctctgctctggggagctcagaggaagcccaacttttaagagagcaaaatgcacacagaccatgaactcccgcaatttttgcccctggtgcagggggacccttcacccatgtgggccctgagattagctgagggagctgcctggagactgcatgacagtattgctccagagagggagctcaggctggctcccacgcactctctgagtccgaagcagctacagtgcggcaccatttgtatgttccaaacacccgtagactgcatcctgctctgtagcccaatggcctcggcatctctatatccctagagccccactgacatctctgcctgcagccaccaccttggctggcagctgccaccaaggtctaggcataacccattgacagagaccccactgtccctagcagagt

SEQ ID NO: 123761 - DNA, 383 bp, Homo sapiens
tggatagaactggaggtcatcatggaagtgaaataagccaagcacagcagacaaataccccatattctcacatgtgggagctaaaaagtggatctcatgagcatagagtacagattgatggttactagaggccagaagggtaggaaggagacggagataaagagaggttgattaggctgagtgaggtggctcatgcctgtaatcccagcactttaggaggccaaggcgggcagatcaccctgattatgtgagatcaggagttcgagaccaacctgtccaatatggtaaaaccccgtctctactaaaactacaaaaattagccgggtgtggtggtgcaccccttaatcctagctactcgggaggctgaggcaggagaatcactt

SEQ ID NO: 123762 - DNA, 663 bp, Homo sapiens
cagagtagatatctaagtgaattgcccgtcactgagcagcttagcatatacagcctgtattcagataaaagcatcatggtttcgcttctttgaaaagttcttttcattaataaaatggtttttttggtttcttttggatgatttaaaaatgattctttcagagatgataaattatgtgcttggggaaattctgtaattctgatgggtttgtaatgactctttttgactttgcgaattgatccagtagagcataaacttcgggagtgccttaggccttaataggctatgttcttgttttaataattttgacagaattgttgtgggaatcataattagagtctctctctcagtgaatttgattaatttaaaaaattaataacatttctacgtaaacaaaaggtattaggatggtgcaaaagtaacttgcagttttgccattaaaagtaattacttaccacaattactttttcaataacctaaatgtaataaggaagagaggagagcctatccccgagcagatgtgcactttagggaaggagttgatgcttgtcctgtgttgtgaggctttgtgattgaatcagctgctcaggatatcaaagaatcttcaacctgaggaccagttacattagaatggtattgtctgcttggactcctctgttgaga

SEQ ID NO: 123763 - DNA, 485 bp, Homo sapiens
taacttatgagttcctctctccagggcacagctacagaggcaatagggcattttggaggtatttatgttacttccaattaggcattctaattaagatggactaagggaggagtaatatgagtgagaattgggcatacctgggtgagggtgtccttgggttattctgaatactgggggattcattgatactcttggaagtcagcactaagctcaggaagatcccatgaggttgaagcagccagaccagaccggagtggagcagccagggcagaacatcttcatctgggagccacactcttggattcaagcgattctcctgcctcagcctcccaagtagctgggattacaggcacccaccgccatgcccagctaatttttgtatctttagtagagatgacatttcaccatgttggccaggctggtctcaaactcctgatctcaggtcatccacccgccttggcctcccaaagtgctgggattacagg

SEQ ID NO: 123764 - DNA, 493 bp, Homo sapiens
tggctgtgtagtgatgcatgagggagcgggctatgggtgaggagattagaaattgatcacattatgaaataaggcactaaagtctgaagccagtaactacacaattctatggaggaagaaaataattatgcaaatacttctgattttaaattttttatataataaacatacaactgaagaaaataaaatgatgcattcaaatgagctgtttttaatacggagaaaattcaagctcatctaaatagaaatatgggtgggatgaaaaaagtaagtatgttggaggctgaaaactgttctccatataggagtgaaagagagaaaaaaaatttcaattacatatctgagattaaaagcaagaatgagaaattttccaaattcgataaatgcatgggggccagatgcaagcatacagaaaactgctggacataattcaacactagggaaccacagatcaaaagcacactgaactaccacctcacacctattaggacag

SEQ ID NO: 123765 - DNA, 509 bp, Homo sapiens
cgcatgtggtgctgtgtgtggggctttgcagctcctccctggcctgaagtcccttttggttaagcacaggcagtggaagttagtctctctggtgctgcaaagtcttgcctttggtaggaagacccctgagagatgctcagaccccactatcctcgagacaggtgggccttccacatttctgctgtacctgagacagaatctggttcactataaagacattgtttaaaatgtcccctttccttccctgccctgagaaacatatcaatcactgagttctaatgattctcactcctcaatattgggctgccacatcctgggtttcccctgggttatgtgctcatcatctctactggactccttccttgccgacctgcctctagtcttgcctgcctccaatccacataccatgtcattactagagtcagctgactctgaaagatctaaaacatattccatgtcttcgttgtgtcaacagtgtgaaactcaagtcctacgcaggacctaggtga

SEQ ID NO: 123766 - DNA, 478 bp, Homo sapiens
gatcttcctgcccatttgaaacacaatatatgtcaaatggaactcatctgtgctactttttttaactaatgacataattacccatccgtccccccaatcaaattcttattctctttgtcttctacttccagtgagctttccgatacccattttatctgtccctttactctcataccacagaaatgtctcaatgcaagcctgggtgcagtggctcacgcctataatcctagcattctgggaggctgaggtttgcggattacctgaggtcaggagtttgagaccagcctggccaacatggtgaaacccgtctctactaaaaatacaaaaatcagccgggcatggtggcaggtgcctgtaatcccacctactcaggaggctgaggcaggagaatcgcttgaacctgggaggccgagattgcggtgggccgagatcgtaccattacattccagcctgggcaacagagcaagactctgtctca

SEQ ID NO: 123767 - DNA, 309 bp, Homo sapiens
accaccatgtaagaagtgcctttcaccctccgccataattgtgaggccttccccagccaagtggaactgtaaatccaattaaacctctttcttttgtaaattgcccagtctcaactatgtctttatcagcagtgtaaaaatggactaatacaagtctccaataccatgttcatagacttcataaagtcacagatgtcttgaacgatttacaatttctgtttgccctgcttttttattttgttttgttttgtttgagacaggctctctgtcacccaggctggaatggagtggtgcaatcatagctcgctg

SEQ ID NO: 123768 - DNA, 517 bp, Homo sapiens
aggcttagccagcccaaccgtgatgttatatggacataacctaacgcatttaaaaaaaataaaggttatgcaccaaataatgtgaatgctacagcaatcaggggtgtgaagacagctgtgagcaggtatgtgtgtgcatgggatggaaggactctgctcccatttcaaccacttgatccaaccaagatctgttgcggtccaaaatctgtggaatgctaaaagctcctgggaatattcctccagagtactcccaaaagcatatttgctttcagactgagtttgcctccttaggtgcataggagctgcccaaataggtaattccaagtacttactcatgacagaataactgaatgaaggtaccactcaggaaacagttgtgaactctacagtagaaaattccatatatgcctatacctgaatcacgtacatttttaaagatggaattttagggttggtggttcatacctgcaatcccagcactttgggaggccaaggtgggcagatcacatgaggccag

SEQ ID NO: 123769 - DNA, 296 bp, Homo sapiens
ctacttttttccttttctcttttccttctacccttgcagggctctcataagtgcctttgcgtggtgtcacagttagataaaaattgcctgtattttttttaatgtctttgatctgggcatcccgagggtgcctctgtaagtgtgctgagacacaactgtgtagtggtaaccaaacctaattgcccagcagaattaactcgaaggagggtttttaaaaaaagttcaattgaaatataattcatataccatacgcttcacccatttaaagtgtacagttcagtggcttttagtatgtt

SEQ ID NO: 123770 - DNA, 424 bp, Homo sapiens
ttctgggaacagcccagagggtgttattggttctcacatccaggccaaacggtatcacccagaacaatacattcttaacaaaatgttacttctccctaccactctggtataatagcatttctgtgcacttttccccattcctcaaggagtggggctgaattccctattaggtaagagttgtagtaacaaacttcctggtgtgggcctgaatggacttaatctttaagggaaaggttgaagatcctggttctctatacccaatgtgaaaacctgtttgaggtatccgagggctaaaatttggcaacaaggaatgccaccttctctatttgaatatgattttgacataattatttctgtggccagaaagagcatcttgagctccgttttggagaagaggaaactatggcccagagatgaagaatgg

SEQ ID NO: 123771 - DNA, 356 bp, Homo sapiens
agttgtggttttggcctctcccagcaagaggcaccaatgtaatgtcagagccacgctgaactctggcatgggcgacgtttcttttttctttgagttgtgtgtgtttgttttgtgatatttccctaccaggccattaagaaaagttagatggcagcaagggtgtgagtggctcgatcccagataaagagggccaggcacagagacggcgggatcgctggaggaatttgagagtccctcaggtctcaccacccatttgcgggttggggagcaggggtacccctgtgggccgtgccttggagctcaagtgactggcctaaggtcacattgcggcggctcatcgaggacttcttattccg

SEQ ID NO: 123772 - DNA, 782 bp, Homo sapiens
gattgcatattgaaacgtgaagaaataagcagatgttctgttgctcagatctaggtttgaaataattactttgtctaattgcttgagttgtgtttctgtcaagtttactctcagagatttaaataaagcacactgcagtaaaggcatactagagtaagaatgcccaagtaataatggtcaaggactaatagaaagaaaaataattatgtcaggaaacctagcttacaaggtaattgctaaattggaattttaatttgttcactgagacatgtatgtatatacggttatttttatctcatgaagtctagatcccagtgtttctagacatagcaatgtaaaatagttcctttacttacaagctggtcatttagaaattgtattccaagcttctcaaaggacagattgggttttacagtgggtatagtttgatgattgagcttgtattgctgcgccctgttgattaagtgggttctgattggtatctgctggactcatactcttcattaagccacagagttaggagagtttatatccaacagatcttagaaacttagttattttagatatatttcagaaattgacagttatctgcagcaaaacaattagtcagaaaagaagggaatttttaaaccaaagataatttaattaaggaatttttgaagaccacatggttaaatacattgttgtagatcaattttcctttaagattttttggcctgttacatacctagtgtatttatatgtctcctaccaagtttcatggaaaggaagcctgaatatat

SEQ ID NO: 123773 - DNA, 635 bp, Homo sapiens
cacagtggctcatgcctgtaatcccagcactttgggaggccaagttaggcggatcacttgagctcaggagtttgagacccatccttggcaacatggcaaaaccatgtctctacagaaatacaaaaattagccaggcatggtggcgtgcacacctgtaaactgaggtgggagaattgcttgagccagggaaacggaggttgcagtgagtcgagatcccaccactgcactccagccgggtgacagagtgagaccctgtctcaaaaacaaaacgaacaaaagaaatacgcattaagaacaaaactataaacatataactaaacttttaaggaaggaaagaagaggaggaaaattcataggtatcagaaatcagagaaataaaatcagaacagtaagcgggagctagtgttgctgtatatagcacagggggcttttggtcctgcatatgttctaaggggtctggggttgaattttattgcacatatggggataggatatatggccttgggccttttcaaaatatatctgaaacaaagacccaggcatgtggcctagagcctgaaataacttccctaattacgcatagagattagaaaaagtgcccactagtcaaatgctcactcaagaacaaagtcaat

SEQ ID NO: 123774 - DNA, 154 bp, Homo sapiens
gacatgagggagagaggataggatggggaatggctttgaggcttttggctggggcagctaaatgaaaggcagtgccggctcttataagaaatggtattggccaggcgcggtggatcacagctgtaattccagtaccttgggaagccaaggcaag

SEQ ID NO: 123775 - DNA, 188 bp, Homo sapiens
tcaccactatctaattccataatgttttcatcactccaaaaagcaaccacttacctcttaattgtcactctcaattctcctctcccttcatccccctggcaactactttttgtgtggataaacttgcctgtttctggacatttcgtataaatagaatcatacagcacgtggctttttgtatctgcctt

SEQ ID NO: 123776 - DNA, 858 bp, Homo sapiens
agaggagtgatataagggaggatgggaaggtggaaaggattagactggggtcaataaactgtaaagggacagaaagtaaacattttgggctagggaagatacatagtctctgccacagctattcaactcttgtagcctaaatgcagctgtaacaatacacaagcaaatggacatggttgtgttctaataaagctttacttacaaaacaagcagcagaggatatggtccataggaccacagcttgctaaccactgaaatagatcatgcagagccttttggccagattaaatgttctggtctttatcttgagaacaaagtcaagtcatttaatgaattgggaacactcaagcagcaagataaaatttgcattaaaaaagttattgtttaggctgggcgagatggtaaatattttacactttatggaccaagagataaaaatcaagaacattatgtaggtacttatataatataaagataaatttctacaaatttttcactgatgcaaagcaaaactttagttataagcacagaagttggaatttcatatagtttccatgtgtcataaaacattagttttttttttaaccaaaaagtgtaaaaaacattattagctcataggccgtatttgccaacccttggtttagagaatgcagaagagggtaacaagttaattgtgtcctggactagggtggtggcagttaagatgaacagaaggtagatttttgaaatttaggaggtggaactgagaagacttggtaatccataaaatagggggactagggaagacggtgatattatcataggtttctggcatgggcaactgagtagacaaatgatggtatcactaaataaatgaga

SEQ ID NO: 123777 - DNA, 431 bp, Homo sapiens
cacaggtcctaggttctatctgaaagatgagaactgatgccctaagaattttcttttgtttttgtaggctgaaaattcaatctttatgatgattcaaaatagattgtgcatgtcctaccatatcaggatctaaagatatggaagaaaacagtggctcctcagtggactcaaaggaaacaccgaatcaaccaaaacaacaactcccacaaaacaaaaacccatcaccgtccacagagtacatgggctgttctactgataattcagtttttagcattttgttttgtttttctttttgagatggagtcttgctctgtcacccaggctggaatgcactggtgcaatcttggctctgcaatctctgccttccgggttcaagtgattttcctgcctcagcctccagagtagctaagattacaggcgtgtgccaccac

SEQ ID NO: 123778 - DNA, 377 bp, Homo sapiens
gctcagtgatcctccatatagtaagcacagatggtcttggttcagtctacggattcaaatgctgacctctttccaaattcttctgatagaccacagagcagtccttgtgggaaaatatagacctgaccaaacttgagtttacatagaaatgagaagttgctaagcttgtaggagcctatctcctgctccagcacctgcctgggactgaagatacaagaaagattcagtttaaaattatgaggtgggtgtatcacaaggtcaggagtttgagaccagcctggccgacatggtgaaaccccgtgtctactaaaaatacaaaaattagccgggcatggtgacacactcctgtaattccagctactcaggaggctgaggca

SEQ ID NO: 123779 - DNA, 576 bp, Homo sapiens
cgcaaatctgcattttccaaagctcctcctgacttcaacgtggagaatggactagagggggcagaactggaacaggaaggcgatgcaggaagtgacaggagtgatccagaagatgacagaggctgaagtcaaggtgaggctgtgggaaggaaaagcagtgttgtggatttcatagacactcaggaggtggaattggtgaaaactggcatcggacgagatgtaggggctgagcagaagcagggatgattcctgggtatttggcctgagaaatggagtggttggtggtcttgctcattgagatagaaaacagaagaaaagcagggctggagaagatcgtgagcctagttctagaaatcttggaattgctgcgagcaagttttgacagcacgatatttggttttcttccactgggattacagagaacttgtcttttgggtagtgagccacaggggaaattttcctgtttgggtggggggctgggtgcagacccacctctactgtgagtatcctaactgtgaagcagacacagtcccttggagtgactataaaaatattaaaaggctgggcacagtggct

SEQ ID NO: 123780 - DNA, 332 bp, Homo sapiens
tggagatacctgtgtaaataggagtgttcctctgtttggagacttgactcatattttagagcttttctcttagaatattaattactacagttggttcagtgtgtactgagtatcaagtgcttgcagagtacatgataagcactccataatgttaagctgcctcactgaatcctcatgcccctcatgagctagaaagtatcatgattcccattgtagacaggaagagactcaggctttctagaggctcacagaggtggtgatgtgatttgcccaagaattcaaggccaaattttctttctgccaagttccccacaccttccaggcccattgct

SEQ ID NO: 123781 - DNA, 258 bp, Homo sapiens
tccacgataaatggaatgaaagtcccgaaatcctcagagtatcagaaatgttctctgttgaccacaggtgacaatttatatcccaaagtgaacatgtggaactcacatatgcatgatagaaaagagggaaatttaaaagctaaatctatacaagttctagaagaaaagagagaagccgaaccagcctgggcaacatagtgagaccccatttctttctttctttctttcttttttttctgagttggagtctcgctctgt

SEQ ID NO: 123782 - DNA, 173 bp, Homo sapiens
actgccctctagcctgggttacagagccagaccctgtctcaaaaaaattttttcctcatctttcttcatgtgtataatcatttttcctagctttaggtattgagcaagccctcctttcttcgtcagcctgtcataccgtatcccacagttcaaatgtgtgggggtttctgttt

SEQ ID NO: 123783 - DNA, 797 bp, Homo sapiens
atctatatggcaggccaacacattgcagattctgtagctgaagctgataatgcagtctttcagtagaatttcttcttcagcgaaacctgagttttgctcttaaggcttttcaactgattggatgaggcctactcacattattgacgataatctccttaaagtcagctgattgtggatgttaaccacatttagataataccttcatggcaacacttccatctgtttgaataactgggtactatagtctagccaagttgacatgtccaactaaccgttacatggttcaatatatatttgtccaataaaaggaagaacaaatggctaaaatggttaatttaagcagaaaaatgtttatttggaggatgttgaataacagaatttaagtaaaaagtgagcacttaggcctcaagaagtcccaagaagaaccagagcagtttgcaggggtagggacctaggtaatagtaaggaacaatgccttcagtgtaccacagtcataaaaaatcagctctagccattttgcttcctcacatcactctaagattcagcttcccgggaaactcagcctgattggtgtaggctgagtttaggtcacatgtctcccttgcccagtgaaaggtgggtacaccttgattgacattctcaccacaactgcattcaggaagacaaggattgtttcccaataaagtgtcacaaggctgttaccaaaagaaggaggaatactagacatgcacaaataaaagatatccacttcgccaactcttgatatctcacatagatggtcagctggtaaaactaac

SEQ ID NO: 123784 - DNA, 788 bp, Homo sapiens
gcaagagataagaattaaccatattatgatgcaaacaaattgtttttttgttattgtgaacttccatgctaagtgctacattaaaaatcaaatgaaggtgacccagagtaagttaattagattttaattcatatctttaaggataaaagaagtttttattaaccattggtaactaggatgctttttacttaaatcagagtcaggaaaagcagttggtcttatatttcacgagataacatgttttcacttgatatgaaatcagttctttttttccctcatgaacagctcataattggattttatttttggacagaaaaactttttttattgttaggtgaattttacagttttattggaaatctcgtttggttatttaccaaaactatttaagctttttgggatgttggacattttcaatgcaacaggtcaacaaagaattcttttttgatgtgttgcattaagatgccatcaaaacagacactacgtcttttaatgagtaaataattaacctataatatgtgtaaactacttgttcatcatttttaattaaaatattttgtatttcaaaactgtttcaaatatgaaatctgggtttagaaaggatctgcatgcaggtcaacgtgataagcaatgatctatgtagctttatttttacgacaattggacagaggtaatttcttagcacctcttaggctgcttaatttagagttaatccaaaggaagaaacattccttcagaagactaggacatatcagatattaattattaaaaataggctgggcacggtg

SEQ ID NO: 123785 - DNA, 245 bp, Homo sapiens
ctgccacctcaagaacatcggctgcaagtgcaagtagggaacacaagttcccaagttccctaggaattcctgtgaccagaaagattcagagagattcagggtcaatctagccttctaggttccttatctaatgtttgtccaagtataactgatgacttgtgttaacaccatgcatgccttgtgtctggtctcatctttacccctaaacccaagtgcccaatctcagcctaagcagaaatccaaag

SEQ ID NO: 123786 - DNA, 262 bp, Homo sapiens
ctgacactaggacagtgtctagctaaaaacacataaatttcctgacttactgctttaaagaacttggttcaattcaagtcagcaggtatttactgagagtttacctactctgtgccttgttctagatagactctctgaggggtaataagcaaggagtaaaagacagtccctgcgttgaagtccccagtttttgttttgtttttttttttgagatggagtctcactgtcgcccaggctagagtgcagtggcgccatctcggct

SEQ ID NO: 123787 - DNA, 357 bp, Homo sapiens
ctcttgccaagctccctggtaaagtctcccccctcctctcaggcacctagaacctgcccatctccatcattccagctggcaggctgttgctcctggagaaagaggtctccactctcttacaggcagccacctcaaccctgtcgggaagtccttcttgtcttcacacctcagtctctcttgctgtagccaatgctcattctctctggaaacattcttggcaggctgtctcttcagcgcgttgggatgctttagcaatccctcggcctgctctcctctaagctgaatctttctttctttcatttttgagacggagtctcgctctgtcgcccaggctggagtgcagtggcacaatctcag

SEQ ID NO: 123788 - DNA, 180 bp, Homo sapiens
aaaactataaaataaaaacttttaagactgtacaatggggaatatttttcacattttgttagatttcatttgctgataaagtcataaaaatgttactagattttttgttgttaccatttagaggtactcttctaaaaagttaattttgtagcttttgtttgtttgtttgtttttgttttt

SEQ ID NO: 123789 - DNA, 440 bp, Homo sapiens
tcagagtaaggggaacagagaagaaatctgactggaggcttattgaatgaaattgctataatctgggcccttgagaaaaagaagaaatctaccaggctggaacttgtgtatgtgggatgggaaggaaaagataggaggatattgaaagtaaagcggaagagcatgtgcaaagacattaaaaaacacaacagtatgtaaatgtgggagtacagtttatatgttaaatgtattatgaaaaacattcagaggacctgaagccagctattatagaagctaagtgggaagctagagtacaaggatttggagttcttctgaagacacttttgactgtttttaagtaaaaggaaaactaacatgagtctgtcacattcctaagtgtcatagatgctacccagtttaattttcccaaatgtttccaaggcatccccctactgtttttc

SEQ ID NO: 123790 - DNA, 681 bp, Homo sapiens
aagaatatttagtattcttttaaggactatcatttttaactaggaaaatttgggggcagttctcaaccttgtttttggacaccaaccctaaattacaattgatgataaaactatattgaacataggtgctgtcagcagagtaataaattctgaagtgatacctcttttccctctgagaatgtaattttagtacttgaatgtaaagtatatgtcccctaatttcagaaattattaattatttggttcattatttttcataaaaccttattaatgggcatacaattgagctctactactttgctgaaagtttctactacctaaaaaagtaatgaattacttaccgagtgacagcaccaacatttcagtactttaatgtttcctaaatgaacatggttaccaaaatggatatttgatatgggaatgtatgagtatacaaagaagataagttatttataccattttgtcaagcttcaaatccataagggcacaggactcattcccagcaatgggacaaaagcgcacatccaaacaggtgtcctttccttctaagggtcaccttgctgctctacatttattcttaacagcttccattgccaaaaatgtttttgaatacctgttttcaaattgccttcagagtctttggcaccttcatttcaatagccgtgtggtaacaaatcttga

SEQ ID NO: 123791 - DNA, 758 bp, Homo sapiens
tcaactaaacaacccagaaccctatttaaaaaacgaaatatgaaaaaaaaatttaagccaagcgtttatcctagaagtgcagattataatgaaattaatgacataactttttgagtgtaacttgagtaagcaaaagtagcatacagtttattgaactgagatatatagagttccagacttggtattcacatttttccataataaaaacagattagaacctaagtagggaatctgatattctctaaaactgagcctcaccttgcatgagccctctcttctaaacaacttttcaaaacatcatttctcaagcccagttttactttcctgaatacatgctgttccccttccctggcaagcttttctctccttctaagtttgggaagcaagatttttccactaaaacccagcagaagctttccctccttgaaatctttcaactccactgtggactctcactttcatgatctaggctagtatttctctatctaagtgtgctaggcatcagtgggaataggaaaagaagagtttctgctgaaaatctttcttaaccccaagtccagttgtcacctttactggtagaagtatatttgcctggtggtaccatcctggcccacagcagtgattcccaaatactgatccactaagttgtgccaaactgttttcatcagtatcacctgggaagctttatataatacaaaatgccaggtcatgcctcctccaattcctctcccttctcagaatttatacccctgttctcc

SEQ ID NO: 123792 - DNA, 340 bp, Homo sapiens
tgaatgcagaaccagaaagcaggcagagtcatccacctccagaggaactggaattgaagagtttgtactggggcctgatgaggcggggcctttgctctgtagccaaccccccttaggcacagtttagtttgccctcctctcgggcgaattaatttcctttctgaagggcacattctttctttgtctctgtgaataacttcaagcctattagtcaagtcttgggacctagaagccattccatcctttaaggtaatttgcctacataatctgattccttttatgtttgttttgcaatttagctctctctgaaggcaatctcctttctgaagttcaaagccca

SEQ ID NO: 123793 - DNA, 409 bp, Homo sapiens
taggccgcagcacagagaaggggaagccaggccaaccctggaagtctctctgagtggaggtgaagctggaatctggagcccacagtggctaggattcacagagcaggcactggagaggagggtatgcacagagagctagctctgaatgtgtgtagaaggtcccctttgagtaacagcagagagttcccttcaattattcagctgagtagtaattagcacacttgtggaaggaaaacacctaaggctaaggctggggaaagaactaggattagagcgaataatccctggagagaaccaggagtaatgcctattcccaccaaccagggtagaaaccccccataattcgtgaatcattgatagagtattcagaaacattttttctcagtagtgagtaaatgcctttctggtc

SEQ ID NO: 123794 - DNA, 312 bp, Homo sapiens
atggttgaattcattttgctaatattttcttccagattttttgtattaatatttatcaaagatattggcctgtagttgttctttcaggtatttctttgcttttggtatcagagtaatactggtcttgtagaatgaatttgaaagtgttccttctccctgtattcttcaaaattttttgaggagggctgctattagtttctctttaaatatttagtacgggctggggatggtggctcaggtctataatccaagcaattttggaggctaagcaaagtagatcacttatggtgaggaatttgagtgcagcccaga

SEQ ID NO: 123795 - DNA, 271 bp, Homo sapiens
gttaatttgaaacatgtaccttgatcaagaaaatcacttctaaagattattctgggtgggcacagtggctcatgcctaatcccagcactttgggagaccaaggcaggaggatcacgtgaggtcaggaatttgagaccagcctggccaacatggtgaaaccccaactctattagaaatatgaaaaattagccaggtgtggtggtgggcacctgtaatcccagctactcaggaggctgaggcaggagaatcgcttgaacccaggaggtggagg

SEQ ID NO: 123796 - DNA, 381 bp, Homo sapiens
tctggtcctcatggaccatgtgtgtttgatggatatgagacaaatttgaagagaagttttgggaatattttctttcactggacattctactctctgattccatggattcgactactctagggacctcatgtaagtggattccagagtgaatatgagaagagactgctgtttgccaggagctgggagtggggagaatcagaagttgttcatgggtgtgcagtttcagttatgcaaggtggggaggttatagagattggctgtcgagcttgatacctatagttcacacagattgagtatttcttatgcataagacttaggacaaaaagtgttttggatttctgacattttttgattctgaaatatttgtcatatacttactgg

SEQ ID NO: 123797 - DNA, 277 bp, Homo sapiens
cattgaatagaagagggctattcccaacattatctttatcttgtagacataaataacaaacaactccggtaatcaaaatttactacaattgtaatagattttggcagagtttatgtattgtatgcaatgctaacataacgctgagtttcaaggatagaggccaggattcctagtttggctttgttaaatgggaaaaaaaaaatcactactgtattcgtagtgtttactacatttaagagattaattctcataaataaaattgtttataccagcttct

SEQ ID NO: 123798 - DNA, 210 bp, Homo sapiens
ccctcgaccccttcactgctgcacctctctgagtccaacccaggctttgccctaacttgaccttcctttgtccccagaagcaggggaacaactacccagaccaaagccactaccccaggagtgcacttgtgggtggtttgcattcttcacacaacatggatttatggagggcctggaatgtgtcggaagctgtggtgggaatagaaagag

SEQ ID NO: 123799 - DNA, 770 bp, Homo sapiens
agcctctcctgtttcttgtcaccacccctttcctgcccctgacacaaaccctacatctcagtctcacaaaacacacaagttcttcacactccgggcaggtttggtagcaaggaatagagcgtactccagtgacagcaatcagtaggaagtttgcatccggagacacgcagcctgtctgcccctgtcttgggccacccgtctagacatttgttctctaacaatcagccgggttccttcaaacgtgtgctgcttatacatgctcattgtgtactgctaatgtcacctacttcccccttcattccccacaatgaatggatccattttccccatgttcaagttcccaagagagaatcgactgccactgtaattttttttcctaatcactcataggttacaagtacctaccctggtccagtgaactgcgggattcatatgtggccacttaggctggtctcgttggtatggagctgtgggagggcagcacccagaaataggctttgttccaggcctggcacgtactcctcctgctcctactttctctacctgggaaatagccgctcaggacgaagctgctgctgtggtgtcgccacctctgagaagtctcccagaccctccgactgctctttaattgcctgttctctcctctggaagccttcccccaacacagaaaaattcaatcccatcatcaaaaagggctttaggttttccctccatctttacgtgttgatcaaagttgcagatctgctggaatccttattgaaaactcccca

SEQ ID NO: 123800 - DNA, 585 bp, Homo sapiens
agcctctcctgtttcttgtcaccacccctttcctgcccctgacacaaaccctacatctcagtctcacaaaacacacaagttcttcacactccgggcaggtttggtagcaaggaatagagcgtactccagtgacagcaatcagtaggaagtttgcatccggagacacgcagcctgtctgcccctgtcttgggccacccgtctagacatttgttctctaacaatcagccgggttccttcaaacgtgtgctgcttatacatgctcattgtgtactgctaatgtcacctacttcccccttcattccccacaatgaatggatccattttccccatgttcaagttcccaagagagaatcgactgccactgtaattttttttcctaatcactcataggttacaagtacctaccctggtccagtgaactgcgggattcatatgtggccagagttctggcttcatacctgagccaaaagccccaatccatgcttggccattgcctgagtattagctgccccagggggatcacggtccccatatatttgcttgccatggaccctgggcagcagggagagagtagagatttgtcaa

SEQ ID NO: 123801 - DNA, 517 bp, Homo sapiens
aaattgttccacttggaataagttgtagacatgatacttttcccccgaatacttgaatatgaatcttttaagatgggaatactcttctacacaaccacaataccattatcatacctgagacaattgacattaattagtgttaattagtattatacttcatatccacattttcctaattgttgacaaatgtttttatagtcttttttttttaacattaacaaaaaaactagtattctatcaaggttcatattatctttgcttattagtatctctttagtctcttctaactagtataaaactgctgtacttttttgttttttgttttctcttttccaaaaggtcagtccaattgtgttatagactgtctcacattctagattcatctgatctagattaaactatatacgttttagtagtttctttagataaaacatgaattgtgactataaaataatgagactacagtatggctttcagaaatggtaggttactcttgtctatagcactaaggcataac

SEQ ID NO: 123802 - DNA, 978 bp, Homo sapiens
cttggctcactacaacctggattcaagcgattctcctgcctcagcctcccgagtagctgggattacaggcatgtgccaccattcccggctaatttttttgtctttttagtagagacggtgtttccccatgttggtcaggctggtctcaaacgcctgactcagatgatccgcccgcctcggccacccaaagtgctgagattacaggcttgaaccaccgcgcctggccctgtgatgtagattttgatgctgccagccaggctgcctgccgggatcgcctgccctggagcaggagcatcagccgtgcgttccaggacgcaggcatggcatgaccggcaggaggcggagtgcccggcgtctcttgggatcggagcctcctgaattccacgctgggaccttaatttggttttaacacaaataaagatctcacataaagataaaaggggatgtgttggcttgtaatttttgttaaaagcaatggtatatgttgtataggatagtgtattgggatcaacaggtttttggggttttttttcagcccactgacattgaaagggataaacagttttttggttattagtgagcagttttctctcaggccatagtgtaggggtttgtggtcatgtagatgagagataggctgggattaaaatttgttatggcagtaataagagcaacagagctagactctgtcaaaaaaaaaaaaaaacatagttagtagaagaaaaaaatcataggattataggattagagcagaaaaaaataaaataaaacaaaaactacaaaagattaatgaaaatatttggccttttagaaaagttaaaaattggcaaaccttcagcagactaaacattttttttaaattcaaataaaaaaacgagttaaaaaaggagatattacaacagataacacacaaattcaaagattggtttgtggctactataagcaactgtatgccaatacattggaaaatctaaaaaa

SEQ ID NO: 123803 - DNA, 296 bp, Homo sapiens
aatctggctccaccacttagtaatgcaatcatgctcaagtgacaactgttctgagacttagttttctcatttgtaaactggggataacgactaccttgcaggtgtattgtgggtgtattgcagttatgtttgtaaaaggcactgaggacagtgtatgactctgagtgggttcccaagatattgcaacttaaaaattgttactacaggttgagcttttgaaaaattgaaatctgaaatgatccaaaatccaaaactttttgagtgcagatgtgacaccagaggtggaaaatatcaaa

SEQ ID NO: 123804 - DNA, 755 bp, Homo sapiens
ggttgaggctttgctgggctctgcctccagtttagggcccccctcataagacacattctgctcacaccggcagacaccctggtgtgaatccacaatctgctagcccctaagaaagggctctaaaaagtaagcagagacaacaggatcacaaacatacattatatattcagaagtatgtcatagacattatgtaagaaggggcaatagtcttgtgtttgtattggtggcataagaatttcttttagctgagttttactatatgagagaaaacaagggctgctaatttgacaagcggcaaataggttgctgctgggtatctatgctgcttctggagttttgatctcatggagtttgttcatctaaattccaggcagtggcacataccctagggacacagggattatctcactgccactctggctgagccacggagtaaattatacagggatgagggaacacccacccagcatactcactggtagattcacaccctgtcttatttcctttcttgccagccagggaaaccagccattgaactaagcatttagtgttgtactgcagagcagataagagcatgggctcaaattctgactctgtcacggatcatctgcgtagcctggagcatgctaatgagcctcccaaagctgccccagttcatctgtacatggggtagagatgacagtgctagtgaacacctcatagggctgtgtagaatacataaggtagtccatgtaacaagtttgcacagttcctgg

SEQ ID NO: 123805 - DNA, 697 bp, Homo sapiens
catctcctacatcctacatctcctacatctccatctcactacaacctcccacaacacgccggggttgtttttgtattttttgtagagacagggttttgccatattgtccaggctggtctttaactcctgggctcaagcgatctgcctgccctggcctcccacagtgttaggactacaggcatgagccactgcacccagccaagtatcagcttttaataaaactgcatctcactgttgaattgacgtaacaccgatcagaatacagatgcattaggaggcttcttttaaaccaagcccttctgctattaaccttctgatgatttttctcctactaccttgctgtttttacaggcccactaatttgcctgcttgactaaaataaggacgagttatgtgctgatgagagacatgtttgtaatgttattcgttgtgacacagttcaaaagaatttgcctttgattctcactaaaatgtaaagttttgcatattaagatcctttttcaacaactgagcaactctttataatgaagggcagaagacgccaaagggaagaaaatatttacctttgtgggcttttactttctttcctgggaatggtaggccatagctattggtatgtttttttttgttgttgttgttgttgttgttgttttttgagaaggagtctctctctgtcgcccaggctgtagtgtagtgg

SEQ ID NO: 123806 - DNA, 581 bp, Homo sapiens
gggaaatgaggaccaccgctccggggcgcgagtaggcgcgtggagtccgggggctcagccgccgcgcctcttcctcctgcagctggagactgcaacagcggcgggtgcaccggcagcagcgacgaccctgcgcgcaggtggcagtgtagaagccagaccgggagcttccagaagtggtttctgaaagagtcaaatgtacatgagtaagcaagcacaggaatctgaaaaaccacaggcccactaatttgcctgcttgactaaaataaggacgagttatgtgctgatgagagacatgtttgtaatgttattcgttgtgacacagttcaaaagaatttgcctttgattctcactaaaatgtaaagttttgcatattaagatcctttttcaacaactgagcaactctttataatgaagggcagaagacgccaaagggaagaaaatatttacctttgtgggcttttactttctttcctgggaatggtaggccatagctattggtatgtttttttttgttgttgttgttgttgttgttgttttttgagaaggagtctctctctgtcgcccaggctgtagtgtagtgg

SEQ ID NO: 123807 - DNA, 755 bp, Homo sapiens
gggaaatgaggaccaccgctccggggcgcgagtaggcgcgtggagtccgggggctcagccgccgcgcctcttcctcctgcagctggagactgcaacagcggcgggtgcaccggcagcagcgacgaccctgcgcgcaggtggcagtgtagaagccagaccgggagcttccagaagtggtttctgaaagagtcaaatgtacatgagtaagcaagcacaggaatctgaaaaaccacaggtatgtaggacaattaatccacctatctagctttataattattgcattccagtagtactaacccatttgctcttatgttcaatattttgacacttatataaatttctatgaagtgaaatgtattttgaggtaacctccgaggagaagcagggtctaatctatttctgacaatgtatttaaataaaaattctgcatgtcattatattacatgactttttactgttctaaaagagttgtttttccattgtgaccatgtggctttgcatttaaccagttgtttgatatctgcttttcaaaacacttttcctgaaactacataaaactcccaaagcgctgggattacaggcatgagccagcgcctaccaccgctattggtactttcacacggatgctaaagttattgtgctggccgtgttaagggtcaggcatcaaaatggccgctcaagagaatgaagctttctctttgtgcagatgcaacgggtgggatggggtgcacaattatcacagtgctggttgtggt

SEQ ID NO: 123808 - DNA, 599 bp, Homo sapiens
gggaaatgaggaccaccgctccggggcgcgagtaggcgcgtggagtccgggggctcagccgccgcgcctcttcctcctgcagctggagactgcaacagcggcgggtgcaccggcagcagcgacgaccctgcgcgcaggtggcagtgtagaagccagaccgggagcttccagaagtggtttctgaaagagtcaaatgtacatgagtaagcaagcacaggaatctgaaaaaccacaggtatgtaggacaattaatccacctatctagctttataattattgcattccagtagtactaacccatttgctcttatgttcaatattttgacacttatataaatttctatgaagtgaaatgtattttgaggtaacctccgaggagaagcagggtctaatctatttctgacaatgtatttaaataaaaattctgcatgtcattatattacatgactttttactgttctaaaagagttgtttttccattgtgaccatgtggctttgcatttaaccagttgtttgatatctgcttttcaaaacacttttcctgaaactacataaaactgccaattgttctgaataatttcatttgagataatgttaac

SEQ ID NO: 123809 - DNA, 676 bp, Homo sapiens
aggcttctaggggtggtagcgacacaagttatgggagggtgagtcagggaactgtatggtgaataaagtaaccttgttaggcagataaaaagtctgttgagtaatacaagttgcttctgagcagcccttgggagcggaggtgattgtctggactgggatcaacctccaagctccactcctgtgatcccagttaatcttcccatgttgagaagattcccagggagcagattcatgacaattgagtttgttttgcaggatccgtctttaggcggataaggaaggctttccctgcctgcatctgctgctccccaagtgccttcacttctaagtaatcagcacaccaaagtggcatattttggggtggcatttcctgaactccttcagtggacatgatttgcattaacacttggtagacagaggcatgggggctgggagaggggtgatattttattttctagtcagttaaagctagtcctttctggtttagatgtcacttctggactaggcctgttttggaaaactgccctctctcccagagttcctccctccttctccaggtcccttctcttcccctttctcagtctgttctcctgggtagctcagggtggaggaggaagcatacacagcgttttggtcctgaggaaagagggtgtgctccccattgttcttctctgct

SEQ ID NO: 123810 - DNA, 601 bp, Homo sapiens
atttccaaatacctgagcccgcgctgtgcagaaaatgtagccagttttaagaaacagcttgttttctccctctaagcccatgaagaagaatacatttatccctgacaaaatagcattgtccccatttggtggtaaatcgtcaagtctgtttagaatcagggtcagcttctcaaatgagcctttcccccatgtagccttcctgaatctgattaacactgtgtcaagggagttgtctgatgtctgaccttgagcagcatgcttccctctccccacctcctttttttgggaatcattcattttgtacagcctcgggccctgagattcctccccagcaggctggagtgcactcgcaggttccctttattggtatcggaagggtttcagacccagtgacctgtcatctgtcttctcacctgcttacatgctgattcactgatgagctggcatcgcaggccccgcctccctctgaatggtctgtgaggttgcaactgcttctggagaggggatgccgagccgaaccagagctgggttactacaagtgtgaaccggcagcctgtctgttgccacagaagaacttggtcaccacactgagaagccgtgt

SEQ ID NO: 123811 - DNA, 381 bp, Homo sapiens
tagatttcctgtcattgcaacttttcaagcatagactggatgacctaggctggaatgtagtaaaagaattgaaatattagattccaatgcttattttaggttttaagtaataatggaatctctttgaaagtgaagatctatcacagaattctccaaacatagtaaaaggactgagaaatggagaaaagcctgtatcaggaaggttggtgaaacctttgttggcataatcgtgggctgtgggcctgaaatggagttacattcaatgaagctgttggttgaaggacctgggaggcagggaaggacttgactagggtatcagatggctgcagggagtgtaattttggaactggcagcctggagtgggaaggtacacttgagaac

SEQ ID NO: 123812 - DNA, 312 bp, Homo sapiens
tgggctcatgttgatcctcgatgtcaggaacatgttaaaaatccttacaaaggcaaaaaactcaagaaacttccagaatcccccaacaagaaactcattacagaaaagctgcactttaagaaacaaagacgggggccgggcgcagtggctcacgcctgtaatcccagcactttgggaggccgagacgggcagatcacgaggtcaggagattgagaccatcctggctaacacggtgaaaccatggtggcaggcgcctgtagtcccggctactcaggaggctgaggcaggagaatggcgtgaacccgggaggcg

SEQ ID NO: 123813 - DNA, 543 bp, Homo sapiens
tgggggtgaggaggtggcaagcatcgccttttgaggacagagtcttggagaggtgttggctttctagggagggccctgtgattctcctgcaaccatgtgggccggggccaggaccaaagccatcgtgctgtcgctgtggatttggtggccgcttcccctgctcagatgttgtactgcaggcctgggccttggcttggggtctctgtgtctccatgttcaggacaggcttgtggctttgggtaccacgaggggccatccagcccagggggcttcagggagctgcccctcaagtgcatgtggggtgctggggtgcagccctgctgcccatggcccggaagtccaggcagcactgctctggttcgaagctgccccaagggtacgggaggcccgtccactagaactgaggcctggcaccatgttgtgtcggttttcatggcgagaaaacatcgtgggcgtctgctggggctggaggaggcgggaggccgaggcagcaaagctgacccgctggcgggtgggggccactgtggcgtccccttcctgcag

SEQ ID NO: 123814 - DNA, 340 bp, Homo sapiens
tttaaagtctctgtttctctattccattttgaaacacagttcactcatcttttcttcagtgtttaatctgccgttaatcccatccagtgttttcttcatctcagacattgtagtttttaatctctagaagtccgtttcggatctttcttagatcttccaggtctctgcttgtcttgtggaacataccaaatacagcgataaataacttttttgagtccttgtctgctaattctagcatctgtatgattattttctacttctaaagtgaggcctctcctagtcctctacccaagaccgtgaattgtgagtattttcggtctggctggtaaggacaggcact

SEQ ID NO: 123815 - DNA, 395 bp, Homo sapiens
agacctcactgagtcctcttaacttttcagggccctaaacttccttagctgttgccccaataatctctgaagttccttctaggattaaaattctgatttcaactttctacaagctccttaaactcaacacaatcaaaaccaaattcatcttcattctaaactcctaagagccattctccctcctgacttccctattcttttttttctttaatgtcccattcttccagccacccaaccataaaaaccacagcctcatctctgacttgagacatagaactcaagttctgtatacatagaaacccccacccccgtctctactaaaaatacaaaaattagccaggtgtggtgtcgggcacctgtaatcccagctactcgggaggctgaggcacgagaat

SEQ ID NO: 123816 - DNA, 552 bp, Homo sapiens
cctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttcttttaaaaaaaa

SEQ ID NO: 123817 - DNA, 190 bp, Homo sapiens
tctttccttgctgtctctgtctaccattccacccaagttaaagcgtttttctttcctttccaaatattgcaaattggacacataatgcttaaaagtaatattctagtaaaacaatttattaagacattcttacaggctgggtgcaatggctcctgcctgtaatctcagcactttgggaagccgaggcaaa

SEQ ID NO: 123818 - DNA, 206 bp, Homo sapiens
ggtgtccaagcaaggattactgacatacaaagaaacaggaacatgtgaccggtaatgaggagagtaaacaatgtaaatcaacccagaactcacccagatattagtattagcagaaaaggacattaaaacagttattataactatttcaaatgctcagacgttaactagagatgtgggaaatattaagaagacccaaattgaacttc

SEQ ID NO: 123819 - DNA, 618 bp, Homo sapiens
gtcacataacactcatgtggtgaatagtccagatttgcatgctaactttggtgcttatggtccctgaaacatatggattcctccgaggttctctctttattatccggttgtggttggagctggatcaacaatgcaacctggtttcagccagatagaagatggaggaattgctactctaggacaggagttcagcaagctttttctgtaaagggccagatggttaatatttaagtctttgtaggctacagggtctccattgcagctacttatctcaagcattatactgtgaaagtagtcatggacaagaaaataaataaacatggccatgttccagaaaaactcttttagtttgccaaccttgtggtgtttttttttattttatttatttatttatttatttattttatgagacagggtcttgctttgttacccaggttggagtatagtgatgcaatcatggcttactgcagcctcaacctcgcaggctcaggcagtcctcctgcctcagtctcccaagtagctgggaccgcaggtgggcaccaccacacctggttaatattaagttctgtttttgtggggatggggtctctctgtgttgccagggcggctaaaactccg

SEQ ID NO: 123820 - DNA, 160 bp, Homo sapiens
caatctttcctttctattcccacattaccccaaattatgcccctaattgcaaaaaatattaacactaagccagacaattaaaaagggtattttaacctcaaaattagaatctgaccccataccatacataataccaataaaaggcttggcagcacattct

SEQ ID NO: 123821 - DNA, 492 bp, Homo sapiens
cttacagtcttgcctggtaaaatgtacagaagcatgcatttttgaaacaagtaaaggaagaagacttaggcgctctccactccaaggccacctgcaccttgcctatgtagctttccccagcaacacgaagccagcattggtttcttaagttcccttcttgtctttatcatgtatgtacttagtatctgtattgtgctttgggctatttatttatatcagcatagcactttattgcatctttattgtaaataaccttcctgaacataggggcctccatgtctttgctgggtcctagctccatggtaggcactgatgggggctccaggattattgaagtaaatgagagccccttaaacctacaaggaaccttaatggtcatcagtggtctgaagggtcttcttgacctttcctgcctcccagcttcctcctgtctctgtcaggtcaagactctacctgcctggtaggttctgtacaaaccattgccaggcaatg

SEQ ID NO: 123822 - DNA, 141 bp, Homo sapiens
ctgtttgataataaaatggaacgaacgctgatagatgcaacaacatgaacgaatttcacaagtgttaagtggcaagacagacgcctgtaaagcatgtaaccacaaacaagcattaaatttctttttttttttttttttttt

SEQ ID NO: 123823 - DNA, 744 bp, Homo sapiens
gggtaagcagttctcctaggagtggcaatgttagagatatacttagaatttatagagattactatggctcctacaaaggagaataaggaagtagaaattttccactgccattctgtcctcatttccaattagttattgtaggattgagggaaagcccaaggcctttcttattaggaaatgagcatcctatacaccttttctccttgggtctgtttcctgcaggagacagacagtcctagtctcagtagagcaaacctcagatattcctgtagggttctaggagccttggaatagacaggactttttcttctactctgcagattggttttcaaggataggaatccaagctacccacaaattctctaacattgttgattactttgtaaacttagtttaggaataatttacaaataactcagccaagatttgttgaaagctatttttagttataggatctataactaaaagctacaaatttagttatagatcctataactaatattcaaaataggcaaatctgtagacacagaaagctatttttagttataggatctataactaaaattatagatcctatgtaaagttataggatcttgggttccctatttttagttataggatcatgcagacttctgtgttcctaacccagtaagaaaagcatcctagccactttggaaaatagtctggcagttcctccaaaagttaaaatagagttaccatatgacccagaaattcctgaaatga

SEQ ID NO: 123824 - DNA, 416 bp, Homo sapiens
tccgggggcaccccagggttagaggtaaatggcataggcattgaaatctccaactgctctgactccaggttggtgcacttcaatgccaagtactaaccaaacaataacaggatgccaccaaaaccttggtatggggctgctgcatcctaattaaaaaaaagtaatagatgttattttttagaacagttctaggtttacagaaaaatggagtagatagtacagagagttctcctaggctcccctgtcctccagcacacaatttcccctattagtatgttgtattagtgtggtccattcgttacaattgatgaaccactgttgatacatcattatcaactaaagtccatagtttacattagagttcattctttgagtttcacagattatgggttttggcaattacgtaatgtcctaaa

SEQ ID NO: 123825 - DNA, 206 bp, Homo sapiens
atacagcaacaagagaaaaattatttttgctatcagtttttcctataagtcaacttttggtctactttcgcaatattggaggttccaacaataaaacaaaagcaataaggtacagtaaggacgagttttattctactcagtttgcatgaagttaaatgactgatgacagggccaggcacggcagcttgtgcctattaattccagca

SEQ ID NO: 123826 - DNA, 122 bp, Homo sapiens
ttatacctaactggggaaaaaagattggaaataaataaataaaatcaccattatttgtaaatgagcctggaggtgacttcccagacaactgtccaattctgtggttaccaaacaaaaggggt

SEQ ID NO: 123827 - DNA, 417 bp, Homo sapiens
agttcattgtgtactgaattccctccaaacctatccaggcagaagccatcttctggtgaataatagcagaaaatgccatctgtttcccttctattcattataaatccttaatgccaccttaggcatgagactagtgcctgtgaataagtaaactgtgtgtttgtaatactctgtttttagttctttcattaattgaggaaaaggtataagcatttcacattctgaattcatatgtttattacttagtaccgtgaccataattaaggaaaggccctgtctctacctctaaagactgtgcttttaacttgggaacttcagggaatacaatgaagagctgggttctggcagctgtacgccaagtgtgtgagtgtgcacatgtgcatatgtgccagcttttgtaagtgattgttccccgct

SEQ ID NO: 123828 - DNA, 159 bp, Homo sapiens
tcggcccgtatccctgaagtcccaactctaaagactgtgcttttaacttgggaacttcagggaatacaatgaagagctgggttctggcagctgtacgccaagtgtgtgagtgtgcacatgtgcatatgtgccagcttttgtaagtgattgttccccgct

SEQ ID NO: 123829 - DNA, 291 bp, Homo sapiens
aatccttcttatatggtgctgacaaaatcaggctggacctacatttttacatcatagatttccagccattattatcatatccacatctttagtaagtacctatctgtgtagttttctgtgataaatgaactaaactaaaactaaagcaaaaatgttgaaaaaaaaattccgggtgtatctctgagtgttgggattgtaagattttattttttttttctcattttaaatactttctaaattttctgcaaagagaaccatataatctacgcgggaatggaatgggggtaccga

SEQ ID NO: 123830 - DNA, 317 bp, Homo sapiens
tccctatcttgctcaaactgctctcttgcaaatatcctaaactcccatatccctttacttcgttaaactcacttggcaagatcccaatttttatttacccaactagccactttctctatgcacatacaggatcctgaattactggtggaaaagtcacatcacttgactgttgggaaccactacataaactcatgggtactaacctcaacagggccctcaacctattctggaaaccttacatttctccaggcaaacttcctctcccagtcttcagagctattctttcaaacggttctctttccttcagcttccaaccc

SEQ ID NO: 123831 - DNA, 207 bp, Homo sapiens
ctctcctattgttggagttttagttccttcctcctcagcaaatttttgttactgtgaacagtacatatatggacattctcttccatgtttccttgtgtgcatgtgcaagaatttcccttggatatagacctaagaatggaatcagtggcttatgagatattcctaaacttgtttactctatctttccattttaacaggaaagttctt

SEQ ID NO: 123832 - DNA, 250 bp, Homo sapiens
tctggcttgcgattcttttgctaggtaagaataaagttagggaaaggcataaattagctgtgtttgtaagaatgaaaaacatgctgaatgtggagaagatggaatgtcattaggatgagaaggaaaggcagcatgttagtcatgaaacttatatatgatatgtttatgtttattatgcacataataactgtattcaaaaagacttccaggggtttgacattcctacttgatcttggtggataactctgta

SEQ ID NO: 123833 - DNA, 141 bp, Homo sapiens
tgctgggattatagacgtgagccactacacctggtcactacctaggaatttttgatttgcagttgacttgctgtgggttacgcttaggaattttgattctgctgtttctctttgtattttgcagtcagttcccttcctccc

SEQ ID NO: 123834 - DNA, 254 bp, Homo sapiens
tgtcatcataaaacctctacatcctcctcagcctcttctcggatgtccctccactctctcactctgctagaagtcggggtctcccctgaagatgctgtttctcctgcagctctctcaaggggtgtctgtttttgtctcccacaccctgccttctctgaggacctgcagctgacagagctcttctccctacttttccagaatattcctcccctctccttccgtaacaacccagcctctccaagagcatgcttagg

SEQ ID NO: 123835 - DNA, 223 bp, Homo sapiens
tgctgggattacaggcatgaaccaccgcacctggcctcttgtatggaattcttaaggtgcacctttttcctctttttctcttccacctcaagctaagacaaagaccaggaaatatatcttctgtgatcaatattttggtttgtttatttttttaaacctttatctactacagatttcaccccattaggaaaaaagacataactgaattgaacccatgggacaa

SEQ ID NO: 123836 - DNA, 477 bp, Homo sapiens
atgcctgctggagtcctgggttcactctgatatggagtctgtgtccaaacctggaccaggcactgtggctgggtgcatttggtgcccttattggccaagcctgggttacagggcacagagatggcagctggggagagatggttccccaaagacctgttgttaatgataaagatgtcttgtattgagctgggcatggtgatgcacgcctgtagtccccactgcttaggaagctgaggtggaaggattgcttgaacccaagagttcaagtacagcctgggcaacataaaaaaaaagtgataggccaggcgcagcagctcacgtctgtaattccagcactttaggaggccgaggtggacagatcacctgaggtcaggagttcaagatcagcctggtcaccatggtgaaagcctgtctctgataaagatacaaaaattagctgggcgtggtgatgtgcgcctgtagttccagctactcagg

SEQ ID NO: 123837 - DNA, 649 bp, Homo sapiens
cagcatccagtgtgcagcctccacaggtggaggaagaactaaaatccttttatttcatagctcggaggtgggtaccatggggcaagttctcaggtctgcttgcccactgcctggaaacagactcagtgctgttggtggggggcacagtgtgagtgagaccggccctttggattgtgtggaagctgggtaaggcctgtgattgctggctttcccccacttccctgacaacctgcgtgactcagcagaggcagccataattctcctaagtacacaactccattgacctgggaacctcacccctatcccccacagcagctgcaccaaggcccacccaaggaaagtctgagctcagacacaccaaaccctgcccctacctgatggtccttccctatccaccctggtagttgaagacaaagggcatactctcttgggagttctaggccccccgcccaccgtctgatcctccctatactaccacagctgatgctctctggaaagcgccacctcctggcaggacaaccagcacaaaaataaagcattaaaccatcaaagctaagaaccctcacagagtccatttcacccactgccacctccactggaataggtgctggtatccatggctgagagacccacagacggttcacatcac

SEQ ID NO: 123838 - DNA, 257 bp, Homo sapiens
gccacccaaaaccactagcactttctggaacatggcaggccttctttggctttctgctgtgtacttctgttccttccaccctagccccacccatcctctccccatccaagagcaaacagctctgaacagtctggagtagctggagacactcctcatcttggcactctccttgccacttgccatctagcagagctggatgcttcccttgagcgctctctgctcctcccccaggtatctaggctgcctcccatctcccc

SEQ ID NO: 123839 - DNA, 504 bp, Homo sapiens
tgtttcatcaagactgctggtggcctctgcctaaacctccagttgggccagtggaccaagccctccacaacctgcccctctacctttgggagcctttaaacctttcctcttaagctccctgcagaaccattccctctgtcccttcaatgtaggaggagacctcagctaacatctaacccagagctcactctgatgcagacccctgcacgccaggaccggcacatagcttgtgggcctcaaatgataatgcaagcccttgtttcaaaattattaagaatttaaaggtgttgacagcagagagtgaaaccccaggctaagataccagccccaaggagctggtcctgccgtctgctcccactacccacctcggccatggccctgaggtggcagctatttcctgggctgtgtttctaatagtaatgcattgcagcaagagagcacataatcttctcctcaaagcatgttctgcttctcaaaagcaaataaatatgtattaaatcaata

SEQ ID NO: 123840 - DNA, 563 bp, Homo sapiens
gaagaaagaagagcaagcagtggcgggggcagcagagggcagagaaacagatgagtgcagctttaccaatgccaaggttggcaggggcacaacagtatgtcagatgctgcagaatgggtggtctgggggaatgagacccgagagggctccactgaatttgatgattattgagccttaggggcactgcagacactcattttcttttcttttcttttttttttttttgagacggagtctcgtgctgtcgcccaggccggagtacagtggtgcgatctcagctcactgcaacctccacctcccgggttcaagcgattcttctgcctcagcctcccgagtagctgggattataggcacacaccactgcacctggctaattttttgtatttctagtaaagacggggtttcaccatgttggccaggctggtattgaactcttgacttcaggtaatccgcctgcctcggcctcccaagtgctaggattataggcatgagccaccacgcccggcccagacacttattttcaaagttgcagaaggggtcaaagccaaaatgcgtggaagaaa

SEQ ID NO: 123841 - DNA, 341 bp, Homo sapiens
  misc_feature (14)..(14): n is a, c, g, or t
  misc_feature (17)..(17): n is a, c, g, or t
actactaaattcgnggncgcgtcgacagaggcgggaagagatgcaggaaggcgggagagataagcgaggcaagaaagttggacagagaagaagacggcaaggcaggaagagggagacagagaccccaaggccaccaagagacacgcgcacataaaggatggggaaacaattgagattgagggaggcaggcagagcggagcgaaaacaggaggacagaaatagcgaagcaaggccaagatcgggacccccaccagggaggtgcccagtacaggcatgaaagtaaggcggggaaagcaagagtggaaaggaacgtcgacgcggccgcgaatttagtagtagta

SEQ ID NO: 123842 - DNA, 758 bp, Homo sapiens
tcccacctctgccccacctgtagccacatgaaaagagtggttctggaagtccctggtgtaactttggtgtagcacatgggctgtgggctctgtgtgcacactcgagacccagcgcaagtcaccactgccatggagtcacctgtggacccaggggctgggctagtcagagcagtagatgggatgaggatctgggggccttgagtggaggggcagctctcagtgagaagagggtgcctttggctgcatctgcccctggaagggagccaggaaccaacccctctacagtggagatgctgatgggtggcctcgtcctggagaaggggccaggatggaaaggacggacctccaggaacagccagcgccctggcttcctgacaggcagctcccaggtggggagaagggcttgtttgacacaggtgtgaggtttgcagatacagggtgatgaggtggggccagtattcagaatgcagaacctgaccctccaccatcacggaccatccgtttgtgagcagcacatgcagctgtggggccgtgttggagcacagggtgggtgtgagtgagcgtgtgagactgtgcgtgagtgtgagtgtgagaatgagtgtgagactgtgtgaggctgtctgtgagtgtacaagactgagactgaatgtgagtgtgacaatgtgtgtatcatgaaaaacactgtgagagactgcacgtgtgtgagtgccagtgagtatagtgtaagtatatgagaaagtgtgagagcatgagtgtgt

SEQ ID NO: 123843 - DNA, 559 bp, Homo sapiens
  misc_feature (417)..(417): n is a, c, g, or t
  misc_feature (517)..(517): n is a, c, g, or t
atgggggtagaactgtttcagcaagattttgtgagaatcactgcacaacgggctgcaacatgacaggcttgcaacaccctaagcgctttgagtagaggctgcatgagtgtggaggagagactcagcctcccccaggaaggtgacaatagagaagtgccttgaaggaggtttgggagacagagaaatccagtaagaacatgccatgaggagagcacagcacatgctaagtcaagggcttccaacagggctcatgagtgccaacgattcactgccccaacaccagaggtacaagggttgcctcagattcaagtccatctaatccattcaccatttgcctatcagaactatttagtaaaataaaatctgatcatgtgcctgtttctccagtccctgcttaaaagccttgaaggaggtttngggagacagagaaatccagttaaggaacatgccatgagggagagcacagcacatgctaagttcaaggggctttcaacagggctcattgagtgcccaacgntttcactgccccaacaccagaggtaccaagggtttgcttttt

SEQ ID NO: 123844 - DNA, 537 bp, Homo sapiens
ttttattatttattttctgtagagatgaggtctctctatgttgctcaggctggtgtcgaatcctggcctcaagcaatcctcctgacttggcttcacaaagcgatgggattacaggcatgcaccaccacacctggccttagagtgatttttcttaagtgcaaattcgtgctcttttttctaaggcctcagcttggaatgtcctcttgtattacccacctctcttctttcaggactcatctcttaggaaccttccctgtccaaggcagctgagtacccttcagtatactcatcctaccctctccctctcctgttgtggcagttagtaccatgttttgtaactacctgtttatttgggtctccccaactagactgaaaaaggcgcttgaaggcagggctgtttccgtccttgtgtcctgagtgctgagcacaatactgagtacagtttgtgacctatagaatttgtggagggaaggcattttggatggaggctgttggttaagtgacctgcaaaactgctccagtatcatgccaggatca

SEQ ID NO: 123845 - DNA, 419 bp, Homo sapiens
agtcataatgggttaagggcccaacctactccagtatgacttcattgtaatttacatcttaattaaatctacaaagactccatttccaaatagggccacaatcagaggtaccaggggttaagatttcaacagatcttctggtgagaaaaattaaatctataacacacaaatggtagtcaagatatggaattaacctgtgcatccatcaatggatgaatgaatggacaaagaaaatgtgtgtatgtatacacattgtatacatacacaacagaatattattcaaccttaaaaagaaggaaatggccgggcacgatggctcacgcttgtaaacccaacactttgggaggccatggtgggtggactgcttatgcccaggagttcaagaccaactgggcaacatggcaaaacctcaactctac

SEQ ID NO: 123846 - DNA, 267 bp, Homo sapiens
tctaagggtttcacaggtttagctcttacatttaggtctttgacccttttaattttgtatatgacataaggcaggggatctaacttcattctttcgcatgtggacatcaaatggtcccaataccatttgttgaaaagactactactgtttccaccaatgaatggtcttggtacccactgaaaatcaattgatcataataagcatgagggtttatttctgaactctcaacaatattccattgatcaatatgtctatcctcaggccagc

SEQ ID NO: 123847 - DNA, 831 bp, Homo sapiens
gtaaggagcagttttctttgattggtatattcaggtttctaaccagctgaaaaattcaaatacatgtcctttaaggattaagtttaaaccacactacagaaaggagagaaaagacttatatgatcatatgtaagcaatggaatcagcaatatgagcacttttcacaactatacaaatcaaatttaataatctccagaacattaaggaagttcagcccttaatgaaaatgaatgaaaagaaattattcgcccactgtcatatgccctggaaagagaatgtcctgccggactcaaaagggtatcacaatattactcagattttcagcaacgaaggccctctgaggatttaatgatgttaatattttcagtttatttccttcactgataaacattgttaatagataccattgcctctgttttcaccttaagtgatgttacttagcacaattcgtttctttagaatgccccctagtttggtggaaggaattttcttgctttattaatataggatattttctcatgaagcaaactggcatactctttcagtgaagtgaatagacaaattaggtctctaaaattttaaaggagtcactgccccaattatcttaggaacaataataatcacttatataaaattaaaataagaaaattaagccaggtatggtggctcatatctgcaatcccagcactttaggaggctgaggagggaggatcaattgaggttaggagttggataccagcctggcaatatagtgaaacccctgtctctacaaatttttaagtattagctaattttttaaagttggccaggcatgataatgcatgactgtaa

SEQ ID NO: 123848 - DNA, 272 bp, Homo sapiens
ggagggacaaaggctgagaaggggctgctgatcgggcagctcctgggataggacatgggtgttaagtcaaatctatcctaaaatgcctatctgatgccagtggtgctaacatcctaattttgtacatcttcaagttttcgattctatggtgcacagcactgtgtcctcgtgggaggcaggaacagccctcccactctatatagcaaacagcccattcccaaatccctagtggcacagatgacttgagagagagattatgcctgcctgggcta

SEQ ID NO: 123849 - DNA, 300 bp, Homo sapiens
atatccagagcagtttttctcaggtatggcatgtagaacaccaacaacagaatcttggtgagcaactgacttgcttatgtagtggactcgtggccctcattgaggtttatgcttaattattttatcctgataaacaaatagaaatatcctcatgattcttactctaacacacacaagtgatgcttactcattaggctttactagtggagacagtactacctgaaataaagtagtacctaaagtattccagttacttgagataaaaaaagcagaaagcattatattttttctggaccatct

SEQ ID NO: 123850 - DNA, 186 bp, Homo sapiens
tggaggtaagcctatggacaacactggaaatgtgcttgggtgtatcaattcctccacaccaactgtcagctggtctgcaggagggaaggcattaccacccaggaggagtattcacagaaagaataaacacaaataaaggaagtaagacaaaacaggcatgaaatcggagatgaaagaatgctgaca

SEQ ID NO: 123851 - DNA, 134 bp, Homo sapiens
tttcacagggtaatcggtgtcatgatcccagcctcacctaccttctgtgtgaccctgggcaaggtatttctctcctctcggactcaattacctcctcttaatattgctaatttggtaagtaaagtaaagatgat

SEQ ID NO: 123852 - DNA, 366 bp, Homo sapiens
gcagacccgagattggatttcctcttctgactttgcaagtgtggctttgctttaataatagccctcctctttttctgtattcctcttttctccttccagtgtggcaaatatgcatcaatcaaaatacaataacctgtggaaccattttttctaaaataggaaggtggtgccatgggctattgattgttgagggtagtctttagagcctgtcttataaatctataataattccccccaaattaatgtgctagttagaaccctagaattgcagcactgaaagtgaattttagaatcttttccaactttttaccaagctcagaaagcccttttattggacctttgtttgcctcatggtcatctggtttc

SEQ ID NO: 123853 - DNA, 411 bp, Homo sapiens
tcaatataaatatgctcagtagtggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagcattcgtaatctaacacagtattgttgccacgagtacgagtatgtgatagactgttgagaataaagaaagcaggcacagttggtcagtcctaagataaaggagatgtttttcttatatgtttgtgcattaaagaaaaaaaaatcttgaatctgaccaa

SEQ ID NO: 123854 - DNA, 550 bp, Homo sapiens
tagggtctctccacatggacgtgcatgaaactggagtcctcgcgcccaccagcccagagtgctctctagaggaaggttacagacccttcctggctcactcatccagacgttagctgtcttgctgaaactccttttttcacccttgaaaaccactggaagaatggccaagaacccagctatcctgagtaagttcacttaaagaagcaaaatctaacatgagtagcaaaatggacattggcaccaggagtgtgggtcagagtcctgccccttggaactacatcatcgcttgtacagtgtaccccccaggcaccaagagaccaggctgagacccttcagttgccctgggcctctggtcagtgtcttccagcctggcacacaggcaggccctcataaaacaatgagtgctgaaagttccagccttcttggtgggttctcagcaccccgtcgtgagccacaccctgccccagggaaatcagggtcgccctgctgctacccctaggccagtgccccttctgaagtgccccaggctggcacccctatacttagatct

SEQ ID NO: 123855 - DNA, 426 bp, Homo sapiens
gttctaattatttatgcataattagctctcgtctgtgcgtttttcccttagtatctagaactggactcttcacacaaggaactgtacaacttgtcaagtctaagcatggttatggatataatgaacttggaccatccttaaatgtcatttcgttggtatttgaacaaacaaaaataattgtatgacgggctgccggaggagggaggcaactttaaacttgggaaaatataagtttgacatggagagatttttaataatgtgtttagctcatttgatattgagtaaaatagtcctgtgaacatttgcaatttaacctgttttgtattaagtagagttgcttacataaaggtgcaggataatttttatctactctttgctataactctttgggggtgctatttttatctgctgcataattaaactggt

SEQ ID NO: 123856 - DNA, 797 bp, Homo sapiens
gattataggtgtgagccaccacatctggccagttttacctgttttaaaactttatgtaaatataataatgcgatatgtattttttcatttttttcagcattacctgtaactgcatgtattcatagttcatcagttttggcttcatagcactgtagaaatataacatgagccatatatgtaattttatactttcattaaaaataaaaagataattttttttttttaagacagagttttgctctttttgcccaggctggagtgcaatggcacggtctcggcttactgcaacctccacctcctgggttcaagtgattctcctgcctcagcctcccaatagctgggattacaggcgcatgccaccacgtctggctaatttttgtatttttagtagagatggggtttcaccatgttggccaggctggtcttgaacccctgacctcaagtgatccacccgccttggcctcccaaagtgctgggattacagacatgagccaccgtgcccagccggactagatacatttcaagtgtatgatagacccaagtggctagtggctgccacattggacagtatagctatggagtattccattgtatggatatattacagttacccattccactgtaggtaattggtacaatcactttggaaaacagtttgatactgtctagtgaagttgaagatataaaaatatgtgatccagaaattctcctggttatataccctagaaaaataagtactgttccgtaccagaatacacattcaaggatgtttatagttaaactgtttacaatacccc

SEQ ID NO: 123857 - DNA, 508 bp, Homo sapiens
cagaaaaatcaccaagtagccaaaaataacacaactgttaattccaagaaaaagagaaagttgcaagaaaggaaatttaactatagtacactacatagctcagctgtgaatagtatccatgaagtcgaaagaaccgcccatgagcggtgcagatgggaacgtagcatgaggcatgggggcaatctacggagccacacttcatctcccatgacaggaagcatgggggccatccaccgagccacacttcatctcccacgacaggaagcatgggggccatcctccgagccacacttcatctcccacgacaggaagcatgggggccatcctctgagccatacttcatctcccacgacaggaagcatgggggccatcctccgagccacacttcatctcccacgacaggaagcatgggggccatccaccgagccacacttcatctcccacaacaggaagcatgggggccatccaccgagccacactttatctcccacaacaggaagtcagtgtg

SEQ ID NO: 123858 - DNA, 426 bp, Homo sapiens
ggccatgtggctcctacattctgttaacagttcctccttgtcatcacccagccctaagcacatacagtacacagtttatggactatctgggatgatgtatttagatcagattgaagagatttcttctgtgttttacctttgtttgtcaagtttgggggtctattcaaagctcccgtatgaaaaattgaaattcaaagtaaatacttaccaatggaccgttagtgccaattgctgtagagtttgaaacactaatataacgactatttggtctatcggagtccacagttccctcccgcttgcctctcctcctgccttccagactgctccagcacaggctttttcagattcctttttatgtcccagcgcctcagcattctccaagtttctagttttgtctttctcttcttttctatgtgccctctagtc

SEQ ID NO: 123859 - DNA, 411 bp, Homo sapiens
tgggttggaggcaaagacactgattatctcttgggggtggcagtcccaccctcaagccagggagaccctttcttcttcttttttttttttagacagagtctcactttgctgtccaggttggagtgcagtggcgcgatcttggctcactgcaacctccatagggaggccctttctgtcgccacctcccccttcccaattcccccaccccaagccagccagctgcaaaaaagtcccctgatggcctctggcatcaaatagaacttagttcttaatctcagcgacttggaaggctgaggcgggtggttgcttgaggccaggagttcaagacaagcctaggcacgaagcgagaccctgtctctaaaaacaagttttaaaattagccaggccaggcgtggtggctcacacctgtaa

SEQ ID NO: 123860 - DNA, 235 bp, Homo sapiens
tattctggacatttcatataagtggaattctgtgtgtgttctgttgtgactggctgctttactcagcatgtaatgtaatcagggtctattcatgttgaagtatgtatcaatacttccttcctttttactgctaaatgatattccatcacatggatattgcacattttatttagtggtttatcgattgatggacccttacgttgctgccccttttgtctgtcacgaatgacgctac

SEQ ID NO: 123861 - DNA, 213 bp, Homo sapiens
ctcaggccagtttttataattttggttttcatccaaactagtcacatttcatacttttaaagtttttaggcttttctgctggagatcatcttcctcacactgtgattcttaaaggttatgtattttttttaccctgatcatacttacgtcttttgacaagagagaagacggacatccagctttgggtctgcagtgatccatcattcaacttcc

SEQ ID NO: 123862 - DNA, 799 bp, Homo sapiens
atataagaaactctgtgtgctggagctaaaccaaagttgatatgtgaaggaaatccttatgtattaggaatccgtgatacagacagtgctcaggaatttcagaaacagcttactaaagctaaaagaataatgatcttagggaacggtggtatcgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcatataaaagaaccagatatacaactgaaggaaggaaaaaggaagctagaagcaaatctaaatcagataatgtaggcagtgcgttgggaccagattggcatgaaggcttgaatcttaaaggaacaaaagagttttctcataagattcaccttgaagctatgtgtgaagtaaagaaaatctaccttcaggatgagtttagaattttgaagaaaaagtccttcacttttccaagagaccatacgtcagttacaactaatacagagatgtggcctgtctatgtggaattgaccaatgaaaagatatatggctgcgatttcattgtcagtgctacaggagttacaccgaatatagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatga

SEQ ID NO: 123863 - DNA, 370 bp, Homo sapiens
ggcatgagaattgcttgaagcgggaggtggaggtttcagtgagccaagatcatgccactgcactccagcctgggctacagagcgaaactccatcacaaaataataataataaaagaaaggtgttagatctatttcggaggtagaatagaacaatctagataactggttagagtgggaaaggagaaaaagagaccgactggccgggcacggtggctcagacctgtaatcccagcactctgggaggctgaggcaggcagattacctagggtcaggagttcgagagcagcctggccaacatggcgaaatcccatctctattaaaaatacaaaaattagctgggcgtggtggtgtgcgcctatgatcccagcta

SEQ ID NO: 123864 - DNA, 4060 bp, Homo sapiens
gattccgggaggcaagtgaggagagaagatgctgtagcgtcctcaccggctgccagcagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctacggcagatggaagagaaaaacagacagttacaagaacgtcttgagctagctgaagaaaagttgcagcagaccatgagaaaggctgaaaccttgcctgaagtagaggctgaactggctcagagaattgcagccctaaccaaggctgaagagacacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggaaagcttagcagaagaaattgaaaagctgagatctgaacttgaccaattgaaaatgagaactggctctttaattgaacccacaataccaagaactcatctagacacctcagctgagttgcggtactcagtgggatccctagtggacagccagtctgattacagaacaactaaagtaataagaagaccaaggagaggccgcatgggtgtgcgaagagatgagccaaaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggctaattcaggaagaaaaagaatctacagagttgcgtgctgaagaaattgaaaatagagtggctagtgtgagcctcgaaggcctgaatttggcaatggtccacccaggtacctccattactgcctctgttacagcttcatcgctggccagttcatctccccccagtggacactcaactccaaagctcacccctcgaagccctgccagggaaatggatcggatgggagtcatgacactgccaagtgatctgaggaaacatcggagaaagattgcagttgtggaagaagatggtcgagaggacaaagcaacaattaaatgtgaaacttctcctcctcctacccctagagccctcagaatgactcacactctcccttcttcctaccacaatgatgctcgaagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgaggctttatggagactgaagctgcagctcaggagtccctggggttaggcaaactcggaactcaagctgagaaggatcgaagactaaagaaaaagcatgaacttcttgaagaagctcggagaaagggattaccttttgcccagtgggatgggccaactgtggtcgcatggctagagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactccttcaggcaacgtttgggtgactcatgaagaaatggaaaatcttgcagctccagcaaaaacgaaagaatctgaggaaggaagctgggcccagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcgaacaagtttacaatatggaattatgtgcttaaagaggttgaattatgacagaaaagaactagaaagaagacgggaagcaagccaacatgaaataaaagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaaggcagattcttgaaagagaatacaataacctcttggccctgggaactgaaaggcgactggatgaaagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatgttgcttcatcaagactgcagaggttagacaactccactgttcgcacatactcatgttgaccagccactcaaaggaggcagcactgacctgctatggcgtcttttcagtctactctacctaaagtgcactaccatctaagaagacgagcagtgaaaacctttgtgaaaactgaattc

SEQ ID NO: 123865 - DNA, 376 bp, Homo sapiens
tgactacccctcaggcaaagtttcttgggacagtacctctgttgtgctagagtagaaccctcccttcggtctgagggactcaggaaagcctccccagaggagatggtgcctagactgagtttcaaaggatgaattacattcacccacaaggatatcgaatccctaacaggagggctggctggttctaagggggctgatccaccgtgcttgcccatagaattcaacttacatcagaaaagtagatctactaccttcaaaatacttccctcaactgttcactgattcctggaagaattctacagttagagattagttggtttcaaaggatttgtctcttgttcaaagcaaaataaaatatctgtcttctgctaagtac

SEQ ID NO: 123866 - DNA, 352 bp, Homo sapiens
tactactactaaattcgcggccgcgtcgacctccaatactgaaggatttggctgcaaatgtaatttattaacttgttgccctaagaagcagtgcatagtgttgactatggctaatcacaaaactttctccacctgctaaggtagactcactgtgtttttttttttttaataaaaaaaaaagaacaagtttacaatatggaattatgtgcttaaagaggttgaattatgacagaaaagaactagaaagaagacgggaagcaagccaacatgaaataaaaggtaatatatctttctttcatatgaaatgcctttattctggggtttttagctttcacttttactaacctaaaat

SEQ ID NO: 123867 - DNA, 1815 bp, Homo sapiens
gattccgggaggcaagtgaggagagaagatgctgtagcgtcctcaccggctgccagcagggaaatggtccaggagtgctgggtgtgagcctcccttctcctcaagccggagactgcggttgtcattgatcaattgaagaagcaaggacccgaaatcacagacattagcaatgatgtgtgaagtgatgcccacgattaatgaggacaccccaatgagccaaagggggtcccaaagcagtggctcggactcagactcccattttgagcagctgatggtgaatatgctagatgaaagggatcgtcttctagacacccttcgggagacccaggaaagcctctcacttgcccagcaaagacttcaggatgtcatctatgaccgagactcactccagagacagctcaattcagccctgccacaggatatcgaatccctaacaggagggctggctggttctaagggggctgatccaccggaatttgctgcactgacaaaagaattaaatgcctgcagggaacaacttctagaaaaggaagaagaaatctctgaacttaaagctgaaagaaacaacacaagactattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtaagggagcgactgagggtttctttagaaagagtctctgcactggaagaagaactagctgctgctaatcaggagattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggccatggcacaaaaggaagatatggaagaaagaattacaacccttgaaaagcgttacctcagtgctcagagagaatctacctccatacatgacatgaatgataaactagaaaatgagttagcaaataaagaagctatcctacggcagatggaagagaaaaacagacagttacaagaacgtcttgagctagctgaagaaaagttgcagcagaccatgagaaaggctgaaaccttgcctgaagtagaggctgaactggctcagagaattgcagccctaaccaaggctgaagagacacatggaaatattgaagaacgtatgagacatttagagggtcaacttgaagagaagaatcaagaacttcaaagagctaggcaaagagagaaaatgaatgaggagcataacaagagattatcggatacggttgatagacttctgactgaatccaatgaacgcctacaactacacttaaaggaaagaatggctgctctagaagaaaagaatgttttaattcaagaatcagaaactttcagaaagaatcttgaagaatctttacatgataaggtataatggaaacttatgttttgggcccattttctatttttattttctattccactgatgaatgttttgttgtaaaataaatttgaaaaaataattttagt

SEQ ID NO: 123868 - DNA, 706 bp, Homo sapiens
tgcactaaactgttcctcttggtaccatggaaaagctccaagcacccaagacatggaggcagccatggcttctttctctgccagaccacgtagcactggctggttctgtatttgagaatgtagaggtcaaggcagatgtcggtaagtttgaccaaatatcttttctctttttgactctccctttctgctaacatgtggatcagctcctgccctcataccgcagacacacccactctgaacacacccctccagagcttgcccacaccttcccaactagactctgtgtgtgtattcaggaaaaatgaaaataaatttttaaaaattgggagtggaatgggcagattagggggaacaaagtcattttggtcatggaacatccatttgcttaaccaaggagacttgcttctatctgaggaatttcccacttagtagaaagaaacactcttccctgggaatgtttgtttctgtctctctcaatgctactctctttcatattctcatttgctcaccctttcacttagagccaccgttttctcatcccattctatgaacttatttccaaattctcctaactattcctgagttttgaagtatttgttttgtaccctctctgcttccggttttttgtttggttggcttttttggagatagggtcttgtggatgttgcccacactggtctcgagccccggggctcaagtgatcctc

SEQ ID NO: 123869 - DNA, 186 bp, Homo sapiens
gtcagtaatgagcccttttcagacaagtgcttcaaagggccaataaaataaacactaaatatcagtctttattagatatcaatattcaaagacataaattttattaaaaatatagtcattcaggtctgttgaattaaaatctgtgtaaatttagaaacctcacaaaaagcaaatctatctttctac

SEQ ID NO: 123870 - DNA, 429 bp, Homo sapiens
gagctcggtaccgacgctctctctgtggggtttgaggaagcacaaactcacccactgctgataaattcattacaaaagatccactgagaaagtatggaaggtaggtgaagaatgtgcagacgctctctctgccgggtgatttagcacaaaaatacaattgatagtgaaggtataaagtgtaatcatcaggtaaacctctcctctctcatagcgtccctgcttcaggactgcaatggaaaaggaaattcttactgtgtagaatttcattaagatggctgggtagatgtttgtgtggcacccttgaactagccgttatgattttattctttgttgagttaattagaataaagtgattttcctcaaaaaacaaacaaacaaatatgtgcccttgtcagactgttccatcgtgatacccccacgataaaccat

SEQ ID NO: 123871 - DNA, 446 bp, Homo sapiens
tcttggagcccactttctgttcttgtcagccaattccctttcaggtgctcaggtttccctccctcctgtcaccgggcctttgcacatgctctacccaccctgcctagtggagagctatctttggcccctggacttcattcacttcggaccttctttgggtcacatttcagtcatgcctcactagacacctggaatctctgcctcactagacacactagcactcactcttttgggtcttctggctgtatgtaattgttatcagggcagtaattttgcatttatacaggtgctgaggtcagtgtctggcctttggctacttgccttgtgagccacctttgctttccagtgtacccctagctcctggcccagtgtccagcttcccagcatccattcatgttttccctggagaccattctgtgcccagcagccagagacatcattgcaac

SEQ ID NO: 123872 - DNA, 407 bp, Homo sapiens
ttctaccctagtattggcttcagtggcaggattccgctcctggccttctgctctggtaagctgtgcttcactgtattaccctgctctctaattctgggggcagtggtttgcccatgacatcaattgtctgatggatccaaaaagaattgttgattttccgtttgttcagttttttttcttgtgaggatgagagtgacgacttctgggctcctttcatgccaaactaaactggttcaggagttgggcagagacatcctgagtttttatacccagggttctttttaagggttttaagggttccacttatctgttatctttcctttcagttcctcctcttgtacaccttatcttctggtggccctggttcctctggccaggaagaggactgatttttgtcttaaatcaga

SEQ ID NO: 123873 - DNA, 429 bp, Homo sapiens
tggtagctttgagccaccatggaagaactctgatgactctaaattggccaagttagagagattacatgcaggctctctgggacgtggtccccgtcaggtccagccttctagttgtctctgcgactctgccaaagtgccagacaatgaacggagctgttgtggattccctcgacttgcccagctgtcagttggacatctcagtcaacaccacatggaacagaagagttgcgcagctgagccctgtccaagtttctgacccacagaatgtgagataaagaaaacggtggtggccaggcgtggtggctcatgcctgtaattccagctctcagggaggcagaggcaggaggatagcttgagcccaggagttcgagatctgcctgggcaatatagcgagacctcgttctccacaaaaaggaaaaaaaaaagacc

SEQ ID NO: 123874 - DNA, 759 bp, Homo sapiens
gtgctaaatctacctttttcattttccttctttctctgtgttacctgaccagagggtcttgaaattagcaataattactctccactgatagggaatacatttacatctgatataagatgtaaatacaatacatccgatataagattgataggttatcaagtaattgtgttgatcataataccttattttattgctcagtatattagggtatatattgggcttttgtatcaaagagtctccccaaatctagttgttcaaataaggtgaaagtttctttctctcttacaaaacccaccaaagagttttctagagaagaagtgtagctcaattgccataattaagcttaccagataaaatacaggatgatgcccagttacatttgcaaataaataattcttttttttagcataactatatcccatatatcccatataatatttgtgactagtacaagtgtgtctcatgcaatatttgtggttggtataaccatgtcctatgtgatatttgagacatactttatcctaaaaaatagttgtttatctgcaattcaaatttaactgagtgtcatttatatttacttgttaaatctggcaaccctagttataaggccatccatgtttccaggtttattcacatggttagagttagaccaccaccactatgtcctcacctcaactcgggagaagagggaagacgaggcaagcaaattccatttaaagatgagacatgggccaggcgtggaggctcactccgtaatcc

SEQ ID NO: 123875 - DNA, 320 bp, Homo sapiens
cacaaaacactgacagtagccagagctgttatgagcaaaaagaaccaaactggaagaatcacattacctgacttcctttagcatttcttgtagaacacgtctggtgtggataaaatcactcagcttttgtttgtctgggaaagttgttatttctctctcctttgtgtttgaagaatattttcaccagatatagtattctagggtaaaaggatttttaccatcaacactttaaatatatcatgccactctcccctggcctgcaaggtttcaactgaaaagtgtcctgccagaagtattggagctccatcgtatattatttg

SEQ ID NO: 123876 - DNA, 534 bp, Homo sapiens
catatagaattgtaccaaacaaggtaacatacctaaaacacttagcaccagcataaaatgctcaataaacatgaatgattattatgtcgcacttttgtttctttacagtgactgaagagcatcttgcctaggtgacagacctgaatgtgatttccagctccttctagttaggcgggcctaggttagttactgaacctcagtttcctcattcccagcaagaatgacgacacatataacgcatattcagtatctaatgcagtatccggcacccagtgactgctcagtacataggaggccagctccccttcccatagcttctacttttcccctcaaagttaccggttctgggcaggtagttggcctgcaacttggcaaattgggtggaaacagaccccggggtgagaatttccccaatttgcattcgcatccatctcccaatgctccagcctctactaggacgtctcgcagggactgtggcctcctagggagccgggtcagttcaactgctccaatagtttaaatgcgtgaccagcc

SEQ ID NO: 123877 - DNA, 881 bp, Homo sapiens
gatcgaaatttttattgcagcaaaatggacataacataaaacttaccgtcttcaccatttttaagtgcccagtttagcaacattagatatattcacgctgtgtagtcgtcaccaccatccatctccagatgtccttgtcttcccaaactgcaacttggtacccatgaaacaattactcctattccttcctccccaggctcctggtagccggcatcttacttagaatcacagagtatttatctttgtgcaactggcttttttcacttcgcgcaatatactgaatttatctttttgccactggcttttttcacttagcgtaatatactcttactcagcgtaattcacgcatgttgtagcgtgcgtcagaacttccttcctttttcaggctgtgcgttattccactgcttgcacgtactccgtgctgtttatccattcatccgtcaatgcacgtttgccttgcttccaccccttggctgttgtgaataaagctcttaggaacatgggtgtgcaaatatgtttgagtccctgccttccattcatttgggtatctatgcagaagtggaattgatggatgggacttgtgcttttcttcctgggcaaaccctcagtggagagaagcctgaagggttggttgcctgtgtcatcctctgggggcatagtccaggggtgaccgtgttccatcaaacctgtgtccatgactgtgggagccatggttttgatatcacatcctgccagggaatttgagtgcctctctgctggcttcccccagcccctagtaggcctctgcccaggggacacgggcatgggtggaagtggaggcagcggcagcattcacggagcccgttggccccttcggcgtgcactttatgaagagcgtgcct

SEQ ID NO: 123878 - DNA, 335 bp, Homo sapiens
ctggggtggggtgctcctggtgtgataatgattgtctgccttcagcccagagacagacacctctaattggaagattctgaggagggatggatctagaaggggtctgggtgagggggtggatactttggcctggcaagagaagaatagggttagaagggatcaagctactgcctccacataaggaatgggggaagatgagccagagtccagtgccctggggccacctcagatccagatgccttgagggactaagataggctgtctctccaccctgtacttatctccagacccactggacctggcccctgcctcctaagcctggacaactctgggct

SEQ ID NO: 123879 - DNA, 617 bp, Homo sapiens
gcaaaacaaacagattacaaaccagaaaaatatacttgaactttatgttatgtattaaggattaacttccctaatacaaaaagaactcctatgaaccaataaggaaaagaacaggaactctgtaagaaaatgattgaaagacataaacaatttgtataaaagaaaatagtggtgccgggcatggtggctcaagcctgtaatcccagcactttgggaggccgaggctgatctcgaactcctgacctcaggtgatcctcccacctcagtctcctttcaaagtgctgggattacaggtgtgagccgccacgcctggcccaagaacctgaatttctgacaggtaacaaataccattttctttttaaaaaagttattcctttttaatcttgttagactgaaatggcttgtctgtcaatatattttcaaagggtagtccattcttgtaaaggacataatgtgcctactgttcaatttttttttttgagatggagtctcactctgttgcccaggctggagtgcagtggtggtatctcagctcactgcaacctctgcctccattcaaacgattctcctgcctcagcctcccgagtagctgggattacaggcgtgtgtcaccatgc

SEQ ID NO: 123880 - DNA, 781 bp, Homo sapiens
gtggatgttcttttagataaattctctggaagcgatttgcaatttgagtcatattttctacatgccaggagcaccagctattttaaaacatttgtatgctcaagatcataatgagccaaacagatttccccgatgtcctgtttgttcaggctctatagaggaaggtgcttcttaaggtgaggcacacctgtattatgtccagtaccagaagtgtgcctggttcctcattcatcaccgaagaggccacttggtggcacccacagaaaattctgatacaacttgaaagcccttctagaaattttacacagatgaaattttacaaaggtattgttcactgagtttctttcacacttaatttctttgcatatgaaatagttatttaaagcatattttaataacttgcagtttaaagacaatctataaagaataaactttaaaggataaaatatgtctggttattgagaggtacataaaaggtgaaattacattttagcaattatctttttactcaagagttttttttttttttcctggtatctactaactagtattaaagatgttttgctaaacttattttaagtaattctgtattgttaagaaaccatagaacacaattcaccattaatggccaaagacagtttttgtttccttccgtctttgctgttttggttcaatactaaagctattttcaggtgaggaaacaagcttacataggaaagccacagagtaaatacaggggaaaacaaagactcacaccctcatctgtttcactttaaaacca

SEQ ID NO: 123881 - DNA, 158 bp, Homo sapiens
gcctgacagctcagcggcatttgttcctgttgacatgccacctttcaagacctctttcatcgacctatttctgcaacctccctcccttctgacctccaggttgctacatagaagtgtccatttgacatttccatggcattccacaggtaccatgacac

SEQ ID NO: 123882 - DNA, 160 bp, Homo sapiens
tttagcacttttgttcccgtatgaaaacatccacattaataatacttgcattaatggtttcttactagattgatccttggtgaagctaaaaaaaaaaagccttttcatttattatggtaggtacaaagactgtgcaaataaaaatttagtatcttcttta

SEQ ID NO: 123883 - DNA, 410 bp, Homo sapiens
ctagggggactgttaatggctttctgactttctgtattgttctctcagggattcgtaagtcctttggatagtgagagtagcctgggggcaaaagactgttttcttgtctaaatcagtcaaccaagatgtattcattgtttgaggatcaaataggtgctcagcatgatgctgcaagaggtacagagaggtccctgccctcatatggtttgcagtctagttggaaacacatttagagaatggtgtgtttcatgaaccatgtgatttagctgaaagagtctagggaaggaagaaatcattatggtttgggattttcagagcagatatcatatgttggtgctggaaggcagagaactgaccttgaactagcccttgaaggtttgctagggttgttacatagggagaaggggtaa

SEQ ID NO: 123884 - DNA, 300 bp, Homo sapiens
ctcctctctccccacccttggcaaacatttgtcaccaggatggatgctgttagaaaaacgtctccctgtgacatgttgtcttttcaaaaggacaagaaggaaaggaggaaacaggttttcattgcttaaggcacattaaaactggctggttctctctagcacatttcttagacaaacacccgttttcctttagactcagagctgatatgttattgtaacagttaagtttgcctttacatttttattcatgctgccttgcaggtagatggttccttttgacttttttacgtagatgggcac

SEQ ID NO: 123885 - DNA, 152 bp, Homo sapiens
ctatcagagctgggactaagtgtccactgaagaaatcttgattcaccggagagaagttgtttccttggattccatcatctctgctctagctaccagccaggtctccacaaccttcccagaatccttcattccagcaccagttcatgttcttt

SEQ ID NO: 123886 - DNA, 109 bp, Homo sapiens
atttgtgtttctctcacaattaatgatgttgagcatttttttatatgccccttgggccatttatgtgtcttcttttgagaaatgtgtgttgagatcttttgcccatttt

SEQ ID NO: 123887 - DNA, 324 bp, Homo sapiens
ggctctggtggcaatttaaactgtagatgaggtgacttggaccaaagagcagcagtagagacaaggaaagtggtcagaaatcaagattcaaggcctggtgtggtggctcacgcctgtaatcccagcactctgggatgccaaggcaggtggatcatctgaggtcaggagtttgagaccagcctggccaacatggtgaaaatccatctctactaaaaatacaaaaaattagccgggcatggtggtggatgcctgtaatcccagctactcgggaggctgaggcaggagaattgcttgaacccaggaggcagaggttgcagtgagccg

SEQ ID NO: 123888 - DNA, 829 bp, Homo sapiens
  misc_feature (763)..(763): n is a, c, g, or t
gaaatcattcaagccaaaagtgcctgccgcataatagatgctcaatgtatgtttcttgagcagatacatgtaacttatggcactttacaagggatttctctcacaaacacattttgatcctccaacaacatttgtcatggtccctgctctcagtctagtaatgtaaaatattactgacccccatcacacattgcaagcagcactcacttcttggaaagctgagctctgcatgcaacatgctgcccaagaaggaaaggaagcagcactggagacctgtgtttcatagctaaccaagataagggcatttttttccaaatgtctgtggagggggtcacaccattttaactatttactgctgtaaccccatttttaaagtgtagtctgtgagccatctgaatcaaagtctcttgcaaaatcccggccaaaatccagacatactgaatcagagggtcaggtcccagaataggcattttgaacaaactcaggttcataaagcttgaaaagttttggggctgttgtgcctgtgttctcttagtctgggacactcttgtcccagattgacaaagggttggttcattcagatctgcttaaatgtctgtcctcagaaaggtctttcctgactactcaatctaatagagtagcctctatcaacttcatccccttatgtgcttgattttcatcaaagtgttacacccgaaaaaaaaaaaaaaaaaaaaaattggggggtggccggaaattttaaacattgtgggggggcaggaanaaaggagggcaggaaggggaggggttccaaaagcgggggggggaaacaggggggttgttaagggaa

SEQ ID NO: 123889 - DNA, 374 bp, Homo sapiens
catataggagtgcaactacccatttacttttaaagcataactacttattttgaatttaatacaagttcttaatttggatgcctcatttttatttggtgaagataacagtcttcctaattcttgctacacttctgattcaacacattagacttcactagtgcaatgttacccgcctactcaaaatacaactgctatatgtgtttaatgttggaaaaagcatttactagattttggaagaacttgaggggtgtgtgttgtgtgtaaataaaaaggtgcacttattgccgccttatcataaccactcacttgaaggcatatattttttttttcactgtagggaaaataaagaagtccactttaagtggacaaacatg

SEQ ID NO: 123890 - DNA, 474 bp, Homo sapiens
tgctgtactaaaatgatctgaaaacccaagctcagcctaacaggatcactgcctgcattcttctgtctgcagcaagccgcaaaggaagttccttaaaaaaaaaaaaggaggctcaggtcatgaggagacaagataggattcttgtgttctgtcttttgacacaatcagaactcagcaatattttgagcctgctcatgcaggctaggtttggcttcagattagtaaagtgtaacagaaaaaggcaccgttatcacatgaggtcccaaagattatgcaacatacaaagaaggtgggacagatggctccggcaaacgccaggctggtagcttctggggaaccaaaggcactggcatcaactttctctaccccaccatcaccaataagtatttctcagctgggctccttcagtgaacttcagtcaatgtataaattgtaaaaataaacaaggattttcttcctttaaatcttttctcc

SEQ ID NO: 123891 - DNA, 221 bp, Homo sapiens
cgactctagacgatcgttaacctgatgcgtgggccaccttatgctgggcacacagtgatggtacagaaaatgctagctattctctgtcctcacagagaaagagatgcagaagctgggaataacaaagctatttttctaaggttgaatcacctcccctgggagctgccagacaggagggcataggaccacctccttccaactccaggtcggggatacttgat

SEQ ID NO: 123892 - DNA, 914 bp, Homo sapiens
gccaggctagagtgcagtggcatgatcttggctcactgcaaactctgacgcccggattcaagcgattcttctgcctcagctactaggtaggctgaggcaggagaatcacttgaacccaggaggcggaggttgcagtgagccgagatcgcaccactgcactccagactgggtgacagagcaagactctgtcttggaaggcgggggaagatacaaaaaaaaaaaaaaaaaatcgggggaatcttcaaatttgttaagtggtagacacttccatattttattaatacagaactcttgttatatgtgggattacatggcttttttcacttctatattagagatgagatggggaaagtatgtcttgaacagttacttcagcataaatactttcgtaccttcattttttccgtttggaaggtaagagggttggatatttacagaattgctcattgaggaccagtctttgatatttacttgctctaatgttagttggccaatcagaattatttgcatttaactaaaaccatcagcataaagcaagcttacataacctacatttatttcatagcttagtgattacattacacagtcagtcagaatcctgattctgctatttactagctaagtggccacaaataagttatttaaatcctctaagcctgcttctgtagttgtaaaatgagagttatagcagcacctaccacctaagattttgaggtttgaatgagaaaatgcatgtaaagctttgggcattgtgcatgatgtaaacactcaaatgttactgaagtcaataaatgttaactattttttagcacacttcagtgggcttatatcaccagtcaaaatgatacacagtattttatttaatggctttatgtaaattatattttactagctattaataaattaactcttgg

SEQ ID NO: 123893 - DNA, 630 bp, Homo sapiens
gggacaggaaggctcagagggtctctttactgatagttaagatacaaaaaaaactaggccaggcgcagtggctcacgcctgtgatcccagcactttgggaggccaaggcgggcggattatgaggtcgggagtttgagagcagcctggccaacatggtgaaaccccatctctactaaaaatagaaaaattagccgggcatggtggcaggcacctgtaatcccagctactaggtaggctgaggcaggagaatcacttgaacccaggaggcggaggttgcagtgagccgagatcgcaccactgcactccagactgggtgacagagcaagactctgtcttggaaggcgggggaagatacaaaaaaaaaaaaaaaaaatcgggggaatcttcaaatttgttaagtggtagacacttccatattttattaatacagaactcttgttatatgtgggattacatggcttttttcacttctatattagagatgagatggggaaagtatgtcttgaacagttacttcagcataaatactttcgtaccttcattttttccgtttggaaggtaagagggttggatatttacagaattgctcattgaggaccagtctttgatatttacttgctctaatgttag

SEQ ID NO: 123894 - DNA, 415 bp, Homo sapiens
  misc_feature (40)..(40): n is a, c, g, or t
  misc_feature (47)..(48): n is a, c, g, or t
gaggtgctgccggagcttatgtctcattcctcaatagtangtagctnntaaagaacaggtctgtcagccaggcgcggtggctcacacctgtaatcccagcactttgggaggcaaggtgggcggatcacctgaggtcaaaagttcaagaccatcctggccagcatggcaaaatcccatctctactaaaaatacaacaattagctcggtgtggtagcatgcgcctgtagtcccagctacttgggaggctgagacagaagaatcacttgaacccaggaggtagaggttgtagtatgctatgattatgcctgtgaatagccactgtactgcagcccggtcaacataatgagaccccacttttaaaatgaaataaaataaaacaaaatggccttaatgggtagttaggatttttatagga

SEQ ID NO: 123895 - DNA, 458 bp, Homo sapiens
aggatacccttccagcttctcctctacctgtcctgcttagctcctctgcttcatggtgaaacttctggaaaggctgcctaggcctcctgtcaacttcctcacctcccattcaccccttagcccatcactctatccaaagttctcttgttaaggtcaccagtgtcctccatggtgctaaatccaatggacggtttccactctttatcttgtgtgctatcccagaagctttcaacactggtggccactccttgaaagcagggatgaaaatcaagtttaacaactgatgtggcatgggcactaaccactatcacagtgcatgcaccgacaagtcagaatggtcactgggcatccgtggccagtctcactgtgcctgcgcatacaggctgaatgcaagtcttgcttgaagcccttgcttccctttgcttccacaacacaacaatctcctgtttttaatcctg

SEQ ID NO: 123896 - DNA, 198 bp, Homo sapiens
agacaagtgatatggatgatcacatagaaagcatttcagaatgatagactattgacttcattttagtagtacagacaaaaataaaaagttcataaaaatattcttaaatatcaaaatcacaaacagctggctgagtttagagccccttggaaatctgtggatttgagaaagacttaattttggtcctttgttgtaatg

SEQ ID NO: 123897 - DNA, 533 bp, Homo sapiens
taaggtatataaggagggctctgtagggagggttctatttgttgctaggccatgaagattaagtcattcgaataaaagcaagtgaatacatgagcctatgttttaacaacaggtggtggtgatgtattgatatggggaggcccaggatgccacaagcacttggggaccccatagactatcctcagggacagcattagtctcaggaaaagaaacgttgggttagggttctgatttgtgcattgtccagaaagagatggaagtgaagtgggtagattaatacatgggaaaaacagtgacttctggacttttcccttcccagattacctctatctcacctagccaacattctactataaaggagaaggtaaaattctgagagattctaacaggaatccatacattttacctattagtgctaaattttcgttctttcaggcaatgccctccatctcgatatgaagaagaggatatctggtgatcagagagaagagtttgatctccacagttgcctaaagcctcacatgagtgtcctt

SEQ ID NO: 123898 - DNA, 240 bp, Homo sapiens
aaaaaaagagaaaaaggaaggtaatttgtcactagcagaactattctaaaaaaatagctaaaggaatttctttaaacagaaaggaaataataaactgaagaaaattggaacattgggaaggaagaaataacacagtaagcaaaaatatgtaaaaatataataggctttcctcctctttttaaaatcttcccttccttccttcctccctttcttccttccttctttccttctttcctccct

SEQ ID NO: 123899 - DNA, 222 bp, Homo sapiens
ctgggctaccttacttatgcttagaacacttacatcagcctacagttgggccaaatcatctaacacaaaatctattttacaataaagtgtagaataatctcatgcaatttattgaacaccgtactgaaagtgagaaacagaaaggttgtatgggtacttgtagtttttaatgaaagctgtttctcatacattgtttcagatgtttcagaatatcagatgtat

SEQ ID NO: 123900 - DNA, 396 bp, Homo sapiens
tttttcctttttatatgcctgtcccataataccaagtggcttatttggctcttgaagagctaagattgaaagtgtttaacaggtgactccctactatctgtgggtccctgcactgtgcccttgcctgagaggtctcatctctctggcaggctcagaagaccactagaaaattctctctaaacagagtctctcacttacatttcttatttaaatgacggggtcccttacagtggatactaagatcagcctttttatgactactatcaaatgatgtgtgttaattgcattacaaaagttctataattaacagttaatggaaatgtactaattgggaaagaggaggtcaaagaacaaagtccagtttgctcatttcatgtacgtgtacacagtcatctg

SEQ ID NO: 123901 - DNA, 1009 bp, Homo sapiens
ctcccagttgcgagggcaagcaaacccgtcatgagcaactcccttccccatctctgctcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttctttttgttgttgtgccgtttgtgatactgcagtgtcaaagagacagtgagaagaataaggagcagagtcctcctggccttcgaggcggccaacttcactctccattaaagaaaaaaagaaatgcttcccccaacaaagactgtgcattcaataccttaatggaactcgaggtggagcttatgaaatttgtgtccaaagtgcggaatcttaaacgtgccatggcaacaggtagtggcagtaacctcaggcttcgaaagtcagagatgcctgcagatccataccatgtcacgatctgtgaaatatggggagaagaaagctctagctgaatggatttgtgtgtcaggagagaaaaaagttgagtgttgacaaactgtatgcaaactaataaaactattctgaagaaaagaaaaaaaaaaataaaaaaaagaagaaaagaaggaaagggaagaacaaaaaaaaaggagagcgggggcggcagccggcgagatacgccacaagagggaccaaagagaggagcaccaccatggttctagagaagggcgcccacagagggcagatagagacgagcggggcccgctaagaagacggcgggagagaaaacaaccgacggggagctatgcaggcgcacaccgccaaggagaggagcacaaaaagaacaaaaccaccagagtagagccgcgcggggacacaacagaggcgagagacgcggaacacacacgtatcgggcagcgaaagcgccgggggaaagagcataaac

SEQ ID NO: 123902 - DNA, 240 bp, Homo sapiens
agggcttgatttagattaggacttagagaaaagggaaaagtaaatgcagagaaattataaatatagtattttattgaaaacagagttgggaagaaaatggccttgggatcactgtccagtttagtcaggttggttgaaaggaataccagtgaaactcaattgcctctcgggctcagctacacagatcttgaaaggaacagattcagctctgtgctgtactgtgtgacttttctcctcctg

SEQ ID NO: 123903 - DNA, 1017 bp, Homo sapiens
tcacagttccacatggctggggaggcctcaggaaacttacaatcatggtggaaggggaagcaaacacatccttcacgtggcagcaggagagagaagtgcagaagaggggaaagtccccttataaaaccatcagatctcgtgggaactcactcagtatcacgagaacagcatgtgggaaccactcccatgatgtaatgccctctcacaaggcccctcccccaacacgtggggattacagttcaaaatgacatttgggtgcagacacagagccacaccatattacagagccagaagagctgagcagtgggcgctaagtaaatgttcattaaaccaaacccctgcacaaggctggcttcatagaggtgccacctgtgcagtggcaaaagccccactgtcagaggggacctgaacttggtttagtgctatgttgtcactgccttcaaattcttaacaatttttgaacagactccacattttcagttagcaccgggtcctgcaaattatgtacccagtcctgtccctgaaacaaagataaggtttgttcatgaagggactcactcgacccctccctgcccatctcactccaagatgccctaagtaaaggggaacacagagctaggagaaggcagtatttgaggatgatcttggaggtcccacctgatcatggctggtgatgcatgtgtgtgggtgggagaatttggctgctctcttctggcaccttccatcccatgtacaaggcctgcactttgcctgtctgtcccaagtcctcctacctgactcagaccaggagtgtggatgggggtggggggtggtggcgggcactggggcccagtactcctggtcccagctggagttccctgttgactggggagatttggcccctctgactactcctaccccatccccactaggacaggagttggtgaaggggacagggtgggaggcttaactagtagccaggggcaggcggcaggcagtggggcgaagatcaggctgaattttcctgctactgatctg

SEQ ID NO: 123904 - DNA, 240 bp, Homo sapiens
taaggtgggcccatgggccacatctggcctgccacttgtttttgtgaataaagttttattggcacatagccaggcccattcatttatgtatcatccacagctgtgttcacgctacaagggcagggctgaacattcaagatggggaatgcacggcctgtaaagctgcaaacagtcactatcaggtcctttacaataagtttgggctggctcaaatggtggctcacacctgtaatcccagca

SEQ ID NO: 123905 - DNA, 763 bp, Homo sapiens
gacactgtcttagtccatgtgtgctcctagaacaatatatcatacacaggtagtttataaacaacaggaacatattcctcacagttctggaggctggcagtccaatatcaaggcaggctgggtgtttgatgaagctccccttcctcgtagatggcgctttctctcttgagtcctcacaggggcccaccttccccacagatggcgctttctcactgagtcctcacacgaggcccaccttcctcacagatggcgctttctcactgagtcctcacgtggggcccgccttcctcatagatggcgctttctcactgagtcctcacacaaggcccgccttcctcatagatggcgctttctcactgagtcctcacacgaggcccgccttcctcatagatggcactttctcactgagtcctcacgtggtggagggtgcaaggggactctctggggtcccttttctaaggacaataatcacattcatgaggctccatcctcaggaccccatcacctcccaaaggccccacctcctgacaccatcactcttgggatcaggtttcggcacaagcactttggagagacacagacgctgagaccacagcagacaggcagcaccagtgtaaggcagaccagttactggccccgggagaaacgggaggcaggggtgcccaaccgtttggcttccctgggccacactggaagaagaagaagacagacatttttttcatgcctactaagacaacgtccactctgcagtccatggatcaag

SEQ ID NO: 123906 - DNA, 1140 bp, Homo sapiens
ggagccatcaaggcgtctattctcttcttgccaaaaatgaagcggagaaagaaagaagacaattattgttgatgtattaggtaaatactttcaatttgtctgtgcaactttttaaaccaacattcttattatatttacacaaagctatgctgtatgctgtgtaacaaacattttggaaaataagaaaaatcacccataatcatgttgaacattattagaatttttaaaaatttcctccttacttttttattctatgtgtattctgtatggtgggtgtaagtttacaaattatataattgagaaaacagatgctaacaagaagacatgcatccatgtttccagtgaacctaaagagtgcatgtacacaattctcaaattgctagaaggccatgaatatgtattctgaatcatggcccagaataaatatggcttttttatagaacttgcccccatagtgtctattatgttgttatatagttttcatagaagcaactttccttaaactgtacatgaatgtttaacaatctgcaactttccttaaactgtacatgaatgtttaacaatttgccagtgctgaccatttcacatcatgagactctacccctatcgctaaattatcataataatgcaaaaacctgtttgaagggtttcagtattctaattgaagagaagcatcatagttggttatcaatattgcatttctagtcactgaatatagagttgaactctatgaggctttttcatggctctcactggaggctttagtccagtgatttgctcagaacacgaagcctttccactcagggctctttctaagcatgtctctaggcacaacaatactccagccacagtttttatgtgaaaattgccagttctatgttgaatataattaatataagaatggcataaggaaaaatatttcattaagcagtagccccacaaactttcaggttagtttcaagcacctaaagctcttttgcctaatggttattactttaatttgagaactggtacatttccacgttaattatttgcaacctcctcaaagtcattctgaaatttggggcctcctatgctgcttgttgatccactggtcatccagaaataaaccatctctctctccgtttcccctgcagagga

SEQ ID NO: 123907 - DNA, 434 bp, Homo sapiens
gggatagctaagaaattaatattgtgctacgagtagttggtgaaaagtatataatatttttatattggccttgcaaatagtcatttatttgtggtgaatagagacttattctggaaccctgcagtgggtagaattacatgtaaggctggttagttttccatttgacataaggggacctaattatagtggtaccagaaggacttcatctgaggttattttaccagttagctagtcttgcagtatggtatcatcacctgagaacaattttatggggccagaccagataaatagaaaataaactcatttgatttaccttacagaatattttccacctggagcagtggaatctatccctccatcttcctgttgatttgatagatatttttaagtctgtgtgtttagagtgctgtgtgcagggaactttaggaggatac

SEQ ID NO: 123908 - DNA, 189 bp, Homo sapiens
agccggcctgattttaattttctactgtaaatttttctgtgttttcaagggggaaaaaaattactaaaaacagaccccttccctttccccctaacaactacaaagccaaacttaaatgtactatgatttttaactgcagcagtaggattctgagtgagtcaatccaccagattaatatttttttaaatc

SEQ ID NO: 123909 - DNA, 442 bp, Homo sapiens
gcttcaacgagcatctccttgatgttatgtcagcactcaaagtgttctggatttgggggtatttggatttcagaattttggattacggatgctcaacctgtataaaaacagaaggactagtgagatattttgtgttgtttctgtgcttctgttaaaatatctaccaagtgtaagttctaaagcaagccatatcaggatcctaatgaagagctggcaggttttatgggattagaattaggaatcaaatatatgtcccagttatgagttgaaatggtcataattttaacactgttgctctcagatctactttttttaaaaaaaaattgtttgctttgttacatttataaaaatgtctatgtacaaaccccactaaatttcaaaatatatttcaactgtatgccttttgattacattaattaaatatatttcaattatttaggat

SEQ ID NO: 123910 - DNA, 158 bp, Homo sapiens
ggtagtccctgctctactgactgtggcctcatctgtgcccttggggagaggctcagccaggccgctgatccaaggaagccccacagtcagctgagggagacacaggaaccagacctggtcccacttctcaggggtcagagtctggttggggagacaga

SEQ ID NO: 123911 - DNA, 197 bp, Homo sapiens
tgagctgctgtggtttaccccaactctagcactccctcctgtctccagtactctccacagcaataacctcttttgtgagactgggcatatgctgaagcaactggaagtgagttgtctcaagtttacttggctttaactcccaagaccccagcaaatgtccttctttcctccttttgtgtcctttcaccatccctctt

SEQ ID NO: 123912 - DNA, 415 bp, Homo sapiens
tctctattttgtcctaactagactgatcattatatctacgatgaatatcaacaaaatggtaataaaaaatagtgtagtgcctggaaaatcctttgacagaattatttggagcaagttttttttttttttaaatttggaaacaaaacaaaaaatttaaacaaaacttcaagaaataagcacatagcatttaccatgatggtacaatagcagtggatgaagaaataccagaagagctgcctgcaaccaaactcatatggaaccgtgagtcaaaggtcaaaccagtaactatctaagacagtcattacttgagaacgaaacggtcttcatttttcaacttagcactatgtagaatatggttatcacaatttattctattcccaagacaacatttcaagcaataaagtttatattccag

SEQ ID NO: 123913 - DNA, 215 bp, Homo sapiens
gaacatacctcaaaataataagagctgtctatgacaaacccacagtcaacatcatattgaacgggcaaaagctggcaaaagcattccccttaagaataggaataagacaaggatgtacactctcaccacacaaaaaaattacctaggaatacatctaacccaggagatgacgcatctccacaaggagaaacactcctgaaagaaattggctggat

SEQ ID NO: 123914 - DNA, 545 bp, Homo sapiens
acaggtggtcaagtccgttatataaaatggcacttgcatataacctatgcatatcctcctatatacttctttctttttctctctctctctttctttctttctttaagagatgggctcttgctatgctgctcaggctggtcttgaactcctggactcaagtgatcctcccgtctcagacttctgaatagctgagattatagaggtgaaccaccacacccagctttacttttttctttttttcccttcagtatatttaaaagtaatctgtagattacttacaatacctaatacaatgtaaatgctatgtaaatagttgttatactttattgtttaggaaataatggcaagaaaaaagtctgtacacattcagtacagatacaaccattttttccaaatgctttccatccacagttggttgaatccacatatgtggaacctacaaatatggagggctactatattagtcatttgagtggatccgaataaaggattgagaaaagtcatctagtcatataatcttcaggctgcctgaaaccagctattta

SEQ ID NO: 123915 - DNA, 246 bp, Homo sapiens
cgtagtgaaaccccgtctctgctaaaaacacaaaaattagctgggtgtagtggtgcacacctgtaaccctagctacttgggtggctgaggcatgagaattgcttgaaccagggcatcagaggctgcagttagcctagattgcctcactgtactccagcctgggtgaccaaattgagactgtcttcaataaaaaagactgttctagaccttattttcacaaaattatggctcagtctctcaaatgtc

SEQ ID NO: 123916 - DNA, 403 bp, Homo sapiens
taaatgcatatttttattgcaggtagatatgatggggtgatccatatatatatttctttaggctcataaagtgaagcagtgggggtggacaaggaagaaagaaatctgtaactggtttgtcatcgattagttgtatacaccattgcacttggaccagctttgtaataaattttgaagcaaaaatttataatcattagagtaaaattaagggaagtaaatgaaaatataaattataggaagaaaaaaatgtaaatttccaactgttaaaaaagtatattcacatttgttttaaaggaatgatggtgatagtgggtatcaaattactaatggtatttagagtcactgggtagattttaaaaacaccctaacagtctcccttttttttttttttttttttttttga

SEQ ID NO: 123917 - DNA, 263 bp, Homo sapiens
ctcaagttcagcgtggaagataagcctgtaaacaaaagaaatgattgtatgtgcttccaataagtgccataatagaagtgtgtacagaggtaggagaggtgaattccacctgggggaactggggcagacctcccagagtaggtgaccagaagtaggtgatcagctgacaaggcagggagaggcactgacatcacaaaggcctgatgccaggaacagcaaacaactttgcagtaaagccctgccatttagtgaagaaaccatgg

SEQ ID NO: 123918 - DNA, 229 bp, Homo sapiens
gacaccgggacaggtctgggggctctggagagggggcgagtacacatctgccaccaccctaccgatgcaacagggtgcaagaggggtcctgatgaggcagctcccgctctgagggccacaggtgtcctgggggcacaggcagtgacgtccactgtccttgctcacctcagcagtcctggtcccacggggcatgcacaagctcagggtgggtgagtgctgaaaggccact

SEQ ID NO: 123919 - DNA, 367 bp, Homo sapiens
  misc_feature (336)..(336): n is a, c, g, or t
tgttaactccggtgacgatacatgctctggaattcctaagttctgtgctttacagtttccctatcaataaaatggtggtgatgattattatgtgctgttggaagagtaaatgagattctacatataaagcatacagcacaatgtctggcacatacaaaagctccatagatgtgatttaacttagttttggcgtgactaagctacaaaattagaaggaattagaagccttatgcattgttgatgggaatataaaatggtgtgacaatcatggaaaacagtatggagggtcctcaaaacattacaaatagaattacaataggatccaacaattccacnttctggaatatgcccccaataattaaaagca

SEQ ID NO: 123920 - DNA, 226 bp, Homo sapiens
ctgcctggctaattgctgctctgctaacaggtcccctcctacagaaagtccccctcttcaacactacctccttttgatcagctcctagggccctaacattaaaaaggtaatggcaggccgggcgcaatgggtcacgtctgtaatcccagctaattttaattttttttgtttgattgtttttttgagacagggtctcgctatgttgcccaggctggtcttgaactcc

SEQ ID NO: 123921 - DNA, 758 bp, Homo sapiens
agaggacagagggcttgaggatgaattgggggtgggggtggtgaggaataagtgagaagactgggggcagaaaagccagttggggaaggttgtagtagactggatagagatgatgaagcgtaactgaggccatgattactgcatggagaaaatgggaagatggacctgaagagagaaaataattgaacctgggtaattgagctttaaggtgcaggatgccttcttaaagagaggaagaagtcaggcatgagttacgggtaataggtttttgacttgcataattgattgtggaggtggctcctgactaagggaatgaatgagagagagtcctggaggagggagagcataattttgttgatatcctccgggaggattcatctagatgtctgcagctcagcaatgaggggatcgacattgaaatgaatggaagatgatgtcatgagagagaacgagacgtgtagaacaattagagaaacattagaagagagtaaaggatggaattaaggagatatacaagtagtcaaggtgttggactaggagaatgtaaaagagcattctgagaagttgaaggcagttgctttactgcctgagccttagtttcctcatttctaaaatgaggattagaatcgtgcctactcgttgtgtttagggttacatgagagaatgtgtggaaggcacttaccttgcatatcagaagtagaactcatgcataattcatcattcattccgtaagtaagagtcaagcaccagcatatgcc

SEQ ID NO: 123922 - DNA, 512 bp, Homo sapiens
tccctcccacaacacgcaggaattatgggagctacaattcaggatgagatttgggtggggacacagccaaaccatgtcacccacattaggcattcaataaatgcctgctgaagaagtggatggaagccaggataaggaggcttaggacagggggctccagagctacatcctatgaatggtagaaggaaatggggaatgagcttttatcaagagcagctgttcaaaatcagaatgggcttccttgcaaggacattccagatctgagtgacccagcagaggcagatgtcatcccctccctcctccagatgtatacagctacctcccacccctccctcctccccttctcccagccctggccctccatcgaggacttcagcatttactcattatctgcaggatgcaagccaagtccatcttctcatttccgatctctttcccgtcgtagctctcttcttcttcatcttcctttctcttactcactcctggaaattcttttgaaaatgcagactctg

SEQ ID NO: 123923 - DNA, 412 bp, Homo sapiens
tcactgaaatgtaagatatatgtacaagagaattcactgcaacactatttgtaatcacaaaacattggaaataactaacctgcagccattaaaaagaataatggcactggcatgggtataaataaataaataaataatggcatttgcccacatcctactacatcaaaaggcaactgcagggaaatatatgtaaatttacactatacatatatttctctatatataactatacatacatataggtatgtttgcatagctatagaaaaatactggaagaatacccatcaaactattaacagcaattatctccgggaaggagactgaagaaggaagaactttcctttatttactgtatatttttgaattgtttgcaatttttactactagcctataatgcttttgtaaatttaaa

SEQ ID NO: 123924 - DNA, 247 bp, Homo sapiens
aaacctgcacattctgcacacgtgtcccagaacttaaagtatattttaaaaattctaaaaaaaaagacaatggtgatacagattctgttgtataattttcttaacatcttctaataaaaaaatcaggtccaagaagtatctatttgtttccattttttgctgcagagacaatacaatgtactgggtaagagctttggcttcggaaacagaccaattagaatcaaatctcttattaaccatgtatgtg

SEQ ID NO: 123925 - DNA, 209 bp, Homo sapiens
aatggacaaattccttgaaagatataaacaacgaaagatcattcaaggagaaatagataacatgagtagccctatagctactaaagaagtctaatttttgcttaaaaaccatcttacaaagaaagctcataaccagagataaattctaacaaacacttaaaaaaaaataccatttctggccaggcacggtggctcatgcctgtaatccc

SEQ ID NO: 123926 - DNA, 534 bp, Homo sapiens
gtctctaaggcaccactgggaggcaatatagcacaatgtgaactaggttcaacccctggttcccctccacttaattactatgtgaccttgagcaggtgacttcccatctctgagccgtggttttctcacgtataaagatgcattcctacatcagagctttgttgtgaggaaccaaatgggaaaatctatgtcaagggctgagcactgcacttggcacaaagtaaatgttgactaaatggcagctattattgttgtcgtcatcaccagcagttccgtcaactcctacctgagccttaggccagttttgttaagattaatttagtttccaaaaaagatgtgctaattggattattacattttcatgtgtttacatctatatatacatgcatggctttgaaatctacacatgaatatatttatccattcaagttctcttttaaaaatctgtaaggattatattttaagtcattgaaccatgatgagattctttttcaaaaaaaggattgctataagtgatcattatgtaggccatca

SEQ ID NO: 123927 - DNA, 694 bp, Homo sapiens
atggctcactgcagcctccaactcctgggctccagtgatcctcccgcctcagcctccccaggagctaggactacaggtgctcaccaccatggcctgatacatctttttgttttttttagaggacagggtctcaccttgttgaccaggctggtttcaaactcctggcttcaagtgatcctcccatctcaggttctcaaagtgctgggattacaggtgtgagccgtggtgcctggccgtgttgctattagaaactgccctgcagtgagtatatacaaggctgcaaagtaaaccaaacccagcgaggcagccattgaattagtatgacttgacctgtatgtgtctactgcttatttggtcctggtatatgcattacagagggagcattggccctgcccatacctgaagcctacagttcgtcacaggaaacagcaggaaaatatgggacagaaatgtacatgattcatccttgaaagtgtttttggggggtagttttatgggaggatttgagaattggtttataaagaagaatggaaggagattgctccttcatttgtaggaaaacttgggcaaagatttggacagaaatgtatttatattcattgagtcactgagtgaatgagaacctgggagtgcagacctgcccttgagatgcttttggtttactgggagacaggcacgcaaaaccagaaccaag

SEQ ID NO: 123928 - DNA, 755 bp, Homo sapiens
gcacatgaaaaataaataaaactgaaaactaactctttaaaggcacaagagtttgtccaaacaaaattggttaaatgaaaaaaaattaaaaattgactcaactctctgatattcatgtcaaaatgtgaaacttgtttttgtctgaggacataaacataagtacttactttaattcagaataaagtctatgacaagcgtgtttctcttatatttacaaatgctatcaatttatgagctgtgacttgagtggatggcaatggagaacatgccaagtggattggcataaatttaataatttaatgcaaagatgattatatcggtttagaatattgagtcaattatttaagaaaatttacaaattgtaatcaaagtggtaaaaaaaagtctagcggtctgattaattactccaatctactaattaggtaacttttaaatgttctccaatggcttatgcaaacatgaaaaacattccaatttctgtttcttctgtgttccaaacaatgcaattattgaagcctcagttctaaattttctttatgtgattgtaagtttacagagtagacctgaaaaactcctcttttaaagttatccatacattctattttctctgtttataggaagatattgtatggttgtggatattcctgtggacacaagctagacaagtgggacccactaaacctctggcttgcgaacttggagaatgagtaaaagaggacatttgtcacatcaagagagcaaattaaatgagatag

SEQ ID NO: 123929 - DNA, 434 bp, Homo sapiens
tagtaacctcatgccatgtccacaatattcagtggtttctaagtttttctgaaagtctgtcaatgtaccctgttatcatttcacttattcccaaatgccgtcatccccaacttcaatacgcacatttccacatctgttttatgtactatgatgtgcacttttaagctattttactctccaagctcctctcctcctgccagttcacatttttttaggccttgctcaaactccacctcttcttgaagctttatcatctctaaagagcactcgtcttctgtcggcactagcggatgcataacaagcaccgcactactttcaatttatgctgactggtatcgctgcgtgggatttatgtgtgaatttcatctccctaactggaaggtacgattttgatggaagggactgtgctttacaaatctcttacgctctccact

SEQ ID NO: 123930 - DNA, 263 bp, Homo sapiens
aagaggggacatttcatccacattggcgctgaatctgggatgtgcccctggaagaagggtttcctgagagttttaaaggacacgtagaaattagccaggaggacagtgtgggggttgacttgtgtctgaggaccctgcatttcttcagagtggatgtaagaaggatttggggagtgatgtggaactgcaggggctacagggccaggtggggcccctgctaaggggctcttagcttttatcctgtggataggtgggggcctttg

SEQ ID NO: 123931 - DNA, 299 bp, Homo sapiens
ttctaccattcaaatcattcttcaaatactatcttttctctaagaagctgactttccccctgcttaagcagctgaacttttacagcaatcactgtccaagtcacatggcaatggtcacattctggattttgtcatttatttgttaccaagctatacgaaatattttgatcatttaaggtgtgtttataactacagtgtaagctgcactagacacacaggtggggtcacgtcttacgttttctagtcttctccctctgtgaatccactatacaacacactgtcagtgtttgatctgctga

SEQ ID NO: 123932 - DNA, 843 bp, Homo sapiens
  misc_feature (599)..(599): n is a, c, g, or t
  misc_feature (633)..(633): n is a, c, g, or t
  misc_feature (635)..(635): n is a, c, g, or t
cctaagtttaggagcacgaagaagagaaaaagatgggtctagggacagggtttggaagaatggggcagagcagattagaagaaaaaaaaacagtggggttgggatattaaccagattttgtgaaggtggtgggctgcggagtctaggtcagagaagaagtgaaggcagcaggaagggggtggtgaggaaaaagcgttgcacggaagagttgaacttctccaaaccctggtgaaggtgaagacaggtagggttggagtaactgagaggatgatctggaggagacaaggttgtatttagagatgggataatcagtctcagagttggggtaaaaaatggcattaggacattgctatacactaaaatgtgaccccctcccaaattcatatgctgaaaccctttcaatgtgattgtatctggagatagggtcttcaggaggtaatcaagaccaaatgagggctggccatagtggctcacacctgtaatcccagaacttggaggatgaggcaggtggatcacttgaggtcaggagtttgagaccagctggtggccgacatggtgaaacccatctctacaaaaatacaaaattagccggtgtggtnggtgtacttgtatccagtactttgggggtgagcngngatcgttgaaccggaggggggtgtctgagcgaaatcgggcctgaatcagctggcaagggagatccttcgaaaaaaaaaaaaaaaatttgcggcgcgccaaagttacaactgtgggggccggaagaaagctaggcagaacggcaagggtcccaaaagggggggaacgtggtgtgttatatgactcctccccccgtaacaaagacaaaac

SEQ ID NO: 123933 - DNA, 305 bp, Homo sapiens
gaacaccgagcaggttagctgggagggagacatcctgaaggagaagagagcggtggaacagaatgctaccacatacacctagaaggtgatcttgtctaaagatcctccatgcctctcaaacattttttggtccatgaaccacagaccaccatcacctatcactacttgctactgcccaaagaactaaaacctcatcaaaactaaagaagagaatgacactgtttctcgtaacagagcaatgaggtggacgccaagaaaatggcagccacagccccggaatggaggtcggctatctgggaacctcc

SEQ ID NO: 123934 - DNA, 654 bp, Homo sapiens
ctccgaactgagaaaaatgagattactaggcttagaagaatatgtaccaggcctggcctggtggctcacacctgtaatcccagcattttgggaggccgaggcaggcagatcagttgagttcaggagttcaagaccagcctggccaacatggtgaaacctcgtctttactaaaaatacaaaaattagctggacatggtggtgcatgcctgtaatcccagttacatgggaggctgaggcaggacaatcattcgaacccaggagatggaggttgcagtgagccaagatcgtgccactgtactccagcctgggcgacacagcaagactccgtctcaaaaaaaaaaagaatatataccaatagtccattcagtcagacagcttaatcaggtataggttaattctcaggctagtatataagtttgattaaatttcctgaccacaattgtcagctagagaatatttcaatttaaggaggtaagatatgattaaaagttaaactgtcagtattggatcttagaagtaaatgattattaggactgtaatagtaattattaggactgtaaaagtaaaggattattatctgcattagatatcattatatctaatgatatagagactgcagacataactacagggctctttttcttaaatcagaaa

SEQ ID NO: 123935 - DNA, 254 bp, Homo sapiens
aaaagttaactgacctaaatgaagacctagactgaaggaagtccagctgcctacttttaaatataaattcacaatgacccagattaatagacctttgagccagaaaaaggttgaaaatggtgaaggcaactgagatacggtaggtgaagaataggggctctggagccacatggcccgggctcttattcagcttcactgccttctgtgtgggtaatctctggttacttagttcactttgctaagcttcagcttcc

SEQ ID NO: 123936 - DNA, 334 bp, Homo sapiens
aaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttgt

SEQ ID NO: 123937 - DNA, 349 bp, Homo sapiens
caaagtgaaaaatgttattatcaccccagaacaatctgtatacatctggagctaattctagccttcatttttcacatcattgtacacactgtgctacatcttgtagagatgccatggaacttttgaagaactcacaaaaaatgttaaggacttcaaatacccaataatgtattttattcaaacaaaaaccttgacaatttctgacttgaaacttactgtactatatgatcttcatatcccatttgattgcattagtattaaacagtactgtgacatacatgataaataggcatattaaaacatgtcattctttatctttgcagctcctaacattaaaatatgcaatata

SEQ ID NO: 123938 - DNA, 434 bp, Homo sapiens
tatcccatgagtagggggtggtgttgtggtcagcaagtcctcactgagacaacttaagtcaaggctgaaaagagagacgggaatgagctatgctgattcctggtgcgaaaagcaatccagacagttggacctcaaggtcaaagtccctgagacagaaaagaggttagtaggttcaaggaacagcaatgaggacagagcagagagtggagtcaataaagagaggagtagaaggagatgatgtcagagaatggaaggaaacagtaagagaaagtacaaggccagcaggccctctaacattttagcttcagctcagagagatagaaggttctccacagaggaataacacagttgctttatgctttagcaggataactgactgctgcagaaagaataccaggaaaacggctggacaccagaacttccttcagtacttg

SEQ ID NO: 123939 - DNA, 522 bp, Homo sapiens
aactgtatgttgacgtcgactcgtagaggatctcctactttccacagggtggtagttcccaggctctgagaggtattttcctgcaaagcaaggtctaatttaatagttgagcattcttttttctgagtcccctgttcatggctagaattacggagatggcttttaggtccctgacccaaattggaaagagattataagtagttggtggcagccaggctagtgtccattactgactgggtcacagtggagtgtccagatgctgaagaggcaggcattttagaaatatcttcttggaggtggggggtggctaggtcactctgtatgtcagagacccacggcaatctgtcttctgatcagctcccaggagccaaggggtcaggggaaagccagccatgagggcttgggcttcagtttgacttaaagagcaagggaaacagaaaactgctgacagtggaaaaaccctggcaagggagaccccttgaatttattatttcaagcaaataaaagcaaaccataaccatt

SEQ ID NO: 123940 - DNA, 451 bp, Homo sapiens
ctgtgaacataccacggctctgatgtaaaataggttacgcatctctgtaatctgagtccctctgtccatgccttttcctggttgtaaaattttaggtccctgacccaaattggaaagagattataagtagttggtggcagccaggctagtgtccattactgactgggtcacagtggagtgtccagatgctgaagaggcaggcattttagaaatatcttcttggaggtggggggtggctaggtcactctgtatgtcagagacccacggcaatctgtcttctgatcagctcccaggagccaaggggtcaggggaaagccagccatgagggcttgggcttcagtttgacttaaagagcaagggaaacagaaaactgctgacagtggaaaaaccctggcaagggagaccccttgaatttattatttcaagcaaataaaagcaaaccataaccatt

SEQ ID NO: 123941 - DNA, 473 bp, Homo sapiens
cattttgaggcccaaaggaagagtgatccggggattactagtaaagacagttcaggctgttttgatgtagtcagttcatctagctatgctcagtgcatctctgtaacagctggtggagcagcttctgtgaaatttgttggtcaaggctgctcactaacccctcaggtttggccgactagaaaaaccctgttggagtcgctggaggtttgagttgtttaaattttatgaaatacaattctaggtgtttataaagtttcacacagagagatggacaggaacagagaaaagtgtttatgttgtttgtaggggaggatgcgtacaagtcaggtgaagaggagagattcacaaaaagatgtgcaagggatattaacctggcggtcgtgcctagcaacaccccgctgcctctttctggattttaaatgtttcagggaagaatacttgtttaagcagtagttgggcaaaaccaaaattga

SEQ ID NO: 123942 - DNA, 699 bp, Homo sapiens
agaaaaagtacatcacctgaaaagaaacagtttcaactgattgacagttgatttcattcaatcaacaaaccaaccagcaacatccagcacaggcatcaagcacatcatcctttcaacacattactgcaacagcaacaacaattgcctcaaccgtcagcacattctcatacccaagcagcaacatcatcacttcacagcattcacacaggtgcacacatcaacagcaccatattattcacgacaaacctaacactacgacactttagattagacatgtaccacaactaaaccaacaacaactaacacgggtgattcttcagatcaagaccacacctacattaccaacaaacggacagcatgactaactgcacggacagaacataaaccttgtaaaacgtgaacacgtccaattctacaatgacaaacatgactgtactacatacaatgataatatcttgtaagctacaggcatacagaattaaaatataatcgtcaggccaagcacagtggctcacacctgtaatcctagcagtttgggaggctgaggcagggggatcattgaggccagaagttcaagattggcctgggctacatagtgagaccctcatctctataaaataataataatttaaaattttaaaattaaaaaaaaatttaaattagctgggtatggtagtgtgcacctgtagtcccagctac

SEQ ID NO: 123943 - DNA, 474 bp, Homo sapiens
ggctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaatttatttaatacattgatttattaattaataaatttatttaataaattgatttattaattaactaattttgagagagagtcttgctctgtcaccaggctggagtgcagtggcgtgatctcggct

SEQ ID NO: 123944 - DNA, 382 bp, Homo sapiens
gcgctggacagaggttgtgggggaggtgaggctgggtgtccccagactggcaggcccacgaagaagggaatgaggaaccctcttgtgcatgggcctctctgtgacgggcctcggcacaggacccagtggccagcagagtccccgcctcgggactgccctggctctgggcgggcctgttatcctaggatgggatgcctctggccactggggcagtctcccatttggccaaggctggcctgggatgggaggacaggcaccaggcagggtgtgagcgacctgactgcccacctaggaaggagaaaagaaggctgggcccttcccagcttggacggaggggacggacaagcaggcaggtgcctgatgcatcctgctgaccccaaca

SEQ ID NO: 123945 - DNA, 575 bp, Homo sapiens
atcatctactgaattcttaccgtggatcaatcactttcgtaaatatttgtgttcgttatctcaagtaatcttcacaatgctggaaggtaaaaaccgtcatgatttccaggttacggaagagaaaagtggggcataaggaggtcagaacatagactcatacgattaaactctacttctttgttgcttttccacttaggattaaatgagaaaatataaagtacttaacacagtggttggctcattgtcttgaataaatggtaacttttaaatattatcccaattttagagatgaaaaccatgaagctaagaacagcaaagcaaatttccctgaattgtgtgactgttggtagaacagggttcacgcgtttcactccacacagttttgatgcattctgccttgcgccaaaagggtatccagcagagtggaagcagctgcttcacccgggatggaggaggatgttcaaccagctctcagaggtcatgcctgaactctaaggacatggctttatccttctcaggatgtattcttcgcctgctacatcttgaacacagcaaccacgagcagtcttcatccc

SEQ ID NO: 123946 - DNA, 287 bp, Homo sapiens
atataggccttttggtaaatattttaaaagtttaaatatcaacaaatgctagttgtggttgctagatttgcttttacttaagtgtattgcacttcctgtgagtaacgtttgtaccaaacaagataagactggataataatagctaaaatttattgagtgcttacttagtaggtgtgatgtgacttgagtcacatcatcagatacaaggaaagggtagaaaaataagatcagtaaaggagattgggaaggaatggccagaagagtaggagaaaatctaagaaaataca

SEQ ID NO: 123947 - DNA, 204 bp, Homo sapiens
gattttactgtgtgataaaagtggctctcagcaggatggggaattggaaaggggatggtatgggaagaaactgctctttctctgaagccgtgtctatctgtagtttccgatgctcagctgcatgtattcctgatgctcagcagcttgtatccccgaccacttgcatcagctgctgaggttgctctttttcttccttttgttctg

SEQ ID NO: 123948 - DNA, 569 bp, Homo sapiens
tggcaatatattcgcgtcttttagagtgatggaagatcatgtgacggtttggtgaattatccatcggtatcatctgactgatgaagcccgctgctgttgcagaacatttaaaaatgcatctcacaaattacatggtagctgggaaaaatgcaggttttttttttttttttttaaagaacaatgcttttctaaagctatgtgctagcatacgtaattttttctttgaaaggatggagaccatttcattatgctgggtatacagtcggttaaggttgtgcaaattcattacaatgtttgttaatgtataaaacattttccattctggttttagtgacattggattttttttttttataatgtgccatttctgaaacatctgccatccccttgttacctgtgggcagaagagagagaatgcactctttctaagaatgtttagaaaatcttttccaaaatggaaaggcttgggagataagagggaaaggacagctttttctgtgaatggttaggttggaattttctgggataggaactttaccatgcaataggcaaagaggggctgtcagcag

SEQ ID NO: 123949 - DNA, 274 bp, Homo sapiens
gatggaccacctctggtccaatgaaatctaagcatggtaaagatacatcttagtcctttaggggtcaattctcatggaagcaaatgatatttgtttaatagttaatataaaggaacattttgctgtgttccgaaaaacgatcactcattttatggtacagtaaacatcagagtaaataccacgggaaaaacatacagagtccaaattaccaatacttaagaattaaacttactaggccgggcagggtggctcacacctgtaatcccagcacttt

SEQ ID NO: 123950 - DNA, 314 bp, Homo sapiens
cttaactttctctctttccaggtacaagccagttcctggctcccccatgcctaccttcaaggcaactggctctcccctacaggggtcagtagcgttactctctctttgggcaccagcacgcctgagccatgttgagccctggctctccctctgtccgtctgcaagacaggcggccttggcattctctctttctctgggcgcaagagcacgcatcctgtgcatggcatcggcagggcagttatacattttcaaacaatagtggctgtgagccaagtatgagcttacacaaacaggttatataacaaatggagtat

SEQ ID NO: 123951 - DNA, 442 bp, Homo sapiens
cttggaggtggaaactgggtgcggtcagaaaagtgagtggagcctggaggccaatgagcaccccaccctggcaagtcacagcaggacagggcaggggaccaggcatagaattgggccagttgtaacctgcacaacctggaaaaggatttgtatttgtatttcatgtacccattgggtaaggtggcatttatctccagcttccttgaggtgagctcagtttaggaagtttcttttcgactgaactgtgtcaggaatctcgccaatgcctgatgctgcccaccacatctcttttgctgctgctgtggctggaacctgcctgggaggcaccggctgtgaaggctggagacccagggaggctgccctgacacctctccttgttccctgagccagggggcccatctgagccccttcacccctggggagctgttttctgtgccttgta

SEQ ID NO: 123952 - DNA, 1034 bp, Homo sapiens
accggtgtgcaccaccatacccagctaattgttttcttttacatgttttgtagagacaaggtctcgctttgttgcccaagtgggtctcgaactcctggtctcaagtggatccacccacctcagcttccaaagtgctgggattacaggtgtgaaccaccacacctggctaattttttgtgtttttattagatacagggttttgctgtgttgcccaggctggtcttgaactcgtgagctcaagcaatcttcctgcctcagcctccaaaagtactgtattacaggtgtgagcccggccaaaatcagtttttaaaagaggtttacatggccgtatggtattctctttcttttttggaaacaatactatttgtaccatgttgtgttatcaatctatgtttggattgttagcatttaagaactacatttttcagtagattgctctaggttatagccactaacaattacttatacataaaaattttcttttgagtcattagccaatttggggggcctctcaggagaaactgcataattcactgggtgaatgcaagttcattgctcttggaggctgtgatagcataatcattgcttgctgtattcatggtcagtacaccttctgatttgtttttagtagtagttttgccatattcaaagaagagctcaatctgaggagactccttgatttgaccttactttggcatagctagcatattaccttaagttagtgtttgccatctattttgttccctgacattctctgttgacgttttatgccccgccccccgtgtccagctcccctcctcacaatccctgccccctgctgccatctttagcactggaaagttaagagttttgatctcagagttcatcaactcaagcttttgctttttatttgtaaaagaaccatgtgaagctgggctcagtggcatacacctgtagtcccaggtacttgggaggctgaggcaggaggattattcgaactcaggagtatgggtccagcctggataacgtaatgagacctccatcttgaaaaagga

SEQ ID NO: 123953 - DNA, 648 bp, Homo sapiens
gtgatgcctcgaaaggtgagctaaggaaactacatttttcagtagattgctctaggttatagccactaacaattacttatacataaaaattttcttttgagtcattagccaatttggggggcctctcaggagaaactgcataattcactgggtgaatgcaagttcattgctcttggaggctgtgatagcataatcattgcttgctgtattcatggtcagtacaccttctgatttgtttttagtagtagttttgccatattcaaagaagagctcaatctgaggagactccttgatttgaccttactttggcatagctagcatattaccttaagttagtgtttgccatctattttgttccctgacattctctgttgacgttttatgccccgccccccgtgtccagctcccctcctcacaatccctgccccctgctgccatctttagcactggaaagttaagagttttgatctcagagttcatcaactcaagcttttgctttttatttgtaaaagaaccatgtgaagctgggctcagtggcatacacctgtagtcccaggtacttgggaggctgaggcaggaggattattcgaactcaggagtatgggtccagcctggataacgtaatgagacctccatcttgaaaaagga

SEQ ID NO: 123954 - DNA, 667 bp, Homo sapiens
ctctggctctggctgtggctatggaactggctacggctgtgggtatggctgtggttatggaactggctatggctgtggatgtggctctggctctggctactgtggctaccggccattttgctttagaagatgctattcttcctgctaaaacatcactgtcagaggaccatttgcttctaagatgacacgtctaaagataatactgattcaaggattcatactccaagatttctatatccaaggattacatgcctgacagagtcttggacctctagcctcacatttctttgaatgaaatcatggccataggatccacggtgtcatctgactgttttccaaatgttatcttttgctcccttaatctctgattctctgttatgactgtgttaatgatcataacatctacaattggggaagtcaatcatttgtaataaaaatggttctttattccaaaaaaaatgtttagtacaaaagagtcaaaaagctaaaataaaatatagtttataaagcaaaaaattatcagtaagctaagtttaatgtattattgaagaaataaaatgtattttatacatttaccctaatgcctaatgtttaagacatctactgtagtgtacagtaatatcccaggccttcacattcactcactaatcactcactgatccaccca

SEQ ID NO: 123955 - DNA, 112 bp, Homo sapiens
atcagttagagtttagtccttaggcccccttatctgaggtttatgcgccagtgaatccttgcccagcaaggagcatgcctttgatacgcaaactaacccattcggacccata

SEQ ID NO: 123956 - DNA, 480 bp, Homo sapiens
tcaggggaaggggtgagggactcggtcattgcccaggcagtgagccccatggctgtgaggacacagaagcccactctcttctcgctgctgttgcaggaaggctgatggcaagaaaggaacccggcctcctactcagatgaggccagggggtggcctccccggggactacctgggactcctgttttacctgcagtctcctggccccacctctagtgagccagtgacccagccgcaggcagctcctctgtctggagacaggacagtggtccaagcaactgcctagcaaggggctgtgtcacagaaacagaggtgatttgaactctcccagcctcagtttccagcctcacctttaaggtgggggtaacgacttttttctacccaagcctcctcctccctggagagttccctgtctttgagttcagagctcctccaggctctgcaacaggccatcctgtcctccccccagcccagcggattctg

SEQ ID NO: 123957 - DNA, 768 bp, Homo sapiens
ggtgctacaaatgtgtgtatggttatttgagtttatgttttcaattgctttgggtatatacctgattggaattgctaggtgatgatggtaattttatgtttaactttttgatgtaccatcaacctgttttccactgcagccgaaccattttacattctcactagcaatatacgaggattccattttctccatattctcaccttcacttgttatttttcacttttgttgtggttgtgattgttatagccaccctagggtgtgcagtgatatctcactatctcactttggttttgatttgcattcccctagtgagtaatgatgttgagaatcttttcacatgttttttggccatttgttgtgtagcttctttgaataaatgcccttttttgaattgggttgtctttttgttgttgagtttgttataattctgcatactaggtgcttatcagatatacgaattgtaaatattttctctcatcctgtaggagttttttcattttcataataatgttctttcatgcacaaaagtttttaattttgatgaagtccaattgattgacttctatttttgttgtttggactaagaatgcattgtcaaatccaagagcgtgaattttacccctatgctttcttctatgaattttatggtttttcttattatatttaggttgttgattcattttgcattaatttttatttgtggtgtgagttatgggtcctgcttcattctgtatgtatagtctcaggactatttgttgaagagactgt

SEQ ID NO: 123958 - DNA, 385 bp, Homo sapiens
gtctataatattatttcagataaaaattttccccggctccccaaccctccttgctgattccttaacatttcataaggagccctttgggatctgagcctgctccccactccagcatcatccctccccttttactttaagcaccagtgctgctgagccagcaagcctcccttaacacacagtaaagtttcacacatcctggcattaactcatgcgagaagtcgcctcacctggatctccactccccattcacctgttaagttcatatttgtccttactcatcaggtgcacctcactggaaagtctgccttgaaacagcattctcagactgacttcagtcactgtctctcccttttgactcctctgcacagactaaactatactatgg

SEQ ID NO: 123959 - DNA, 589 bp, Homo sapiens
acttattactgtggggggaagtaagtgctgtttacataactccactgagagccgacaactgaaagctcttcctggaagtctcctagaccttgacctatgagtctctcctttgagtttaatctgtacccgtttgctgtaataaaccataattgtgagtataacagctttcagtgggttctgtaagtttgtctaacaaattattaataaacttgagggtgttcttgggaaacccctcaaagtttgcaatgaccaagtagaatttattccaggaatgtaaggttggttcaacatatgaaaatcaatcaatgtaatctacaatattaagctgattaggacaaaaaccatacgcttatctcaatagatgcagaaaaaagtttgacaaaggacaaaaaccatgtttatctcaatagatgcagaaaaaagtctgacaaataaaggacaaaaatcatatgtttatctcaatagacacaggaaaatgcctgacaaaatccaataccctttgatgataaaaacactcaacaaactaggaagagaggggaactgcctcaaactgataaaagcatttaccaaaaccccactactgatatct

SEQ ID NO: 123960 - DNA, 549 bp, Homo sapiens
agatttaatcttccgaaatgcctgaccccagaacttcacaacgatcaccgctagctccagggcgcgtcacagatgacgcagctctcccgcgcagcgctcaggaagccgccatcccgtatcgctgagaatctactctgtgccaggcacatgctcggcggaaggcctgggactcaagtacctgtctttggactagacacaatttttgataggaaaaattctaaaatctaaagcagaaacacataactcctttattaaattaaatacggttgctctcagtggttttcaagctgggatgtgctacctgactgtatgctcagaggcccctgaactctccaggagagaatttgaatttatacttatttgtcacagatcataatggaaataaagacactcatttttctgtgttctggggcaggtgctgagagaccagtcatattttcaacgttggagcgatgccactattaaacgttacacacccaaagtgaaacgatgtggcttgtgcagttgagatggttaaatgtggcccttcccccccgcccacagaaacag

SEQ ID NO: 123961 - DNA, 393 bp, Homo sapiens
gacggggtttcactgagttagccaggatggtctcgatctcctgaccttgtcatccgcccaccttggcctcccaaagtgttgggattacaggcatgagccaccacgcctggcctaaagcagctcttactagtcactagggctgcctatcaattgccttaacctggtttttgtttgttgcacttttattcatttgtctttgagatcccctcacttctcctcctaaaagtgctgggtgacatttttgttttttttattgagacagagtctcactctgtcacgcaggctggaatgcagtggcctcgatctctcggctgaagcattcctcctacctcagcctcctgggtagctgggactacaggcacgtgcaaccatgcctggctaattttttgtatt

SEQ ID NO: 123962 - DNA, 632 bp, Homo sapiens
tgccctagccaccactgtatgatcagttttgaatccaataaccagaatgagactgaaaacctgtctctctactcaatcccctccataccttcccaaaggcctcagaagatttcactttccaccaccttcaaggatcactgtgcagcaacctggagctcatggttccatccctgggagggctgcagaaagagccaggagggaagaggatgcagagaagccaggggcaggaaggaggaatgggagagaaggaagtgtgcctgccctaaccaagcccagtgagcgggaccttaagatgtggaacggggcagggggagcataacaaagaccttggggggcacagaaggagtgggagggaggcccctgaggtgagagagagcaagatcccgatttgggtaagaagaggactttttttgttgttttttgaaatggagtttcgctctgtctcccaggttggagtgcagtggcacaatctcggctcactgcaacctccgcctcctggattcaagcaattctcttgcctcagcctccagagtagcagggattacaggtgcctgccaccacgcccagctaatttttgtatttttaatagagacggggtttccccatgttggccaggatgatctcaatctctt

SEQ ID NO: 123963 - DNA, 376 bp, Homo sapiens
gagaagagatcagctaggagtactacagggtttgggtgtggatagtatggctcttattctgaacattttaattctttcctttattttgtgcgaagttttaacacaaatactaaacttgtcaattaaccagttcctaaagagttaatgagtggctaggttcaagaatattctctaagacagataactgaggactggcatgttcaatattcattcccagcaactcctctgttctgcagatgccagagactacaaactacacttcccagactcgcctgcagctaggtgtcatatacaatttaggatccaccagttagatctacaaaagactttgattcagaattgaattaagagggggaaagagtcagggcgtatgcca

SEQ ID NO: 123964 - DNA, 358 bp, Homo sapiens
cctgggacgtcaaggctgcagagagccatgatcatgccactgcactgcagcctgggtaacaaagcaagaccttgtcttgaaaaaaaaaaaagtatatggaaggatgaatgcggagctgagagataataggttaacacccacactaaaaatgtagaaagaaattagtcccatgtttaggtctgtatctcacatcttaactcacaatacactaacttgcctcacaatactgcaaataggaacaaaagaagtggcacagtaatccaaaggcagtctgagttcaaccagagccctgctcaccaggacattttattacacattggagaagcattctaagagattgctgagggtgttctaattg

SEQ ID NO: 123965 - DNA, 754 bp, Homo sapiens
gagggattattgctgtagcgaggaaatattctttttgttaaggaatgataaaagaatgtctaccagtgaggcacctaacaccgcatttgagatttcaggaaactctaaatgcctgtacttaaattttacaaaaaagaccaatgttaccttatagtgtatctgttcagtgcttttggttgccctgggaactatgacagtgttcatttcacatttgtccttggtctgctcagcgggaaggttgaggactggataccagggcctggggcagggcttcctcttcctcagccacataagccaagagaatctcagcattttcctcagtggcttgttcaggaaagaaaaggccatggtttggcaggaaagagcaagtttggcaaccatgctggtcataggaaatatttgtgtgttttcaaagagaacataaatattatatgagatgcagtttgttctgtttttttagaagtgttactgaaaacgtaggtttggatacatcactacagttatgttttgaatttgccagaccttgtgttctgtaactagggcaggatttttgaagcttctttttagttggaacgccgcagcattgcagccacttttcagggtctgagcaatgataggttgtgttctccaacatatcttttctaaatgatcttgtctatcttcacattcgttacttttaagacccagacaaaactaatcattctctaatttgaaagtgttatttatgactattggaagcataaataaaattgtg

SEQ ID NO: 123966 - DNA, 231 bp, Homo sapiens
gacggggtttcaccatgttggccagggtggtcttgaactcctgacctcaagtgatccacccgcctcagcctcccaaagtgctgggattacaagtgtccactgcgcctggcctgaaccaccgcatctgggctccatttttgactgttaacatagtacctatgctttttctctcaattttttatttttattttttctttttcttttctattttttttttttttttgagacaga

SEQ ID NO: 123967 - DNA, 329 bp, Homo sapiens
gagggccaggaccaaggtctgtggggccctttgggagcatggctggtggcatggtggcctggtggcatgctggctgggactgacagcccctcaggctggggctgcataccttgtgggcatgtctggatggctgtgtgtctccatctgagacattcttccctcaccccacatccatgccatggtagcagtcgccaaaatcatagccatttattgagtgtatgctatggccggcactccacttggccgctttatatgcattctcttgggacagccatgggctgtttgtctccagggtttgtgctcttcatcactgttttgtcccccacttt

SEQ ID NO: 123968 - DNA, 772 bp, Homo sapiens
atggttatgggaggtagcaggatctgccagcagccgtcttgggaccctgaaggaaaccatcttgagcgtgaagccggtcacagaggtgggtagagaggtgagatcttgctctgttgcccaggctggtcttgagctcctggcctcaagtggtcctcccattttggcctcccaaagtgctgggattacaggcacaagcctctgtgctcagccctcaacttactcttatttctgactgccatctgtaatgggatacaggctaaggccaaaaagaacgttctttagaaatgcaatgaaaaccctcagcttcccttcaccagatgctccctacatgatactcccagaggctctaactgcctgcttacttagaagctccagagccatgactctctctcaccaggagatcacctcaagagacaacactcaatctgcaacctaaagcatgtccacgatggaactcgctcccacctggagagtatctcgagacaatggccaccttacaacctagctctgcccaggatggcaccagctggaccactcagtagataaggcgacacagtgagtcatgtagaccttgcacctgatcgctccctcccctgtgtgctgctcatgccaggttcctgtttaaaagccctgctttctgcacacaaagggaagcagtacccttaaaggcaggagccagtacatcttcccctaagctaagccttagaataacgtcactttctttacaccagacctcacccctgttcattggactctgcaagcagcaagtgac

SEQ ID NO: 123969 - DNA, 817 bp, Homo sapiens
taaccaaccatcttagaccatcccagaatttttagtgacttaaaaataatggctttttggccgggcgcagtggctcacacgtgtaatcccagcactttaggaggccaaggtgggcggatcttgaggtcaggagatcgagaccatcttagctaacatggtgaaaccccgtctctactaaaaatacaaaaaaaaaaaatggatttttaaaatttgttattattttattattactatttttttgagacggagtctcactctgtcgcccaggctggagtgcaggggcgctgtctcggctcaccgcaacctccatctgccaggttcaagcaattcttctgccttagcctctggagtaactgggactacaggcacatgccagtgaaataatggcttattatttcttatggctctgtgggttggctgtgctcagctgggcagttcttctgctccagtggtatctgctggggttccatgtagctcattccactgggaactcagctggggctgaatacccaagagggcttcactcatgggttagaactgcaacacagttaactggatctgtctccaaccatggtgcgatctgaggactgaaaatggaagtagccagccttcttgagggtgaggctcagaactggcacagcagcacttctgctcattccattgatagagaaaatcacaggccagccaatattcaaggggaggggaagtagattccgcttcacactgggggctgcagcccgtacatacagggatgggagaaattttttagtgcccattttttggtagcactgttacacatgaatagaaatataggatc

SEQ ID NO: 123970 - DNA, 151 bp, Homo sapiens
ttcatgtccttttttcataattcttttctcttcatttttttttattgtgacctctcattcaaggatttccccccttttctttctccttttgtgaaacctcacttcagaattactgtgaaagccttcatggttttctccctgctttcagtgg

SEQ ID NO: 123971 - DNA, 294 bp, Homo sapiens
aaacactagtatccgtgcgctactactacaggaaagggtaaagataactattacaagggcctagtagaaaggccaggagcaggagtgcttctgttttctttcattaggaaatgaataaaatccaaatagcaatatgtaactttgaataaaatgcagaataaccaaaacgtcaaagacactttttaaaaaattaaaaagggaaaacattcccatggtataagctttgaatttttttttttttttttttttggaaacggagtctcgctctgtagtccaggctgtagtgcagtgggc

SEQ ID NO: 123972 - DNA, 271 bp, Homo sapiens
aggaagtcccagtggaaggaatgtgctctctattccttcctgtatctcaaaacagttcactaattttctcttcagctatgtctaatctacaacacaaactatccattaaatttttattttttattttttttagagacaggggtctcgctctgctgcccaggttggagggcagtggcacaatcccagctcactgcaacatcgaactcctgcactcaaggaatccttccgtctcagcctcccaagtagtgggaatataggtgcacatcaccat

SEQ ID NO: 123973 - DNA, 280 bp, Homo sapiens
cgtgaacatgtcactgggggttagacaggaatgcttatggggtctggtggaaggcaatatggaaatgattcatagagcaagaaccacttgaattcagtcttgaaaagaagctccactgggaaggtgcattacagaccttgcacaatgaaccaaaccatggagaggtgaacctacacgtcaagtgggaactgcccaacactggccatacaatctgaaaatggcattttcaaataatttatggataacatcctaaaaaaggactgccgattgtcacactcca

SEQ ID NO: 123974 - DNA, 482 bp, Homo sapiens
agaactagtgggtatcaaggtaagaaaacatgttgagaaatttgtagcaggaatggaatcttacaattgaggggagtcaaacccactggcctcagatttctaggtgaaggagagatgatctcttaataatgaggaggtagaaatgggcattgagtaaaagggcttaaggaaactggtaaaggtttggaatactgaggggaaaggaaagagatggtggaagaccacggaagcatgagtcagtagtactgagcactcaatggtgcttggaaaccacaactatagtggtaacagtctgtatttttttatccagcaatactcagctccctgtgtgtagaagcagagaaggtagattgcagttatttttccaaggctggcattttactgggtagatactgctgaaggaaatacagggtgcagatagttcagctggtcaataatccatgattcaggttggatagggaaagaaggggggttaggaggga

SEQ ID NO: 123975 - DNA, 217 bp, Homo sapiens
tggggtctcactatgttgcccaggctggtgtcgaactcctgagctcaagtgatcctctcacttcggcctcccaaagtgctaggattacaagcatgagccaccatgcccagccacatcatgtaaagttaatcaaaataatacctaatgaatttctaactctcacaaagatgctaagcttagttttttcccctgccctaacacttcagtgggaatttta

SEQ ID NO: 123976 - DNA, 422 bp, Homo sapiens
aactgttttttgctacctcacttaataaactgagctccaccatgttccaggtcccatgcctgtcaccggggtcgaactaaagtaagactgagccttgccttctacatgctcagagcttaaatccccaaatgcattgtttgttatttctttgagtaaactctttcttcagaccagctggctacactcaatttcctgatggccaccactcctcccctcccatttctcctgcgtagattttcttctctccagttcccacaaatcccataaacttcatcacctggagggcctgtatcccctgaccagcaccatcctcagcgatttttatttcgacactgaaaaacagcctatgctttttgtatatcacaatgcatctgggtttgaatctgacctttcctctatttacctcctccttcatttctctc

SEQ ID NO: 123977 - DNA, 294 bp, Homo sapiens
gagctttgtgagatgccctagaaaattattgagcatgagaagaagatcccaggcaactctgatttgtagccaagttagacagaagttgtggataatctgtaaatctattaatatggtttcgatctgtgtccccacccaaatatcatgtcgaattgtaaaccccagtgttggaagtggagactggtgggaggtaattagatcatggaagcaaatttcccctttggttctcttcctgtgtgtattagtctgttttcgtgctgctgataaagacatacccaagactgggtaatgtac

SEQ ID NO: 123978 - DNA, 308 bp, Homo sapiens
gccgactctatgaggatcccctgccatttaccccatggccagaccgggagagcagggctgcggcgcaagagggccaactgccaggcggccggtgtgtctggctttcagaatccgggtcattgaaaggctttttaccttttccttctgggctggaaagtacttgccttacccaggccccgtcacccgcacagcggtcgtcgtgattatccctgccggcagggtgttgcagcattgaggaatcgcggttctttgctgcctccctccgctgtggagcccaggctttcgccctccctagagctcctgaggcc

SEQ ID NO: 123979 - DNA, 366 bp, Homo sapiens
ggatcattttctgtctttgctagatactattcatcgggcaaattatcattgtttagaaactttgcagtttatcaacttgtagaatcagtgttgccgagtggcccttggtctcaagactggggctggatttggacaagtaatgaaaatgtttcacccagagggcaacatgcaactgagtttttatatagttaatctggcatcctgtatgataagaaggctaagaaatgcagaaattctctctgctaagtatgaattcacattgagctctcatacaccaaaatcttttattcatacttaatgttttctcattcttatatatttcatctcgtgaaattttaaatttttaattagcaaagaccccaaaag

SEQ ID NO: 123980 - DNA, 322 bp, Homo sapiens
gggctcacctcctacctctggcctctcactctctaccctcccagccacatgttcctacctattattgcttgaatgccctgcttgctcctacgccagggcttctgccttggctgcctctgtctgcaaccctctctcctctggatactaacatgactcactccctcacttactttaggactctatttaaatgtctgtcagagagatctcctctgttcaccctctatataaaaaaagcaaaacacatacacacatagaggcactctacccacttgaaagtacttattctggccaggtgtgatggctcacaccagtaatcccaaca

SEQ ID NO: 123981 - DNA, 272 bp, Homo sapiens
gagtgtaggtctcaaggagtttggattaaccctcaaggtggggcagcctggggatttgcccttcttcacctggaagaagagtccctgggggttgagctttatttttttattttatttatttatttatttatttatacggagttttgctcttgtcacccaggctgaagtgcagtggcgcactctcagctcgctgcaacctccgcctcccgggctcaagcaattctcctgcctcagcctcctgagtagctgcgattacaggcatgcgccaccat

SEQ ID NO: 123982 - DNA, 530 bp, Homo sapiens
agctctctctgtggggtggtgctctctctgtggggggatgacgctctcttgtggggtggtgacgctctctctgtggggtggtgacgctctctctgtggggtggtgacgctctctcgtgtggggtggtgacgctctctctgtggggtggtgacttctctttctgtggaattaaatatatgcttctagacttaaagatgacaatatgcatccttgacttattaaagttcaatataaattagtacttttttcaattcctggactatgttaaggacattggaatgtgtcaactcccttttcctccttcttattttttgtgtattattttaattctacatatattctctctcaagatattattttatacagtcagtattaattttgattttcccatgtgtttaccctttacaatgctcttcattcctttctgcaactccttgcttccatctgaaattcttttccttttacctgaaaaactatttagtttttcctttagtgtctgtcagctacttataaaccatctcagtttttgt

SEQ ID NO: 123983 - DNA, 1423 bp, Homo sapiens
attgctccttttatattatcaagccaaagatagagtagatcctctcagccaaatatactaggagtcacataaaaattgctatgaaatttaccaaaaactaaggacttcattatttgttaaaaatgtgttagaatcacattaatagaatgaaagggagggaagaaaacacatgatcatcttaattgatgcagaaaggcatttgacaaaatccaacaccctttcatgatttaaaaaactctcagaaaactaggaatacaagcgaacttctcagcatgataaagggtgttcatgaaaaacccacagctaatatcatattcaatggtaaaagactgaaaactgtcctcctaagataaggtacgaaattaggatgtccactttcaccaataatcaagaccttagtttttggcaaatgacgtatacataggaactcccaaagaatccacaagaaagctagagctactaaattaattcagcgaagtttcaaggtataagctgaacacacaaaatctgttgtctatataccagcaaagaataatacaagaaagagattaagaagtccattaaaatagcatctaagaataaaacacccaggaataaatttaacagaagaagttcaagacttgtacactgaaaactataaaacattgctgaaaaataagacctgataactggaaagacatctccacgttcaatgataggaatagttagcatcgttaagatgtcactactagcaaagtgatctacagatttaatgcagtccctaacagtattccaatagctttttttgtgaaagtggaacagacagtactcaaatccacaagaattgcaaggggactcaaatagccaaagcaatcttaagaagaatgaagttgagagattgacattactcaatttcaaagcacaccacaaagctaagcaatcaaaagcattgtggtactctagcataaggataaacatacagaccaatggaatagaattgagttttcagaaataaacccatacatatacagccggtagacttttgacaaggctaccaggttcatctaatggagaaagaatagtctcttcaacagatggtgctggtataactgtaagttcacattgcaaaagtaggaaattggaccccaacctcatgccatataaaaagttaaaatggctgggtgtggtagctcacacctgtaatcccagcacttttggaggctgaggcgggtggatcacttgaggacaggagttctagaccagcctggcccacatggcaaaaccccatctcttctaaaaatacaaaaaattagccagccatggtggtacacctctgtagtcccagctacttagaaggttgaggcatgagaattgcatgaacccgggaggtggagggggcagtgagccaagatcacaccactgtactccagcctgggtgacaaag

SEQ ID NO: 123984 - DNA, 329 bp, Homo sapiens
tcttgaaatacaattgattccatcctccatcctgaaagaaactaagcttcctgtcaaaacatggtgatgcctagagaccaggaaagtgcccgtttaggacatggcatgaaaccagccaggacatcaggggctaactttcaggcccactcacatcaggccacctgtctcactgagttactcatttattctcctctgtatcctagttggcccaaggaagccacagcagaataatcaagagattccaaaggagaactccagtgagaacattatgcattcaacatgctcactgagagaagattatttcttttcctttttttttttcctgagac

SEQ ID NO: 123985 - DNA, 356 bp, Homo sapiens
tacatgccagaccctcttctgggggtatacagcaaacacagtcctaagtactcacattctagagggaagagaaagtcaacaaacaaatagatcatttgtcaacaactgataagttctttgacaaaaagcagatgaagagtttatcagtttcagcactgttggcattttgatggggatcttttgctgttggggctgacccatgtattgtaggaagtttggcagcgtccctggcctctacccactatatgtgccaaagcagctccctccccaagttgcaataacaaaaaatgtttgtagacattgtcaaatatctcttggggggtattattgcccccatttgagaagtactgggttgg

SEQ ID NO: 123986 - DNA, 269 bp, Homo sapiens
tatagccaaggctaaaagccactgcatgaaaccagaggggcccaacctgtctgcacattggaatcaccttggaatcttaaaattcccacaatccaggccacagctcagatcaactaaacgccaatctctggcggaggggtgcaggcaattcgcagtttctgaagccccccaggtgattccaatgtgtagacaagtttagtagccactagcacacaccactcgttctgaatcctagctggacactgggattacccaaaaaacatttaaga

SEQ ID NO: 123987 - DNA, 485 bp, Homo sapiens
ctcgctgttgcccagcttggagtatagtggagtggtcacggctcactgcagccctgaattcataggctcaaatgatcttcctgcctcagcctcccaagtagctgggactacaggtgtataccaccatgcctgcctagtaaaaactgtttttgtgtcacccattgagtttgagatccatggagtggagtagacgaggtgagaggtgttcagagtctgctgggctgatctgagtctctttgagatgggaccatatggagccagcctagtctgtttctctttttcacaatatgagacttaacctctctgggctggtctgaagccagctactggtcatgtcctttgacattgctaatacaaagctgtaggaaaatctattttcctcatgggtgcacttctctttggcaagggaaaggggcctaactgttcagtggatattgcacttgtctttgtttcactctgcctgccaactcctcagggttttcctt

SEQ ID NO: 123988 - DNA, 522 bp, Homo sapiens
gttgaaggagaagggagaggctggatccagattaaaggtttgtgactgctgatgaggctggtaatattgataacttcatgcagaggtttatggtttctaaaatgctttaacacattttttttaatgtgctaaatggtagatgttctttttaattttaatttgagtttttagttttgaaaatctcaaatactcggaagagtatataacagatccttatgtgtgtagttgccttcagaatttaacaggtgttccttttgttatatttgcttcagggttttttctctctcttcctctttaaagtaataaaacatctcagatacatccaactttctttgccctctctgctccccaggtaaatattatcctaaagttgatgtgtatcattcccatacatgcttttgtacatttacagcagatgatctattcataaacaatatgtactgttgcttgtatgtctttatatttgacacacatagtatctttggtatatcctttctttcatcttttttcttttttcttttt

SEQ ID NO: 123989 - DNA, 324 bp, Homo sapiens
catttaccccaccagattcaatccatccttcttctttgggatcaggaagaagactggaagggctcaagtttgtaatcctagcactttaggaggctgaggcaggcggatcacctgagatcaggagtttgagagcagcctggccaacatggcaaaaccccgtctctactaaaaatacaaaaattagccaagtgtggtggcgggcacctgtaatcccagctgaggctgaggcagggagaattgcttgaacccgagaggtggaggtttcagtgagccgagatcacaccactgtaccccagcctgggcaacagagtgagactccatctc

SEQ ID NO: 123990 - DNA, 663 bp, Homo sapiens
gttataccaatgaaaaaaaaatcttatttccaagtgacccatgaaattccattccatattttaaatgtgtcacattggaaatgccacttttttctccattgtatttttgttaccctaacccatgccctcaccatctgaggactgtgtgtatttttacagttaatagctctcatactcactggtttgtggaaactgagcatttcccctttatccagaggcagttgtggtaagtgtcttgttttcttcagatcccaaccacgggtctctaaaggtatctaagatctgtatggtcacatctgcttttccaagtaacagctagaaatattttaccatgccttcactatagctaggctataataaagtttacaatcagaggctgggcacggtggctcacgcctgtaatcccagcactttgggagggctaggtgggcggataacctgaggtcgggagtttgagctagccagaccaacatggagaaaccccatctctactaaaaatacaaaattagccaggtgtggtggtgcatgtttgtaatcccagcttctcaggaggctgagacaggagaatcgcttgaacccgggaggtggaggttgtggtgagccgagatcacaccattgcactccagcctgggcaacaagagcgaaactccgtctcaaaaaaaa

SEQ ID NO: 123991 - DNA, 124 bp, Homo sapiens
agagaccccctggggggcatgtgtggaggggaagcgtttctcactttgcattatcagctgagacctgggggagtggagatgcaaaggccctgaggtgggagtgagccaggatgtcagtgtggct

SEQ ID NO: 123992 - DNA, 2371 bp, Homo sapiens
  misc_feature (786)..(786): n is a, c, g, or t
  misc_feature (1236)..(1236): n is a, c, g, or t
gtgcatcattttaggggttacatgatgttgaatatgtcttaggattggtagtgttaaccatgatcatttggttaagatactctctgctgggttttttcactgtaaaattaccgtttttcccttggtgcttaataaagattttagaagagatatactctgaaactgtgcaaataccctgtttttcttcaaactttcacccactgattttagcatccattggtgggtcttgctggcatcagttactgcttaatgtttgtctaatgttgattttctgttttcttcatttcttttacatttattgattggaaatcgtctgtagggaagatctgtaccttcctgatatatttattgatgattattaattatttatagctgtggactcattattaataaatgagggttttatgagtaatacttgtaaaccttaggagaggaatgttgatgtatttaacttgtaaactttgttttcagcttcttttgtgttaggtaggtacatgtatgcttgggtgtaggataaatagcaatgctataataatactgtatatattgttatatgaagattgcattttatttcaagatttcctttggagataacttttaaaacattgagatttcaaaccacaagatcactaattacttgcataacacttagcataattttctcctaaacgatatcatggtctttctatagttaacactcaaggtgattttctttattgttctctttgccttctttattttgaatttgaggcacttagtatatttttttataagttatagccacanatcagtacttaccagcatgataagcagttctttactataaaattaaagtttgtaaaccattaagtgtaatttttggtcagaccacaagtcctgttgcttttttatttagttgctttaaaaattttttctaaacatacagaataacaaccgttaagatctcatttttctctccacctactctctcatttgtttcttaaactcccttttttttcagcctgttttttgtatccttgttagagagaacagacatatattgtccctgaatgtacatttaattatattcttcatgtaattacattatgtaattacaactcaatcacctaatttagcactgcttaacacatgttaacttttgctttttgttcgtttttgagacagggtcttgctctattacccaggcttggagtacagtgacatgattatggctcactgcagcctcgacctcctagncttacatcattctcccacctccaccaagtagctgggactgcaggcgcatgctgccacatccagctaattttttgtattttttatagagataaggtttcaccgtgttgcccagtttgctgtcaggcttctgggctccagcgatctgctcgcctcagcctcccaaagtgctgggattacaggtttgggccactgctctggccacatattaactttcaaccagtcatggtagctgttgttaatattttaatatataactctccagatcttttctatgcacatatactcatttttaaattgatacataatattcatactgtatgtactgttctgtatgtaacttgctttctgactttatgatatctagtttttacactctcattaaaagatgacagacatggaaccagcatggaaaacacaattaaaggaagtttaagaatcaaatgcaccagctatggtagttcacacctgtaatcccagcatttggggaggccaaggcaggaggatcgcttgagcccaggagtttgagaccagcctgggcaacatggtgaaaccctaactctccaaaaaaatataaaaattagccgggtatagtggcgtgtgcctgtagtcccatctgcttgggaggctgaggcaggaggatcacttgagcccagcaggtcaagattgcagtgagccacaatcgcgccactgtcctccaacctgggcaacagagtgagaccatatctcagaaaaataaaaagaatcaaatggattcttaaatttatggaggacttccttacaacttttttttgacctcgtgatccgcctgcctcagcctcccaaagtgctgggattacaggcatgagccaccacgcccagctgcaaatttttttattactgtactggtacgtgctttttatatatttgatctatttctttgcatcagatccctagaaataaaatttgggggacaaatgatatacagatttttaagacttgatacgttaatgccaaaatgccttgtgtggccaggcgcggtggctcacgcctgtaatcctggcactttgggaggccgaggcaggtggatcgcttgaggtcaggagtttgaaaccagtctggccaacatggtgaaatcccatctctactaaaaatctct

SEQ ID NO: 123993 - DNA, 2470 bp, Homo sapiens
  misc_feature (786)..(786): n is a, c, g, or t
  misc_feature (1236)..(1236): n is a, c, g, or t
gtgcatcattttaggggttacatgatgttgaatatgtcttaggattggtagtgttaaccatgatcatttggttaagatactctctgctgggttttttcactgtaaaattaccgtttttcccttggtgcttaataaagattttagaagagatatactctgaaactgtgcaaataccctgtttttcttcaaactttcacccactgattttagcatccattggtgggtcttgctggcatcagttactgcttaatgtttgtctaatgttgattttctgttttcttcatttcttttacatttattgattggaaatcgtctgtagggaagatctgtaccttcctgatatatttattgatgattattaattatttatagctgtggactcattattaataaatgagggttttatgagtaatacttgtaaaccttaggagaggaatgttgatgtatttaacttgtaaactttgttttcagcttcttttgtgttaggtaggtacatgtatgcttgggtgtaggataaatagcaatgctataataatactgtatatattgttatatgaagattgcattttatttcaagatttcctttggagataacttttaaaacattgagatttcaaaccacaagatcactaattacttgcataacacttagcataattttctcctaaacgatatcatggtctttctatagttaacactcaaggtgattttctttattgttctctttgccttctttattttgaatttgaggcacttagtatatttttttataagttatagccacanatcagtacttaccagcatgataagcagttctttactataaaattaaagtttgtaaaccattaagtgtaatttttggtcagaccacaagtcctgttgcttttttatttagttgctttaaaaattttttctaaacatacagaataacaaccgttaagatctcatttttctctccacctactctctcatttgtttcttaaactcccttttttttcagcctgttttttgtatccttgttagagagaacagacatatattgtccctgaatgtacatttaattatattcttcatgtaattacattatgtaattacaactcaatcacctaatttagcactgcttaacacatgttaacttttgctttttgttcgtttttgagacagggtcttgctctattacccaggcttggagtacagtgacatgattatggctcactgcagcctcgacctcctagncttacatcattctcccacctccaccaagtagctgggactgcaggcgcatgctgccacatccagctaattttttgtattttttatagagataaggtttcaccgtgttgcccagtttgctgtcaggcttctgggctccagcgatctgctcgcctcagcctcccaaagtgctgggattacaggtttgggccactgctctggccacatattaactttcaaccagtcatggtagctgttgttaatattttaatatataactctccagatcttttctatgcacatatactcatttttaaattgatacataatattcatactgtatgtactgttctgtatgtaacttgctttctgactttatgatatctagtttttacactctcattaaaagatgacagacatggaaccagcatggaaaacacaattaaaggaagtttaagaatcaaatgcaccagctatggtagttcacacctgtaatcccagcatttggggaggccaaggcaggaggatcgcttgagcccaggagtttgagaccagcctgggcaacatggtgaaaccctaactctccaaaaaaatataaaaattagccgggtatagtggcgtgtgcctgtagtcccatctgcttgggaggctgaggcaggaggatcacttgagcccagcaggtcaagattgcagtgagccacaatcgcgccactgtcctccaacctgggcaacagagtgagaccatatctcagaaaaataaaaagaatcaaatggattcttaaatttatggaggacttccttacaacttttttttgacctcgtgatccgcctgcctcagcctcccaaagtgctgggattacaggcatgagccaccacgcccagctgcaaatttttatatccaagtttctataatctttttttttaaataaatgtgcagtggcccactatgtttatgtggcataatttgttttcaatgttttgacatttaaaatattattactgtactggtacgtgctttttatatatttgatctatttctttgcatcagatccctagaaataaaatttgggggacaaatgatatacagatttttaagacttgatacgttaatgccaaaatgccttgtgtggccaggcgcggtggctcacgcctgtaatcctggcactttgggaggccgaggcaggtggatcgcttgaggtcaggagtttgaaaccagtctggccaacatggtgaaatcccatctctactaaaaatctct

SEQ ID NO: 123994 - DNA, 144 bp, Homo sapiens
tccttttcttctgtgagggacaggccttccttgggaagaaaggtcaccccttgagtctgacatgctctgcagtcaatttgagaagccttttggttaattttggacaagtcaagcctggtggtggaattcggtcccatttagcat

SEQ ID NO: 123995 - DNA, 178 bp, Homo sapiens
catgagccaccgtgcccggccgatcaatcccttctatctatgttgctatacccaagtaactgcataatctgagggctgagaaccagggctaagtaagataaaggcttgggagcctaggagttacagaaaagggcctggattggaacaattagccaatctaaggtcatataatgtcaaa

SEQ ID NO: 123996 - DNA, 453 bp, Homo sapiens
aggggaagaggcactgtaggcaaagggtgcagcatatacaaaagcctagaggtgagtccttggggaaatgtgtggtgagggataccaaaatgtgagcctgaagaggaaagaagagaccagagcataaaggatgaggcttaggcattaggtttctctcccaaaggcctgcctgagtgcttcacacataggaaggctcaactaatatatgccaaattcaatggttacatctttagaaatgccatttcatcactggtaaagtacataaattcaagctattctatctactatactactactactactactactacttcaagaacagaggtaactctataggcattggagaaaagggcaactcatagtctcaggaaacctattagttcctaacatcccacttgattacgcttaagtctccttgaacctaattcacaccaatggcatttagcaaatagg

SEQ ID NO: 123997 - DNA, 425 bp, Homo sapiens
agtttccagagcacataatttatagttatgagtctacagtgtcaacctatttttaatccaaagaaaaaagattgcatgtatatttatttttcaagaagtaaaagttaataggagagaagattcaggatatcttgtttatacataaatttacatgttgaattatctatttgcagaaggtagaatttacattttgacaaaaaagtgttcattagttttaatttctgctgatgttgaaaataatccaaagtacaaaagcaaaaaaaaaaatgtgtgaactcttgaaccctccctgaggttttttatgtttgctgatgtgtaggcacagtgatggtgtcaggtgttcatggctgtggaattggatgtacagaactaaagactccaggggtcctattggcagctcatgatctggcaattggtgaacatta

SEQ ID NO: 123998 - DNA, 617 bp, Homo sapiens
gtttcaactataaaagtgagctcttttcatttttttgccccttgagtatgaaacatatgttaaaagctgaacgtattcataatttcagtttgttagtatttttgtataagtgtactctgtaagtcacatttttcgattttcaagtatagcagtcccccttatctgtggggaatatgttccaagcgccccgtggatgcctgaaaccatggatagtactgactctatgtgaattgtttttcctatacatgcatatctataataagttttcatgtctacattaggcacagtaaaagattagcaacaacgaataataaaatagaacaattataacaacacaccgtcataaaagttatgtgaatatagtttctctgtctctcaaaatactgtaatattttcagaccacagttgactgcagtccagcctaggggatagagtaagactctctctcaaaagaaaaaaaaaagtctttaactattttgtatagaataatgacaaatattgttaccaaaggataaaaattaaagaaaatgcgtactgcagattaacatacataaagactcaaaatggaatcaagtgtaatcgcacatgacccatttcagagtcatttcttcccattg

SEQ ID NO: 123999 - DNA, 113 bp, Homo sapiens
atctttgatggacttagctgtgcagaacagatactaaatgcatcctcattcttctcataatcaaaagtttttgcttaagctggatgggaaaaagagaatcccatttcactaag

SEQ ID NO: 124000 - DNA, 461 bp, Homo sapiens
cagaggtaaggatgtggggtttcactaaaggagctccccatttggccagaggaaggagtcacaggcgaggacgtgaaaaactagaaaacctcacgggagccatgaaaaagactaactgtgattctggaggtatttaaaatgcatgaggttggtttatcatgactttagaaacatattcatctgagatgaaccaacagtaaaggccggggttgcatttactgtggcaacatttacaacacaatattctgacctgaactctccatagcatttccctaaggaaaatatgaggagcctaacacaatgatgagataggcaactgtttagcaaatatgctcacgcttcagaaacactgaaggaagtgcagtgaaatttgtctctgaacttagaagattaaagtcactgtctccagttgaaatctacatgatacttttcttttgtctttttttttttttttttttttt

SEQ ID NO: 124001 - DNA, 398 bp, Homo sapiens
ccaggctggcacaagggttccgttcaactcctcctcccatgcagagttccttctgccctcatccttttcttgcctctttcctcaaaagggagctagaaggcagaattatgtattcttagggcagaagagaagaagtcctgatcttctaaaaagaagttatataaagaaaccatttttattgaattgtgtagcattgtgacatgctattcaatttttactttttattttactcttaccttaacatattagaatagtccatcagacaaatgcattggcagcatttttactattccccaaacatgctgctggtcatgtgatgcctatttagaaatacactttttttttttaatttttattttactttaggttctgggatacatgtgtagaacgtgcaggtt

SEQ ID NO: 124002 - DNA, 455 bp, Homo sapiens
actgagctacaccacaccctggtaaaagggaaaatcttagtataaatttcacatacacctaaggctttcacatacacctaaggctttcacatacacataaatcactggcctccactaaactgaactacaccacaccctggtaagagggaaaatcttagtatacatttcacatacacctaaggctttcacatacatttcacatacacataaaccactggcctccacgaaactgagctacaccacaccctggtaagagggaaaatcttagtataaatttcacatacacctaaggctttcacatacacctaaggcttcacatacacctaaggaaacctaaggcttccctcttgttctttctccctcttctcctccttcacctctccctccactcttcctctgatctctctttttcaaacgttatggtttgttgttccataccaactgcacatttggca

SEQ ID NO: 124003 - DNA, 614 bp, Homo sapiens
gcctccagactagctgggactacaagtatgcaccaccatggctggctaattctcctggctcagcctcccaagtagctgggattacaggtgtgcaccaccatgcctggctaattcttctggctcagcctcctgagtagctgggactacaggtgtgcaccaccatgcctggctaattcttctggctcagcctcctgagtagctgggactacaggtgtgcaccaccatgcctggctaatttttgtatgtattgtagagacaaggtttcaccacgttgcccaggctgcagttacatttttacttgaaaatcgttcatttctaatgcctttttaattttttaaatcagaaaagaacaaatttgttctgccagactattattaggttcctaattctgtgaagctgtgacctggggtaaaggttaatctgtagttagcttaaaaccagtttcattactagcctttacagtatactttggtatttatccaagatcggggtgctggctttttatgtgaaaggccagaaccttaagtagcaagaaaaagtagtccttaacttttcattaaagtataacatgaatattgaaatgtacatttatgctcaaggaacaccattttacc

SEQ ID NO: 124004 - DNA, 748 bp, Homo sapiens
agtttgagaccagcctgggcaacatagtgagaccccatctctacaaatttttaaaagaacaggtaagtttaactaaatgttgttgcataatttgaagagaatagatgataatgtagaactaaaatctaagatgatccaatgtgtgagggtaggagccaggaaaaaataagtactaaagttctcgcctcatttgtcaagaggctaatgatcctgattacatctagatgctgatagaaaaatacgagtatacacacacatacatatatagcataaccaatagaagaacggaagtaaaacctcaaacttcctaagcaacacctcaaacttcctaagcaacagaggaaaaacaggacaaagtaaatgaaaccaatccaacaaaaggcaaaaataaacttaacaaaaataagcaaatataataaaaagtaggcatgaaataagatggctgaaataaatctatgactcatcacaataaatgcaaatggattaaatccatctattaaaagcagatactaaatacaaaatccatttgcctgccttctttcaaagacacatataaagcaaaatgacagagaggatgaaaaatggaaggataaaaagaacatgccagccacatggtaaccaaaagaaaagaaatgcatctacaaaacagaattcaaggccagatcatgaaacggacaaagacagagtatttataatcggaaaggtacaagcatcaagaagtgccgcagtcatcaatcataagcatcta

SEQ ID NO: 124005 - DNA, 184 bp, Homo sapiens
gacagagtaaaaatctctcaaaattctctcctatcaaagcaacgagaaagctacccaaattggtgaaatcaactttttaaactttggaaattaatcaaagatttacagcaatgcagaaagcatttattcatgaaaaatggatgaatctcagcagaaacaggaactttgtggtgcttttccatgc

SEQ ID NO: 124006 - DNA, 260 bp, Homo sapiens
tatatttctatgcctggtgttgtttgtttgacacaagtttcctttcataggcatcctgagatgtactaaagacatatattttcaagttggaatgacagtggcatacatttaaaagaggatttatttgaggctaggttgattgtataccacctagtttttataattatgtatgtgtcttcctcctctccccactagaatgtaagcctcttgattatcagagctgtgttttacactcaataccttccataaaacctgacagc

SEQ ID NO: 124007 - DNA, 559 bp, Homo sapiens
gaaagtcctgagaagtcccaccatagtacctttgtttaatccaatattttataaatgaatttaacataacctctgtttaagacatgctggcttactgtattttatctattcaaagatgcacacttttttcacgtttcgacatctctgacgatgagatgtggcttagaattaaaagtagctcctcttctgagctctcattctgcgattcttcaataagaaccaatgctaactttcagccccaacatggcccctccagacaggtggctcaaatgtgcaaaaagataagaatgcatttttgctccctgcctacacatgcacccaacaaatattcatgagtgagcatctcctgccaggcaggagcactgaggatacaacagtgtggaaggcaggaatgggctttcctcatggactctggtctagaggagaaacgaatcataaataaggcaacagaaaaagagctggcacatgaagataactgctacagagacaacaaataggtaccatgagaaagaaactcacttcgtatgctaatcaaaggatgaaaactaagtacctgggg

SEQ ID NO: 124008 - DNA, 398 bp, Homo sapiens
cagcagggaaacaaaatctgtatacatctaaacatacgcatacattgatgtgttatgtatgtgtgattttcagatgttgtcacaaaagttgtgaattatgcttattcttgtgctttattggcatttaaagcaaggcattcagcatttgcttactatcaatgtctcatgatgttcaggctctcagcagtgaccagaatgatcttactgtgataatcacaaaatcttgcctctgtttcatgttaagattgttttcaaaaggatttgacttacactttgatagtaatagtagtttatgactaataaaaatggagaaatgcttgaaaatattaactcaagtaatagtgctggttagtacaactcttaatacgtgactatgtcttttctctctctcatataag

SEQ ID NO: 124009 - DNA, 162 bp, Homo sapiens
gagcctgggaaagtgatttttaaatttctatattgggtggtactcttggtacatcacgactcataggatgggaattcttcaaacatgggaaataactctctatattccataaaacctgtacaatgtcataataaaaatgatgtacttaatttttaaaaagtt

SEQ ID NO: 124010 - DNA, 199 bp, Homo sapiens
atttgttaaatattgaaaccatattccttcaacatcctaatgaagggaactattcactaacgtctctatacgttgatttataacattattctagataatgcattttaagttaacttttgtaaaaaaaaaatcctaagtttttctttttaagaatatttgcttgggcttcatctaatttttaccttatcccctgaaatta

SEQ ID NO: 124011 - DNA, 610 bp, Homo sapiens
acaggtgtgagccactgcgcccagcccctgctgcactttaagcagagagaaaaacactgtagtcataagagctattaaatacagtacataattttaaaacatttttgaaacacagaaaacacatacttttttgatctcaggaaggaggaggagttagtaggggaggctaaaagggaagttgcacccagtttgggtctaacatgttgtggtagtaacttgtgttcttcatattataggtaaagaagtcattgactacttttaaatagggagattaggtggtcagtgtagagttgctgggtgagcagaatgcataaatgtgcctgattaactaaagatggcaaggattatggatattcaaatagcctttcccacctctgttgatgaattggtagtaacctacatcctgttggtaagtagtcagtctagctaggaatgggctatccaataaatattgtgagaggaaaatggaaagtagttagatattacatttgaagaaaaattaataatttgaaatgcctctagggagcttgtaaaattggtaggatgacagtaacttaaacagaaggaaaagaaggcaatgggaaataattttgagagtctccgtcgaact

SEQ ID NO: 124012 - DNA, 360 bp, Homo sapiens
acaggtgtgagccactgcgcccagcccctgctgcactttaagcagagagaaaaacactgtagtcataagagctattaaatacagtacataattttaaaacatttttgaaacacagaaaacacatacttttttgatctcaggaaggaggaggagttagtaggggaggcttgcacccatccatgcttctgagcgtgcactcacacatgcatgcacactaccactcattcacatacactcacacacacttgcactcatgccctttacactgtgcacattcagatccacaccatgtacactcatacactggcaaacccacacatgcatcacacacctacacttgcactgtcacacgcacataca

SEQ ID NO: 124013 - DNA, 371 bp, Homo sapiens
actttagggggtcaaggccagaggattgctggagaccagcctgggcaacacagtgacaccctgtttctacaaaaatttttttaattagctgggcgtggtggtgcacacctgtaatcccagctcctctggaagctgaggtgggaggtcaaggctgcagtgagctgtaaatgcagcatggcacttcatcctgggcaacagagcaagaccctgttttctttaaaaaagcacaccaaaaccgtgtcttactcattctgcctttataaaattccaggcccaggttttgttgttatttaaagagtctatggcttttttggataaattgcttaaaccagacacttcacatactgacatgtgagaagcgaaggttaatt

SEQ ID NO: 124014 - DNA, 458 bp, Homo sapiens
gtgaaaccacctttccaaaaattataacaggaaattatgacagtgaaagagatcagacctaactgactccatcttgcttctaacctataagctgtccttgttcattcctgggcagaggccaaactaactttggaaggaattcagttcatggtttgactctgaaacaaaattgataacagccctttcccaaaaagacccccttattgcctggggaccagtctgcttttgtaggcctaacaaattagctataatattagacattgcagtttaggggtcatgcagcctctgactccaagagtctgaacctccccaaattgctcctgggggataacatcactattgtaaaacctaagatcagtgcttgagatattttgtagaccctgcactcgatggatcagctggcaccacccagacccgtaatctggctcacccagttctgccatcccacccaggaacag

SEQ ID NO: 124015 - DNA, 286 bp, Homo sapiens
cgccggcgtcagttccgctgcctggcttgcccggcgtcctcgcctcgcctctgggccccgagccgtgccggagcgacgtcggggcaggagcggccggcgcggaggacgccggggaggtgtccgggagccgggccacatgcggcgggctcggccgtaccccgccgggccgtgccggccggagacaacgcggaggggcaggactactcgcgccgcacgagtgggggcggtgcctgtctgcgacgacgtcgcggctggcggcggggcttacctgaggagtagcctacct

SEQ ID NO: 124016 - DNA, 157 bp, Homo sapiens
ccccaatcttttattactaattcctacaaatccttcagatcttagctcaatccacatctcctcaaaagctcagtctaggccaggcgcagtagctcacgcctgtaatctcagcactttgggaggccaagatggtgaaaccccgtctctactaaaaata

SEQ ID NO: 124017 - DNA, 503 bp, Homo sapiens
taccaaatgaatgaactctgtttcgataaaactttatttacagaaacattctgtgggccagacttggcctaggggccagtttcccaggccatagtttgctgaacttctgttacaaaacataataaagagggggaaaacccattttacaaaaaaatacctgcctcaaaacattaccacgtaaggatgtgaaagtaggtctgaagagcagattcatgtttttacctcagactcaccctgcacatacgctgaccaaaatggcagttgcaattgcccagtatataaatgatttatctgcctctcatggctcagcacagtgtcggattccataagttgcatactagccttcacaattcgatatataaatatgaaaacaaacaccaaacctgagccaggcacagtggctcatgcctgtaatcccagcactttgggaggccaaggctggtggattacttgaggtcaggagttggagaccagcctggcaacatggtgaaatcccatctcta

SEQ ID NO: 124018 - DNA, 358 bp, Homo sapiens
tcaaggggttcagaaagataactatgtataagtaaatacacacatagtacacaaaagttaaaggcatttgttttacaatgctaacaacaggtgaatctggataaattttttttcttttctttctttctttttttttttggagacagagtctcgctctattacccaggatagaatgcagtggcatgatctgggctcactgcaacctccacttttttttttttttttttttttttttttttttatttttttattttttttttttttttttttttttttttttttttttttatttttttttttttttttttttttttttagtttcgtttttttattttgtctttatatttatataagacag

SEQ ID NO: 124019 - DNA, 190 bp, Homo sapiens
gcacagaggagcacctgaacaagccccactcatggagcattagagaaggcctcctggaggaggtggcattgagattagctaggcagtgagctaagggcagtgcagaggcatgaaggcgagaaagcgtacactgtgttttgtggcctgtctggggttcattgtgctgaagtacgtgagtgtctgtgacaga

SEQ ID NO: 124020 - DNA, 355 bp, Homo sapiens
tctgcaccacagcgatctaggggtactaagtatagttgtattacgaggacgtattgtgtgaaatatggacttttagtgtattcatcacctaaataatgtacattgtacccagtaggtggcatttcatccatcacccctccatcctctcgctgtgtggagtcctcagtgtctgttattcccctctgtgtgtctgttctgtgtgcacccattgtttagccccgtcttataagggagaacatgcagttttttgttttctgtttctgagtcatagtgggcatcctgtattctatatggcaacactaaagacaggtagtgtcatcggtgctgaggtgggggcaccgtaggcctgtgggga

SEQ ID NO: 124021 - DNA, 509 bp, Homo sapiens
ctccatgaatccttacctcgatgccaaatcacattaggctcccatccacctgaattcaccaaccaacccagctttatctattattccacacaatgaaactaaacgggtgacctcacctaatgccgtaagaaagcagttgtacaattcctcccactctcaccaggacactgtataacttaatgtaaaaaaaaaatacaatcaactgtgcatgttagtttaaaacacattgaaacatgatcagtcaatagcagttgtattgctttttccttctggaaggaagtgcatgtttcaaatacctcctcacatttatatgctaatttaccactgttttaaattcataaattcagataatgactatagattatttaagaagtaggaatagtttctacatacaattttgcatgttttcacagttaataaaatgttcaagctgaattgtaaagcctttttgtcatatcaagctgggaacatttttatttaaaattctttcagtacaagaaagtgtgctg

SEQ ID NO: 124022 - DNA, 311 bp, Homo sapiens
cagtccccattctctgtagggtcccacatctatcaggtgctcagaccctgcccttcaggatgtatcctctctacctggggaccatccagtgttttctcttactcggcctccaattgtgatcgcaatgccagcagctgtgctgatggccccctgaaattgacttggcaattcactatcctcactccagtgagcttctaaaaactcaataaacttgatctttgccccgcctcctgccacttgaagctttggtggcaatgatgatggtgatgatgatgatgaagatgttgaagaaggggatggggagaagggag

SEQ ID NO: 124023 - DNA, 272 bp, Homo sapiens
aacacccagctatgggattggaggagtccacgtgggcacctccatatgctgccatcagagactagaagaatgtgggataaggacagacacgcttaggaaaaaacaaggcgaaacacagcaggacaaaaactgaacctctggcacgatcattcgttgaatttgcaaaaggaaaaagaaaataccaagttccaaatctatccctagaaaaatgggtggtgactgggtgctgtggctcacgcttgtaatcccagcactttgagaggccaaggcag

SEQ ID NO: 124024 - DNA, 381 bp, Homo sapiens
ttctacagtattgcacaagcgaggaggcgagatcagggggagagtggcatgaggagggcagctgtgctaagagagatggcgcagcagagtggggccagaaaggcctctgggaggtgacagatgagcttcaaggtcaagcagagtccgcagtgcaaatcaggcgtaggaattgggggagaaaagggcacactaagcagaggaacaaggctggggacttgccagccgtttgccagggtgggtagacaggccagagaaggggccggcagtgcagagcccacatggggtgctggagagttggggtgctctctgagggcagtggggagtcagtgaaaggccaggtgaaattccatctgtcttctgttatcattgcttgttccgctg

SEQ ID NO: 124025 - DNA, 670 bp, Homo sapiens
agcgggggaggagcggggcggtgagagcctggctaggcaggctggaaacagtagctcttaacggtcccccgcccgttggtggcaaggcggctggactggaatcccagcaggcgacatgcgaggaggcgggcagcccaggagggttggacacggcaatgtggacctcgccgcttccacaacgatgctggctactgatcgcgtgcacttccttgccaaagaaaagaaattaatgttatgactggatgaagacaattgtgaagaaactgcactttgaggttgtctatctctgtattctgatggaaaagcgtggagtttagaagcactgctcactccttcagtttctaacaagtttgagactatggttaggtggtgaggaaggcaggctcagcacccaagccttggggagacgcagaaagggcccatcccaggcactcaggtggagcaggtggtctgtcctagagaacgttccatgtggatttgagaagaatatatattctcatgttggatgcagtgctgtgcatatgtttgttaggtttagttgttttatgttgttgttcatgttttctattttttatcttctgtctacttgttctatccattaatataagtgaagcattaaagtctccaactattactgttgaaacaccaaaaaaaaaatctctccagcgct

SEQ ID NO: 124026 - DNA, 388 bp, Homo sapiens
ctaagatcacacagctactaagtaacaagtatgctgaagtccaaatctgacttctgatatgggaaagcacagtgggagagaaggcgattatactgactatttagtgttctgaatgccgtcttaaggcattctgtactccatactgggtcaagggcatccacatcatctgggaacttgttagaaacgcaaattctcacatctactccagacccattgaatcagaaactctagaaggtggggcacaactaactgtttcacagtacctccagctgattatgatgcatataaaattttgagaacccctggcctagatgggaaagatgctacacaaccagaattcattggggtttataaattgactgcctataaaatggagaaagagaaaatg

SEQ ID NO: 124027 - DNA, 874 bp, Homo sapiens
atctcttggctgctagggcttacattgttgtgtgataggcacccatgtgaatgtttacaacagtacattgattggtgatagtgagctatgacaaatgggtacctgctaagttagggtttttactatcccagcaacctaggatataaggttttgcctagggttgactgaatgatgaatggtggcccctagccagcatacaccaactttcctgcataatttgggaaagagaagatggttgatatagcaaagggacagtaaagaagagacctccagcagcagagtacatatgcttgtgaaatattttcctagtaagaatcattaaaattttttttagagacagagtcttgttctgtctcccaggctggagtgcagtggcacaattgcagctcactacaagctcaaactcctgggctctaatcctgggaagaatcttaattaaaaagataaagtttagaatttaggagtttgtcaggaagaatgagatcagaagaaaaaaattttaaaaatgccaccacatatcagtatataatttatagtatcctaaaatgagttttctataggatcatagttatcaactatattgcaattctttatttaggatagtatgataatagatacagtttattcagtatggacccaaatatttaaccgtatcataatttatgttgagatactgtttttttagtatcctaagttaaaactaccttcataataaattgttttcttgagttgtgagctatcagtagaatgtaacgtgtgttgtccagacaggccagtgctccacccctacaaggaaatagggtagtggcttccctgtttccctgcttttgtgaatgtaaagtcttaggcaggtcaaattactcaactctagaat

SEQ ID NO: 124028 - DNA, 699 bp, Homo sapiens
gtaacatttgctcattttgaacaatattgtatgagtagtgtgaagtgatttttaaaatgtctgtcatttttttcatgttcccattttattaaaaggagggatggaactatattgtggaagctaatgtaatttttgtctctaagaggtttttttttctttttagactaaaagggcttaacagaagaaaaatttatctttcttaattgctaatttaaaggctaattttttccctagattgcttagttttgactatttgattccatcatatcaagctgtgaatttccttcattttcttgttttgaggtttcattattaaatattgtcaaaaataagtggctcatcaactctcttgaaagtgtcttattgctatgtttttttttgtcagtatttgacattctgaattgaagatgtgagttggaaacctggttaattaccaagttacataatcctgtatttattaactaggttagactacatacagactgttcttgaaaatgaaagtgctgttataactcagaaaacacattcactatggcccatttcaagttaattgaaggattgagcctttgatagtgcatttgccctgtgcggctctgttacatgcattctttctaggcaaagatgcattgttaccattctctcatggtatgttgaatatttcattagattcaatatttcaatattaatccaagctttttt

SEQ ID NO: 124029 - DNA, 250 bp, Homo sapiens
tgctgggattccaggcgtgggtcaccatgtctggccgaacattctctttcataagcacagtacaactatcaaaacaagaaatttaacatggacatgatacttttatctaatgcaaaattcatgttccaatttcatcaattgtcccaataacgttccttattgctgttttttctcctggcttggaatccaattcaggatcacatgttacatttatttatttatcttttccgagacaccctggtgacttaac

SEQ ID NO: 124030 - DNA, 184 bp, Homo sapiens
ggaaaaacaaaaaccaataatggttgtattggggtcaactattcttttacttctttactttccaaattttctttataagtatgcttgaattttataaaggaaaagagaattactgcatctattacgtttttaagctgcatattttgtctcaaattatacattttgatggtccctcgtggtctag

SEQ ID NO: 124031 - DNA, 208 bp, Homo sapiens
agcctcagggctgctgccaagtgcccacctccagaagccgctgatgggagacccgacgtaactgggacagagccaggttccagcttcctctgaagttatctaccatgggcggatctgccaagcacacgtggaccctgagcctgatgggaggcaaactgtgtaacctacctgggggaagaagccagtgcctgattgtgcacagcactaa

SEQ ID NO: 124032 - DNA, 560 bp, Homo sapiens
tagcatagtagaatatatatcataaaatggcttgcctgtatgggttgctagggacggacagtgagaattgcaatctgtacagtgattttggaggatgtccctgactcatttcaatgttaacgacagttgttggtatctctgtcttaactcttttattaacattccactctgtaacaaacagaggattacatatcgtagataaagttagggcctttcttatgactccacacacctgtactctcctagtaccttttgttcacagaggtatcaccacctgtgctcagaatagcatttccaactcaattgattcatggggcaggaaaaatgagttcttgtgccagtacgaatagagttgtggggaggaagctgagaaagagaaaattaggaaatgcatttctaatttatcaagatatgagaatgggcacttcattttcttacatatactcccagtcacacagtctgtatgaccactggataatttattctaggtgcacaaaggtcttaattggtactgatatttatagcattcatcacacaaagaaataaaagaaaataaaaga

SEQ ID NO: 124033 - DNA, 211 bp, Homo sapiens
taggagaattgcttgaacctgggaggtggaggctgcagttagccgagattgtgccattacacgctaccttgggcaacaaaagcaaaactccgcttcaaaaaaaaaaaaggaaattctgcttcaatttccttattatttattagtccattcagattttctgtttcttcttgattcagtcttggtaagttgtatatttgtggaaatgttttta

SEQ ID NO: 124034 - DNA, 404 bp, Homo sapiens
gtatatatcagctcggtacccccgtatgctttggagcattgagaggaactaacagctttacaaacttcaacctctcttgagtcattgccatccccaggcatgtgaaaaataattacaagtgtaggaaagaaatacagcatagtagcataacatattaaagagatttaggaattctagttcacactaaattcattgagaatgaagcgtgctgtagcatgacactctgcaatcttagggtatagtaacagaggccatataaggaaatgaatgaggaggtcacccctccttcagtaagttgaattctggattccttaatttgagaagaaagagcaattaagtgtatattcagatgagagccaccaagaccctgaggagatctgaaaacaaggactgtatgatttttt

SEQ ID NO: 124035 - DNA, 498 bp, Homo sapiens
caaagtgctgggattataggcatctgcaccacagcaggctgaattcttgttacaactataagtctagaacttctaattccgaaacatccttcagttccatagactgaacagttgagaatagttggatggaaagaaaagaggaaggcaagagagaggtagggcagggagaggagagttgagcaaaggaggaaaagaaagtgaatttttgctgcctgctgagtgtctggccatgtttgtttaccatggtaaacaaacaacaagtagattgagttgggggctgaaaggggcaggcagaaagccttctgtgaaggacctgaagtgtcaatcaacaaagtagtctgaaagtcacaggtatatgaaggtaaggacagttcttatccctgtccttggatttacaactagcttttaacgtactcttttaagttgttaagactgttgtttattttgaaattaccagcagctccgctgtgggtgcagaattccggctcggcgcttggg

SEQ ID NO: 124036 - DNA, 215 bp, Homo sapiens
tgtgtgtgtgtgtgtgagagggagagagatccaaaaagagaaaactttgtaaagatttggttccattttgtctgagaaagactggattggcattcctcatctgtatgaaacacttctcaacagattccatacaatatatcgcttggaaaattcaagagctgccaggtctctagctcttgctagcatttggttagcatttcactgtatataagatc

SEQ ID NO: 124037 - DNA, 369 bp, Homo sapiens
gaacaattttctctggggtctttgctctatgtatatacctcctagggaacttaagtgagtggtttcgttgtcacgggagttgaacctacaatatttgacaccctgggagattggaaacaaaaaattcaaattgcattcccaacatgtttattgaacctgtgccattttcagtactatattaggtattaaaaatataaaaaacaaaaaagattacatacttcactaattttaaggaactctgagtaaaatctgataaatatacattctattataatacaatgtgctaaattcaataaaagttacgcacaaggttttataaaagcactgtggacccaatacacgtacttgagatagcaaagaccccaaaag

SEQ ID NO: 124038 - DNA, 180 bp, Homo sapiens
tacatatagatgatcagtgatttattttacatgaacagctttgtccttttatatgaaagggctaccgggatgaataaatggacagaaatggaaaatgttctaaccttctgttgaagtataacatatgtatgcaatgcagcatttgatgaatttttatagagaagtgaacacatctgtggg

SEQ ID NO: 124039 - DNA, 431 bp, Homo sapiens
tgcctcagcctcctcagtagctgggactacaggcacgagccattaagcctggcttgaggggaaaagtcttttcccatggtgggaggagaagaattaacagctgtggaccagctgtgggcaagctgtgtcttttccttgcttgaaggcatcttcttaacattttctctctgaaggcataaataagcttccaggttttcaccctattttcaaagaacttttcaaactctagccttaaaatccattagggtttattacatctgcttctttcagaaaaggtagataataagtaactttgcaccactgaggtaagcaagcaattgtttcccatattaaatgtgttggccctcaccaaggtacatgagaagcttggaccacgatctgaatcctaaagggacttctgctgggactgaatgcttgcattagcggttcac

SEQ ID NO: 124040 - DNA, 299 bp, Homo sapiens
tgccaatttttccattgacaggcttgtcttctttttaattgtcatagttctgtacttatttccgatactaattttctgtcagtttttttatatggcaaatctcagcttgtgacttttcagtcagagaaaagtatcttttaatgaataaaagttcacgattttaatattttcttttatacaatgtatattttggaccacctttaaataagcctttctctactccaaagatcatcaagtattattctattttgtcttctaaatgtttttaaattttgcctttcacatttaagttcttgatc

SEQ ID NO: 124041 - DNA, 345 bp, Homo sapiens
  misc_feature (22)..(22): n is a, c, g, or t
agcggcgccctttttttgtaanttcacttccctgactctactgaggccccacactgccctatccatatggtggattaatgtttgtattgttgttatcatctttcagtcacatgctgcggtactgttgtcactttagatctctgcacgttggataattaggagttcacagagttatgtgtacacgtggtttgcagctcaccagtgtctgcatttcttctcattttgaactttgcaggagccttatgtcagcttttggacattatttcttagaggacttgggatgtcttccgtatattatacatctgtctgtttctcttaaggatgtaaggtctgtaagaatagggg

SEQ ID NO: 124042 - DNA, 203 bp, Homo sapiens
agaccatgaccttttaactctgtgttagtgaaggtgagcagatattagatgtgagaagaacactcctagacaattgtggttgtgtggaaatgcagtatagaatatggcttgtcttcatcataaactcctgggcgctggaagcacttgtggtggagctctgcggatagttcttgccttgcagggctaggataggatctgcatgt

SEQ ID NO: 124043 - DNA, 566 bp, Homo sapiens
ggtaccgattacgctcctagacggcagaggtgacctcctagggttctcaggaggggagctgtgccttgtagagtcacggtcactacagaaagtgctgcagccagcccacccagatcaagatctggcatgttggccttctttgttcacgttcctcattagcagctgcgcagttttaaagacacatgccggaactgggccttagtctttgtcgctggagcaaaataaagtagctctctgtggacacgggaggttccagagcaccgaatggagagaaacaggtttgggtcctggctttgctgtgtcactgtctgtgtgacttgaagctggtcactccccaaatcctgctccttgtctgtagagtgggcctggcattttctcgtccctgggaccgctgtgtggagtgtgcgttacagggaaggttcagggctttgctgctgctcagaaagtggtggtggatggatccgtatagggtttgaatctaaggtgctggcctctcagcaccttgttgtaataggctgttattgtacagtggaataagggagctggccctcttctgattctcttcc

SEQ ID NO: 124044 - DNA, 258 bp, Homo sapiens
ttccaactcagcaactagagggatccttttaaaatacaaatcaaatcagatccctcctctgctgaggacctttcagtagttccattttgactgagaatcaaaatctttacgatctgaccaccccatgtctgttaccactttatcctcatcctctacaattcccgattctctttgatccagctcctagcagccacacccacacctgagggcctctgcaatggctcttcctctgcaaagagctctcttccccccgatgcc

SEQ ID NO: 124045 - DNA, 427 bp, Homo sapiens
tcccccaaagatcgcaagtgctgtgggttataaacgaagccatgcatcatggggccgcctgtaatattttaaaagtggtgttggaaaaccgctccaataaacttgggagaagacggatcacctttctgaaaacgcaaaataggatgctgtgggcataaatatatgcaaagaccagattttgatccatcctgagttaagaagcaaggcctcgttcctcttttctggcattcctggtgctccagctgtaagaggtttattactggagctcagctcacgtttacatttcaggctgattgttggcaccagcgtcacatctggtattacttcccccaagtggctgcattctgcaccaggcacccggccctgtcaccctcagaagtcccctccaacatttccccacaatctcagagaagaagggaaaatgcca

SEQ ID NO: 124046 - DNA, 360 bp, Homo sapiens
tggaaatcaagtctggctgatgtcaggggcagtaaagcccatcccatgtagccacgtagctttcccagttccactcaggctgtggtggctgtcccttgctagtgagaaaaaggaacttgactgatacctgaacaacaccctagcagcaattccagtgggtgttcaagcaatgtcttcttcaaggcacctcacatatagttaggaaaaacaaaactttacctttacagagttctttcctctagtaaaccaaatgacatgcctcacatttttaaggtgatgaaaagagaggtcagtaaaattttccccaagaaggaaagggtgcttgggagtcctgcatggggggctgggggtggggtgggg

SEQ ID NO: 124047 - DNA, 258 bp, Homo sapiens
tgaatcctgtgcccacctgatgtaccatctcccatccttggctttgggagaagataggccacagggaccttcatggtttgctgcaagctcaatgagaatagaaatgcccaatggggatttgcttgtgaacagcagtcccaggtcatcttcagaggagaccaaggccccattgtggccaatggccaagatctgagtttgaagcaaaaaggaaagacttcctagtgggccacgtaagtgctcattatatgtgtgccatgg

SEQ ID NO: 124048 - DNA, 286 bp, Homo sapiens
atggcgacgctcggagttcaaatatgacaacatggagattcatctttatctatgataaatgcctgagtccctggcctgtcctgtggaaggtgggccctataggggattaaggctctttgtcttgggttaaatgagtccctggcctgtcctgtggaacgctggccctatgggggctgaggctctttgtcttgggttaaatgagggttgccatgtggatgctgttaggaggagagtattaagtgaaaatgctatacaaagtccatgctttctccgtggcggtcgccat

SEQ ID NO: 124049 - DNA, 712 bp, Homo sapiens
cttgggagggcactgttttcttagagtgtaaactcataacatcatcccccattgtttgagcttccctatgggatgcccaggggagatagaaagtagaagtgccagaatgtcctccaaatggatgtccccatgtttacatcaatgaaagaatcatttcagaaatttttgcagaacatcttgctccaagagagttataacagccaaaggcaaagtggaaccgcccacatcctatctattttcatactgtaggataactcagttaagattctagaggtcacagttcacgtccactctccttttcagaaaaagctaagcttaaactattggcaaatttgtaaatatcctctcgttaagattttagcaaaacacaacagaattgcaacagttcaatttacgtcttcaagttgaagtaaattttaagagccattacagaggagtcttgaatatttatcacccctatttagggagcacctataaatgccaagcagcaagctaaatgtcctatatacatcattatacatcacatttgatcttcacgggaatgctagagggtgaaattattagtcttggtttacaaacagcaataatgaagttcacaaaggttaaataatcttcccaagtttcagcagctagcaagaggcagtattcactggacttgatggctcatgcctgtaatcccagcactttgggaggccgaggcaggtggatcaca

SEQ ID NO: 124050 - DNA, 338 bp, Homo sapiens
cataagctcaattgtacatggtcacacaattaagaattgagctgcaattaaaactcagaaggagtgacttcaaaatcaattatcccatcaggctcacagattttaaaaaaatgtgtaagttgccttatggaaattacacaacacagaaaagtttctaagtagagaaaataggtaaacaagaaaaagtgaggaaaagaatcttctacccagattgccagtccagtgtccctacaatagcttcctgtgcacgctcgcccctgagttagcagctcgcccctgagttagcagctcgccctgagttagcagctcgccctgagttagcagctcgcccctgagtt

SEQ ID NO: 124051 - DNA, 363 bp, Homo sapiens
ccaagggctgaggacagcaccttcctagagggctgtgcacaagccaagttctcagcagcaacttttctgagagaaaaccatctagctccaaatcacgtgttcattatccattttcttcccaccttttgccacttctcctttttctgtggtccctccctgtttagcaggtatggaaggtttgggggagaagccactcattttctctgcatctcttctggccctgtttctacctccaaatctgcaccatagccccatcctcagcttccttgtatttcctgaagctgtgtcctctctcccccagcccctggccgcacccatctcagtgtaatggtaccataaaggggccaaggaagagcctgtttc

SEQ ID NO: 124052 - DNA, 194 bp, Homo sapiens
cagagtggaggaatgtacttaaaacatgtgtattcactcaatatttatttcctgaatgtttactacaagccaggcactgttctaagccgtggagataccgcagaaaacaagacaaagttctgctcatatgagccttacattctagaggaagacacaaaaaataaacaagtaaaacaaataatatataattctag

SEQ ID NO: 124053 - DNA, 448 bp, Homo sapiens
cagccgttaggatgagaataatgaagcatctgcctctatgagaaagagcgcaagagagaaaccaccccagatcgataacttgtaagtaaccagcatgaaaaagggccaaaaagcttttcttttctttcagttcttaaataagcttttcctggtggtatcactattcatgttggagtgattaagtaaaaacaagaagacagaacatttactaggcaatatgttgtttttattttgtatatttactataaaaatgtttgaaatgcctttatcatctgctgaaaagtaatcatagaattgacattattgcagatggtgtgagagatttttaagattaatgatagtagatatgagttggaatgtaattgttaagcttaaggaaaaaaatctagcatgtagatagagtgtgtttggtgtctttgtgcctgttttatagaaggcacgttacctt

SEQ ID NO: 124054 - DNA, 455 bp, Homo sapiens
tgagcaacttaatttcaaagtccgaagtcgacctcttcaaagttgtataagaagggctgagataatgtttataaaataaaagaagctggccagacacggtggctcacacccataatcccagaactttggaaagccaagccccatagatcgcttgaagccaggggtttgatatcagcgtgggcaacatggtgaaaccctgtctctacaaaaaatacaaaagttagccaggcatggtggcacatgcctgtagtcccagccacttgagaggctgaggtgggagcatcgcttgcgcccaagaggttgaggttgcagcgagccatgatcatgcactgcacccaagcctgggagacagagtgagaccctgtctcaaaaaagtagtaagtaaacaaacaataaagaaagaaacaaactaaatagtgaagataaactgataaatcttagctctcggttttttt

SEQ ID NO: 124055 - DNA, 211 bp, Homo sapiens
aaacaggactgagacaagaaactaacaaagggcattgagaaagaatggtcagagactaaggctggaagagcatcagtagagaagaaggtactggataccaagcaaagacagctgcagaatgtgggaggtaatgttaacggtggttacaccactgaggtgggattttattgactttctattttctctcatttccatatcttatgcaataatt

SEQ ID NO: 124056 - DNA, 533 bp, Homo sapiens
attacatgtggacgaaggaatagaaggaaaggtaacaccatgtgctagtgagtatttttgtttttgtatttgatcgagggaggagttgggaagtcaagagcggtagaaagatggataatagagtaatattcagtcattattctgaaagaatgcacaacccatagtattatagggaataattacaatgcaacgtaagtactaaaataatggcttgttaaaagtaccatagaggtatggtagagggtatgatgaattttatatgtatggagggatgttaagaaagaatttatagaggaggtcctaaaagatgagtacgtattcatcaaggtaaacaacacgatcccagatagaaagaacttggtataaaaggagacagggagactatcaagaggttactgtaatagattaagtgagacacaaaggcaggcaggattctgagcagaaggacagttaagagatacttaagaggcagaatggctaggtgtggtgcctcacgcctgtaatcccagcactttgggaggccaaggcaggtg

SEQ ID NO: 124057 - DNA, 383 bp, Homo sapiens
attgctgaatcacacaaatattttatcttatacccactcctttattgtacctgggagaaaactaaaggattcacacagctaaaccagcaactgccacccctggtatatttatctacagtagttacagttatagaaaaccattagccttgtttaccttgtggtggcttggtgttctgtcacttagtgcagagagacttttaatgaaatcaatctttcaagggtctaggttccaaatatttttttccctaatctgttgccaatttttcagttgtattttgtgagtatcttcctattgagctgactgtgtattccttttactttttcaaccctattatttgatactagatgatattcatgttgcaggccacaaaaaaaagtgttgg

SEQ ID NO: 124058 - DNA, 683 bp, Homo sapiens
attgatctacaaaattaaatatatatatatacactttatttttaaaagctcacctattattaaaaacatgtctttgcaagtttaactgccttgaaatttctattaaaaagaaaattatgtgttaaacatgatgttagttattataaacaaagtgtaataaaattgggagacatataggtatattagcagatacactgacatatttttagaatgaattcagttcttgcattcttaaaattaacagacatatttatccaacttcatagctaactaaaatctacatgtgacgctgatgagttactgcagggtgatggtgcataaggctaattacatgattcattctacttttgtataagacagctttatgcatgtatgcaacttaaaacatggtcaaaaatagaaatacatacattaattacctgaaggagattcagacaaagacataatgtaataatccattaacaaaggaaactgtctagctcactgaaagcaaggtttctatcttctaaagaacctgaacaagtcactcctgggtagcatccaaaccaaacactttgggttaagaggtggagctacactaaaacatttacaatccattcactcctctgacacaataaatacaacagactgtttagactcctaacaagactggggctttaaaaactacatggtttttttttttt

SEQ ID NO: 124059 - DNA, 256 bp, Homo sapiens
aagcaaggctgaatataagtaagtactatactcgataatgcaactcatccccattagcagagatcagagaagggagataccagaccacaaatcctggagcagcctaagcaggcgtttggaaagagggcaacagaggttgcccctgaaggaggacaaaaacaagactccagatggcagctgaaacacatgtgtccaatgttctctttcctgaaaaccccctacagtcagagtgagtattttgtttgcttgttctctg

SEQ ID NO: 124060 - DNA, 495 bp, Homo sapiens
gcgttctagaggatccctgcatttactccatggcttgctcaccattcaggtcaatgttccactacaggtgctttattctggcatgagggaatattccttgctacggcagacagaaatagcctaacaacctggttaagcagaccattagagataccagagattctatccaccggtgtcaggcagatgctgagagtcttgacctttctctctgtcctttgaaaggcacaagcatttgcaatggagaaaataaaaggaggtgagtatgtgctaagagccggaatgtactgggccattcccaatctgtgaatttaaaagagaactgcagcagaacaggaaatgggctgaagtttagtcatttcattttccctccctctgagactattattgttctctctctatctgtaacatgaaagatagcctgtgctttcattataaaccactttcctcatctggatttctgaagtccttatctgtggcttgccacaccttacatga

SEQ ID NO: 124061 - DNA, 256 bp, Homo sapiens
attttcttgtatattaatatattttatgcctgttgaatcacacaaataactaggactttgtattttaagtttagcactagattacctggcttcttactctagttttgccattcactagctgtgtggccttacacaagttatttaacctctctgtgcctttgtttcctcatctgtctacaatgggtcagccctcatatctgaggtgcattgtttctaagacccccatggatactaaaatctatggatgctaaagttc

SEQ ID NO: 124062 - DNA, 348 bp, Homo sapiens
tactaccgattgaacatccctaattgaaaatctgaaatcgaaaatgtgccaaaaatctgaaactataagtgctgacatgacatgacaagtggaaaattctacatataagtacttaacacagactttgttttatgcacaaaactattttaattattaactggtcgctattatggcttgtgcctgtaatcccagctactctggaggctgaggtgggatgatcacttgaggccaggagttcaataccagcctgggcaatataaggagacccttgtctctacaaaagtaaaaaaattagccaggtatgttggtgcacacctatagtcccagctactcaggaggctgaggtgg

SEQ ID NO: 124063 - DNA, 445 bp, Homo sapiens
  misc_feature (44)..(44): n is a, c, g, or t
gacctgaaggcaggcgcgaattcactagtgattgtgagctgagntcgcacccagcctcttctttggtattcttatctgttttattccatcaataaaaaaaggcgtaagagcaattctataaattcttttgaagattccaggaatgtaaactatgtgaaaggggctaccacagtactgtgcacagatgtccaatgaatattagagggtcccgccttattttctcacctctatcgaggtattttcctctgatccttgtgctattttccttctaaacacgtgtccaggactgaaggctgctcacctttaccccaatataaatgtctatcccccattacaactcgggttccttcaggtcaggcctgtggatttcacatctctgtccccagcccctgcacattgtctggcacagagcaggtgtttggtgacagctgggttgacttggcca

SEQ ID NO: 124064 - DNA, 280 bp, Homo sapiens
gggtcatactgagcaagtattacatagtagtaatgatgaggtcctacaaggcaatttgaattaacttggacactaaaactaaatggttcttgaatcctatgatctcataggtcttcagattaaacaattcatcgttagtaaagcatctaacagtgcctgttctgaatactgattccctttctcttcaatctggttggtcttgcctctaactccaaggttccgcccatttgcagattatggaaattaggtaactgaatttcctaacttgtaagtaaaacaa

SEQ ID NO: 124065 - DNA, 414 bp, Homo sapiens
gagatactttatagactaacattctccaatcttgggtcaaagttgttacaatatagttagaatagtaattatctactcccagtacctgggagtccctgattgtccctgatctcaagacaattttattacactgacgcttcctctgcattaaatatcagggattcagattaagtttctgtcctcccagagtgcagaacctaggggtaaggaggtaaatgataaaccaagaatgctaaccagaatgttatatttcttaggagagagctattacctctcccttggatagaaggagagagtcaagccacatttcagaagaagtgtggcagatttggagggctgatacatccctctttaaggaaatatttgtgacttcaaggaagatggttagctgatagcctttagctattagattgt

SEQ ID NO: 124066 - DNA, 344 bp, Homo sapiens
cattgatgagatgaataatgctgctatggacgttcatctacaaatttttgtgtgaacatgttttcagacctcttgagtatatacctagaggagaactgcaaggttatatgggaactctgtttaactttttgaagacttgccaaactgtgttcctaatctaccataccattatacgttctcactagcagtgtataagggttccagttttctccacatttttaccaacatttgttaattatacccatctcactgggtatgagatagtctctaaactgtggttttcatttctctaatgactaatgatgttgggtatcttttctgtatttagaagaaatgcttggccc

SEQ ID NO: 124067 - DNA, 902 bp, Homo sapiens
gtgttgtactggggtttctaaccagggcaattgggcaacagaaataaatttaaagtatcagattgaaaaggaaaaagtacagctatctctatttttagaggacatgatcttgcaaatttgaaaatgctaagaaatccacaaaaatactatttattggccaggcgcagtggctcaagcctgtaatcccagcactttgggaggctgaggcagggagatcaccacatcaggagttcgagaccagcctggccaacatggtgaaaccccataattactaaaaataccaaaatattatctgcacgcctgtaatctcagctacttaggaggctgaggcaggagaatcgcttgaacccaggaggcagaggttgcagtgagctgagatcacaccactgcactacagcttgggtgacagagcgagactctgcccaatgaacaaaaaaacaaaacaaaacaaacaaacaaaaaacctatttattatagctaatgaacaaattcagcaataatgcagggtagaagacaaatacagaaaaataaattatattttcaataattagcagtgaataatccaaaaaccaaaataagaaaacagtttcatctacaattgcaataaaaaataaaatacttagaaataaattgaacaacataagtgcaaatattatagggtgaaaatgaccaacattattgaaataaattttataaaaaccctaaggtaatgaaaagacatttttgagttcatgaattggaagacttgttattatgatgatgccaatattccccaaatttatctacagatttaatgcaatctctataaatatcccaactgccattttgcagacattgacaacctgattccaacattcatatgaaaaggcaagagatccagaatagtcaaaactgtcttggag

SEQ ID NO: 124068 - DNA, 575 bp, Homo sapiens
acagaactatacacttaaaaatggttaagatggtaaattgtatgtggattttaccacaattaagcccacagatatctgctatccaaatccttcctactgactttatccgggtctaagatctcctatttgggttactacagcagctactgtcttccttggttcattacattctctcctcactctaacttaacctgtagatcattaacaggtttaccttcctggtttaccacattaatccctggcctccaaactttcaaaggctctctataccttgcacaacaggataaaagtagaaatctcctcaattcagcactcaaactcttctacagacaaatagctttccaactgactaaagtttcctaacgaaaacattctcctcaggaaattcagttgtcagctcatcctagtctccttctatttccctccccctaagctaatcttcactttacactcttgctttttcctcacaaagtaactgctacaatctctcggtaaatctaaactttcataggccagctcaaatccgaagtttcccaagttctttggactcttggggtctcactcatctctctcta

SEQ ID NO: 124069 - DNA, 678 bp, Homo sapiens
ctaaccaggttaggcataggcagatggggcaaatgtgctgggaaggtttctgggaaagggtctctaaattcttaaaaagtgcaagggaaatcttctatctctgtatagaaatgtccaaagaggtgatctaggaatttggcagccaccctggacccagggggaacaaacagaagagctccagctagtgccctaggctgcatgtgcaattccatcactgagctgctaaaacaacagccctagagctgcctcacttgggcttcctgtttggtgagctaacaagcccctttttgttctgaacgtttttattgagctttattttcaaaaaagcagcctgattcatgcacatatctttagaagaaatttaaaacgccctagaaaagaatatcttcagtttaaaatctaagcaatttggaatttacaggaatatattcctcttagttccagttactcaccattaaaaaataatggtcctcaggttcagctcgaagatatttaaaaaccacttgctccatgaacctttccataagatcccagtcttcaatgattccatgtcgtatcggccactggaggaagagacaccagagttgtcaagcctcagttcgcaacaataagagcaacagtttaacagtggcacagaagaaactgtattattaagaataaaggtctccttctcattgc

SEQ ID NO: 124070 - DNA, 195 bp, Homo sapiens
agtcaacacctatcagaactatataaggcctaggttaagaatgccatttcctaagctccacaccagacttactggaaggcacctggaaatgagaaccagaaatctccttgtgtagcaaagtccttagcggtttttatgtgcactggagtctgagaaaggagtccagtggcccactatgatgaggtgacagccctg

SEQ ID NO: 124071 - DNA, 607 bp, Homo sapiens
tgcagtggcaccatcccggctcactgcaagctctgcctcccgggttcacgacattctcctgcctcagccttccgagtagctagggctacaggctcccgccaccacgcccggctaatttttgtatttttaagtagagacggggtttcaccatgttagccagaatggtcttgatctcctgacctcgtaatccaccggcctcagcctcccaaagtgctgagattacaggcgtgagctactgctcctggctccagttagcatatttttaagaaaagatttaatatattcttttattttaactttacttatttatgtacttaatttttacttgagacagagtttcactctgtcacccaagctagagacaaggttttaccatgttgctcagactggtctcaaactcctgggcccgagcaatccacctaccttggcttcccaaaagtgctgggattacaggcatgagccactgcacctggcctatttcaactttatataacagcagttttcacacgtactccaaagaaaacagtataatgagccatcctttacccatcaccaagcttcaacaattatcaaccataaggacttttcaaagaatgtatttaaaggc

SEQ ID NO: 124072 - DNA, 781 bp, Homo sapiens
aaaggtggagccaacagcattgcagccacaatggatgtaggtgtgacagagaagcttcaaggagaactaaatttgggggccggcaactcaaagaatggagttgccatttactatgatggagaagactatgagaaaggcagatatgggggagaaagatacagaattaggttttttaaacctaagtttgagatgtctattcaggaggagctacctacccactaagcattggttatttgtgaggtccaggagagaggtctaagctgaagaggttatttgggaatcatctgtgtattatggttttatatgataccctctattggtgtaaatggaattattgtaataaagttttgcaagagctcatctgtttcacaaagcaagatacccttgtgtatagactatatgcagtagtcccatggtgagaagttgtcctgaactcctccccttgaggtttgtgtggtatgacatctcatttgcccatttcgaagggattaaatgcctccctcctttctctatcttaccatatccccaagaggcaaccatgtggtcgccagcagagaatagctcagttgctcttgcagcacattttaaagcagatgagaaaagccttcacgctgaaatagaaatatctcagagaaaacttggctccaaggcaccccaagagagtggggggggttcctgatatgggagggcccagcagaacgcctcaaggcatcaccttcctcaacatgcacaaatgtggctgccataacacaaagcttctatataaatatgtcaaggagca

SEQ ID NO: 124073 - DNA, 573 bp, Homo sapiens
gtgccccccactttctactatcccaacagcacctgccgagtgccccccccccactttctactatccagacagcacctgccgagtgccccccactctctactatcccgacagcacctgccgagtgccccccactttctactatccagacagcacctgccgagtgccccccactctctatcacaacagcacctgctgagtgccccccactttctactatcccaacagcacctgccgagtgccccccactttctgctatccagacagcacctgctgagtgtcccccactctctactatcccgacagtacctgccgagtgccccccactttctgctatccagagagcacctgccgagtgcccccactctctactatctcgacagcacctgccgagtgctccccactttctactatccagacagcacctgccgagtgccccccactttctactatccagacagcacctgccgagtgtcccccactttctgctatcccgacagcacctcctgggaaattcaccctcagctgtggtctgtgtcccagcccgggccctgggtttggtgtggggctctaggt

SEQ ID NO: 124074 - DNA, 379 bp, Homo sapiens
ggaacttacatttaagtatttgttctgtgaaagagtggatgaaaaggttaaactttactctgtgtttcattcttccccattttggttttgagagcctgaaagttacattgctgttgtcctccataaatgatgtgctgattccatggaaggactgtcagtggcatatacatcaaacttaatcagctctgatgaaacttcttacaaacttggccttcatttccttctttacattgcttttcttccacagttaaacccagttatttcagttatatatttcagtctgtatttttatccattcgttcataattgcttcaaacagaggtcagtagaaataggtctgtcattctctctccacttctttccccacttctactgccca

SEQ ID NO: 124075 - DNA, 337 bp, Homo sapiens
gagtttatttcgatgtttcctgtgaagtagagatcacttttttttttcataaagataaccctgaaatatggatccaattttctttccataaggataatctagtgaccaagcatcctttattgaatagtccatctgttccctacaacttttctaatgccacttaaatgtttccatatatatgagagtttgtatctgtattttctctattccataccattggtctttttgcctatcttgtactacactgccttaattctcatagctttataataattatttatatttgatagggcaagtctcactcccttgttctttatttttcagactttctgtcata

SEQ ID NO: 124076 - DNA, 726 bp, Homo sapiens
cgcccacctcagccttccaaagtgctgggattataggcgtgagctaccatgcttggccctaaactatattttttaaaaatgcttaaagactactgcttggcaaaaaataaaaataaaaaataataacgaaatcaccatcagcaaagtaagaatccaaattagcaaactagaaaaaatatgtgtaacgcatatgataaacaaagggctaatctctgttaacaatcaacaactcaatagagaaatgaacaaaggatataaacagatactgcataggaaaggacattgaaatgactcaaatacatatgaaaagatgcttactttcactcttacgagagaaatgtgaattaaaacatatttttatctgtcaaattaacaaataaattttaaaaaggagacttgataatatgccatgttagcaaagctgaaagaaaacaagtacttaatacattgccaaggcagtactcacgacactgataaaccttatgtggagtaatttttataacagtacccatcaaaatcacaaaggcatatctgctttgacctggtagctttactcctaggaatttacattagaggatgtacaagcaagcatggacgataaagtttgaacatgatatcattacagcattgtttgtaattagctaaagattagaaacaacctaaaatattcaacaatcaggaactggctaaagagattgtggtatacaacctttggtagaatgctgt

SEQ ID NO: 124077 - DNA, 450 bp, Homo sapiens
ctcccgtaccacctaccctaaacatgcacctccttctgttttcctctcttggtgaatgcttactgctgaggtattatatattccaaaggtattgaatttccagtcagcataagtcaaatgcaaatggttatccaccatttcttcatccaccaatatttactgggcaccttctatgtagcccatatcatgttaggctctgggatgcaagtgaaaaaagttatcacctctgccctcatggagcttacaatctagtaggggaaacacacaatatgcagggattattttatgtattaagagtatataaaccagggtactgggataatagttagggaacacttgctttttagatagaatgatcaagaaaggcctctgagaaagtagttaaaactggatttgaaacctgactcctcaattacaagctgcatgaccctgggcaagtaagtcgcttat

SEQ ID NO: 124078 - DNA, 654 bp, Homo sapiens
attgtagatatataggtaatttgaaagagcactaatgtactcttcctgtgcaagatatcctgtagaacatacgcaaaatatgcattttttttttccttcaacttctattttaagttcaggggtgtatgtacaggatttgcatatttgttacataggtaaatgtgtgccatagtggtttgctacacagatcatcccatcacctaggtattaagcccagggtccattagctattctccctgatgctctccctcctcccacctcagccccctctgacagcccctccccccacaatgtgtgttgttcttcccaatgtggccatgtgttctcatcattcagctcccacttaaaagtgagaacatgcagcgtttggtttccttttgcttcgttagtttgctgaagatcgtggcttgcaactccatccatgtgcctagaaaggacatgacctcgttccttttttatggctgcatagtattccatggtgtatatgtgccacattttctttattcagtctgtcattgatggatgtttaaattgattccacgtctctgcagacataaagacaaatggaacagaatagagaactcagaaatcagactacacacctacaaccatctgatgtttgacaaacctgacaaaagcaagcaatgggaaaag

SEQ ID NO: 124079 - DNA, 530 bp, Homo sapiens
atctcacaaatttctacccaccaaaggacaactccagatcaaagattgctcttcagaggaggcctgcattggatggaaatggccaggcccttgtatgaccacctggtttagttgttcatcagagactgacctaaaaatagtaagaccttgattcaaaagactgggttggatcacaatgaagcaaacagttgaagactgttgtctaagcgcaccctttgtagctgggcagggaatccttcttgaaagggtatctgaaactactttaaagttcatatggaaccaaaaaagagcccacattgccaagtcaatcctaagccaaaagaacaaagctggaggcatcacactacctgacttcaaactatactacaaggctatagtaaccaaaacagcatggtactggtaccaaaacagagatatagaccaatggaacagaacagagccctcagaaataatgccgcatatctacaactatctgatctttgacaaacctgagaaaaacaagaaatggggaaaggattccctatttaata

SEQ ID NO: 124080 - DNA, 280 bp, Homo sapiens
tctcaaactcctgacctcaggtgatccctctgcctcggcctctcaaagtgctgggattacaggcgtgagccaccgcacccctccatcttgttttattttggtatccaatgaagttgagcaatcttagccattttgatttccccttgaatacactttgtgtatttttctgttggatttactttagatattatttctgtcactttttgatgatgtaaaaatctccctttctgtaagccagttgtcatctttgtctactatatcacattaaaaatgaattctt

SEQ ID NO: 124081 - DNA, 286 bp, Homo sapiens
atctgattgcccttccaatttgtttccactcacctggagaactgtcgttttcagcatgtgtgcctttggaaacttttctgtgcctacagcttcagaaaatgtatcctattattttagtgtgttttcaaacaacacaaatagtacagatctatttttccactctgcatttcaccttgcacataactctatctccttccttacttcccctctatcatttcaggccttctagtgaacaaaggcatgacaggaccccatgtggacctcagggtacactgcagcctgggcc

SEQ ID NO: 124082 - DNA, 418 bp, Homo sapiens
tgtaagtgggagaagagacgtccctctgccctgggcctcagctctttactctgcagtgactcttcccattgtgatctcagccctggaacccatgagagctctggagtgggtcctcctgagtggccctgacttcctgctgtggggaagatccccagtgtttctcagcatcagaccatccgtcactcagtttggactcaagccacacatcactgtttcttcaactggcaatgaaggcaggggccaggcccctggttcatgtccagaaagatgactttgtgctggccagggcttcacaaccacagccagagtgctccctgcatggctgccatgagtacacacagggttggggctggcataatcactggcgtatgcatttgtgtgcgcacacacacacactgtctgtctcacacacacacac

SEQ ID NO: 124083 - DNA, 701 bp, Homo sapiens
cctctctagggattatttagaattaataaaatcaagtactttttcacacgagcctgaaggaattgttaactgaaggaacttttatgtgatacagtttgttctgaaaattaggtatttaaggactttgtcaattatggttaagcacattttttattaaaaagaacaagatatgtagctaagtggctgtgtccgggctgagatgtttcttctcactcgatcctacagtgaagtcaaaatatagtgacagattcagtttccatagctgcagaatctgttttcaaaaacacaaggctgtgatttcactgtagttcagtgcacattgagaagctaatatggaaatagaaatgaaacttttcaaaatacatgccttaaaacaaaaacttccagttcccctttagtgcttagatgagatttttttttttttcaggctttgtaagttttgcagattaatttcagaagttgacggcaatgtgatcctggtggactgtcattctgtagtgttagtcaggaagcccctcacacactttcttctcatttcctaatgcgacagttggttcagtgaatatccattgtgctttataggttgatattgatatgtttgtaattggcctatcacgtagttagtttttttttcttttttggcaatcacctttttccatgtgaattttcaaaaaatgtatttatttatttagaagcaggat

SEQ ID NO: 124084 - DNA, 248 bp, Homo sapiens
accttacccctcacccttttcagcaattcctaccctccttccccatccgtccctctaggcatcactttgctcttctccaataatgacctggttttctcaagtaaccacataactcgaagtaagcatttagctgtcagcccttagacacagtggaaaggtgtgggtgatatttgatggaaaggaggagaatttgattaactccctataaatgaagaaagcaaaatcaataaatttatcttttatgttcc

SEQ ID NO: 124085 - DNA, 331 bp, Homo sapiens
ttggtacatagttcttagtctctgtgaggcaggtctcggtgtcttattcaccagttttcatctctagcacaacatattcttaagtttggaggcccatggatataaattaccttcacatattccagtaaatcgggaggacatatcaattacagtttctggttagggaggaagattttcctggcatggctgaagagggaggccctaatttcttgtcagtacccactgatggtttcaggaaacccagcaaaaacaggtattctctaacagtctataagtgatattgtatctgtaagaatcagtctgaaattttcagggtatttctctatgaaga

SEQ ID NO: 124086 - DNA, 687 bp, Homo sapiens
tgtggcactggcagatctctgctgttgcaaccagcctctgagctccttttttctcagtagctcccaggcattcaaagtgtgccagtttcccatcagtgctcccagtcagtcgagacataaactagtccctcaggcagcccccctgaaaagctggaatgttagatgtacattccattcttctcttttcttcccaagggaaaagccatgaattgggcttttctcctgcagacactgagcgatactgggttaggggaagggctgtcacagttgaggtgaaatggcttttcttacccatttcagcatggccattcttggcattaagcttgcctatggtcctgtgccttcttaactggtttctggagttctcataaaagcttctggattacaaattgctgttaagttgatgtctttgtggggaaactgaggtgcggggcttccttttctgctatctagtcaacatcacttcttcatgacaaggagtcttaaaattgagatagcaattttaggatcttgtctcttcactgaattttatgtgttgtatacctgaggagttttagtaaatggatttattgaaaactcgaaaaataaagagagaaaaagaaatgtgaggaaaagataaaattacagagtgttttaagaagtttaatttgttattgccaaaaccaaataattttaatatttagctaa

SEQ ID NO: 124087 - DNA, 618 bp, Homo sapiens
agggcggctggggcccgggcgcgtcacggggccgggtgtctcttgggtccccgtgggccgaagaggctgggcggggttccgtgggggccgcgaggggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctatagcagaccccacgttagctgaaatgggaaaaaactttgaaggaggcagtgaaagatgctggaggacacgtcagagaagaacagaaggaggacaatgggaaaagaagctcatatccggagaatattccaggcccactccaggcagtgggcaagatatggtgagcatcctccagttaagttcagaatctcatgcatggagatgaacgatgaggagccccagagaccccagaatccaaaatattggagaacaaggtcatatggcttggtagggacatagtctgggagctaatcatttcaactctggacaaagagaagctgagaaaactgacaactaaagatacattcagatac

SEQ ID NO: 124088 - DNA, 379 bp, Homo sapiens
tgggtgcttatgtgcctggcactctctaagagtttatatagacatagaaacctatcttatgtttatgtataaatgttcatatatacatatcttatttaataccctcatcagacagatgaggcagatgccattaccactctcatttttctgatgaggaaactgaggcagagaggttaagtaactggctccagatcatggagctgatagaggcagagccaagatgcaaacccaggcttcttgttgcagaaaccctgctcctaacccaacgttgtgctacttgtgaattggcagagtcctgtgctcatggaagacgctagggaacacactgtgttatggagtgctctccacgggtcagcactgtgttcagccaggactatcc

SEQ ID NO: 124089 - DNA, 272 bp, Homo sapiens
ctggtgttgcccacctcaggtccccacattgactgcacctggggcttcctgactggcctctccgcattcactcctcttccccaccaatccattcaccacccagtagcgacaccaaactttctggaaacatgttggctcttggaacatccccacttgaaattcattaatggattccccctcttgaaactaagaatgaaacccaaactccttacgtagcccacagggctcatgcgttatgtggcctcccagttcctctcaggccaccctccctt

SEQ ID NO: 124090 - DNA, 597 bp, Homo sapiens
aacaaggagcaagctcaaaaactaaagaaagtagcccattgcctggcaaattactagaaaaataataggaacgtttaatgtccataagaagactttctcatgaggccaggtgtggtggctaccacctataaatcccagcactttgggaggccaaggcaggtcacttgagccagagttaaagaacagcctggccaacatgaccaaaccctgcctctactgaaaacagaaaaattagctgggcgtggtggcaggtacctgtagtcccagctactcgggaggctgaggcaggagaatcgcttgaacctggcggagattgtagtgagctgagatcatgcacgccagcctgagtgacagagcgagactctgtctcaaaaacaaagactttcatgaaataaaacgaataatgaggtatccttggcatcatctgatggctctgagtatttgttgggctgctccattctgatacgtgggccattctgtccaacaaggtgtggcattgagaaggattggtggtcacattaagggcttgttttcttttatattgttaaataatagactctgaaatgttacttttctctgtaaaacaaggtagtactt

SEQ ID NO: 124091 - DNA, 292 bp, Homo sapiens
tttgccgtgttgaccaggctggtcttgagcagctgacctcaggtgatccacccacctcggcctcccaaattgttgggattacaggcatgagccaccgcacctggtcccaaatttctttctgttactgatttttaatttccttccattatggtcagaaaaaatacactgtaaggtttcaatctttttaaattttgtgagacctattttgtggcctaatatatatggtatatcctcatgttcacttcagaaaaatgtgtattctgctggtatcagatacagtgttcctatatgg

SEQ ID NO: 124092 - DNA, 605 bp, Homo sapiens
tgtggtggtgggcgcctgtagtcccagctactcgggaggctgaggcaggagaatctcttatgcccaggtggcggaggttgcagtgagccgagatcgcgccactgcactccagcctgggcaatagagtgagcctccatctcaaaaaagaaaaagattcctttttcctacttacacctattaaaatattaaaggatttatgtttaggaatttgagattttatcacaaaatattgaatttactatgttaacatagtaaatggctatattttgttaaacatctgtgtgaattctgttagtagtagtctcatctctataaaaattgtagcgattgtcctcttcagtcaataacaaagccacttaaattatgtaggaaaagaaatgtggactagatgaatgttatttttagttagttctcactagaaattagtattataatattcacaagctctgacataatggatagataatatatctttaacaagccattttacacaaatccttttaaataaattacacagtctactcacttgggattgaaacattttaaaacaaactaagcaagaactacataatctaaagtgactgtgtgacatattagagagggga

SEQ ID NO: 124093 - DNA, 384 bp, Homo sapiens
gtccccctctccctacgctacagtctgcctgttctctctgcagtgtgacatcccacctccccagatgggagaatctgataggactagttggatactcccaagagagaccatctctgttgggtggaccatttcacagtcatttgccatctaagagtggctgcccaagggcctgatccatattcctggttcaatcacttgtattcagggtgatggagacatggataaaatagggacaaagaacagcagttaaggactgtggatgtggcatacacatagaacatcacagcctcctttcccacgtattttccacaatacatttccagatacccgataattcccatacacgatgaaaccatccgtaactatgatcccagaaataagcat

SEQ ID NO: 124094 - DNA, 332 bp, Homo sapiens
ctaaaagataagagtgtatgttaaaacaaaagtagcaaactgtaaaatatgattaaattgtcaacaaacaaagaaaatccagtgcttttctagagtggcaaaacattgcatgttgtcaactgtgctatttccctggctgaaaatgccctcttattctttctctgcttgctgaacctctacccatctcttaagacccagctcaaacctcatgccctttcaacatcaaccttaactctccaagcagtcttatgtgcccctcccaaaaacactttgtatgtacgtacctctgccactgcacttgtcccacggttaattatttcttcccctttatg

SEQ ID NO: 124095 - DNA, 730 bp, Homo sapiens
tgtttacagggcatggtaaaaggaataaaggtgaaaagaaaaatataatgtctggacaaaagtctttagaattttatacagatatattcttcatatgtgcaaagtatgcaataaaggtatctgttttggtttctataagacatgcttggcaggcttctgcctgggcttccctggccagtgctgactggcagggacaaactatctctcaggctcacagtgactctgtcctggctgtcctcatgctcggagggacatgcggaccaggtaccgaaaggagtgtattctgtcagtgctgcagaaacctggaccaaccttgactctggtcttgatatcaaacctggacaatggagctcactctggctacacagaggtggggccaacctgggcacagacaacatgctccttggtgctgccgtggcctcaactgctcactctcctagtgagtgtttcatcctaagcagggcctcctatttaggccctacgtgaggccctatgtgtgatgtgtagagtttccagcaatggggcttggactggcccatcccagttctgactctcctggccacccagggcctacctctgctgatggccagtggtagatggcagtggttctttttctaaatctcaccctgtgtgctcccctgcccatggcattcagcagccaaagaccagagaagtgctcttctcctgcctgcaaatactgtgaagatcaccccatcacccagcagttcag

SEQ ID NO: 124096 - DNA, 293 bp, Homo sapiens
ggcacctagaagaggctatgaggctgtggggactgcacctttgtgggtgccactgctgtggttattcaaaggtgacctcagcccctctttctgtctcttgccctctagctgggggggcagtatgtcagactaaactgcttcctcttgtccccatgtcacggagcaccagtgactcgacatcccaggccactctgtctggagcatcccctgagcttctggcaacaaccttcacccccatgtgactgtgcagctcgcaggccctggaaagttgctggtgccttgacgttggactt

SEQ ID NO: 124097 - DNA, 593 bp, Homo sapiens
atggtttatgtaaatgcacacccttctatatatgtatgcacagataacactagcattgatatatctgtcactcggtttattaaaagcaggcaaatgaaaagacaggaaaagtagttcatgtataaagtgttgaaaccacagagttacgttatagccgcttgggagtaggagcagaacgttgctgtgattgcgccagaagagagtcatgacccctgttcgcagtcagctctgcaaagccattttacatgacagcccccacccagtttggttcagagcattcctgtatgctagtatatgagttattaatagtttttatttctttcagacctctttcctgattctcatcttgtctttttcattacctttctattttatttctagaaataggagtattagggtagaggttttagcttctgtttttcttgcactggagtaccaacattttgtttttcattttatacatttttgtaactgatacattggatagtttatatatcttaatttttttataacttactggagttgatttgacaagttaaaatataatgggactgaaaaataacttgagatataattggatcttacttgatact

SEQ ID NO: 124098 - DNA, 521 bp, Homo sapiens
ccaggtttgatttgtcctggtccctctctggctaattagggtgagagccgccatccttccttccctgagctgcatgcttgattcaagagaaaaatctttcttttgtcatacatgacactggcatgtttctttagtgatgataaaggcgacatgatcagtggcatgaaataaaggttttggagtatataaaccatttttacagcggctacaaattttagaatgtgtgactgctattatgtatgatggtaatcttttcatatgattgtattgggcaagtatgtctcatttctagggtttttatctgttttgtttgtcttttatggcatatgtgtacttagaagtaaatatagttggtactatatataatatgtacaatacaataaaaaataatttcattgtccttattttgttctcactggacctgttgaggtgggagaatcgcttgaacctgggaagcggaggctgcagtgagctgagattgcacctccagtctgggcgactttgagaccgtgtctcgaaaa

SEQ ID NO: 124099 - DNA, 131 bp, Homo sapiens
catcatggtgtcaagtcttggagcagaggcatccatcaggggctcccgaaggccacggtctgcatgcccacgtgcctgatcccacccacgtgcctggccttggctcccggcggccggcagcactaccttgt

SEQ ID NO: 124100 - DNA, 284 bp, Homo sapiens
ggatggctggatatagaaaatggatgatgcattcctgacccagatcacaaaactgatacaaaggcaaggtgacagagagtctcaactatcagcccattactaagaactccttcagctaaacccagatgacagcccacttgatggctgattctttatttttttttttttttgagacggagtttcgctcttgttgctaggctggagcacaacagtgcgatctttgctcactgcaacctccgccctccaggttcaggcgattctcctgcctcagcctcccaagtagc

SEQ ID NO: 124101 - DNA, 266 bp, Homo sapiens
ctgcccccaagttaaattttgtaataaggccctaaactacaacatcaagctggaagtcttgcatatgaaatattcacgcgttttgacagatgaaacccggagactgtaacccacaggacgcagggattaacacaggccctgtttcaagctgctaggatgctgagctcaaaccacagcccacagggactcccactggcaggggccagcgcttaggagatgagcggaccccttaacttcaaggagagggggaacttcccgtggaccag

SEQ ID NO: 124102 - DNA, 421 bp, Homo sapiens
gaataaggtctgctctgttgccttcaataccagaaaccacgctgggaatgtgggctgccatcttcaaggctcccactgaactatggaaggttgtggggcaagggcaagtaaaaaaacccagttttcctaccattttgaagttgcttttttcttgattcagtgttcatttggagtattagtcagttttcacactgctggaaagaattgcctgagcctgggtaatttataaagaaaggaggtttaattgattcacagttccacttggctggggaggtctcaggacacttacaatcatggtggaaagctaacaagaagcaagtaccctcttcactggctggcaggagagaggagagagtgcaggggaaactgccacttaaaaaccatcagatctcgtgagaactccctcgctatcacgagaaca

SEQ ID NO: 124103 - DNA, 589 bp, Homo sapiens
cgcagtggctcatgcctgtaatcccagcactttgggaggccgaggcagaggtgggcagatcatgaggtcaggagttcgagaccagcctggccaacatggtgaaaccgtgtctctactgaaaatacaaaaatcagccaggcgtggtagcgggcgcctgtagtcctagctacttgggatgctgaggcaggagaagagcttgaacccgagaggcggaggttgcagtgagccgagatcgcatgccacggtaccctagcctgggtgacagagcaagactcatctcaaaaaaataaaattcatgcggggaaaaactctacatgaaaaccccatatttcctacagacattaaaattatataagaaagaacgtcttagactggcataattactggtgccaattaatttaagaaagcaatattagtgggtcaagatttctcattccttaccaaagaagcacaggcttcaaagaagaatttacttcagaactacaacaaaaagctacagttaatcctacttcttctttataaatttagacttttaaaaatacagtacatttagtatatattaaaaagagacaacaccaaatttacctta

SEQ ID NO: 124104 - DNA, 128 bp, Homo sapiens
ggcagctttacgatataattaggggtacagacttccttctttgtgctcacaggatagttgcgggaagaaggaaaacagaaagtggggaaaagcacatgccagttgagtttcgtctcttttaatcaaga

SEQ ID NO: 124105 - DNA, 363 bp, Homo sapiens
accttcctccccaccctaccaagaactcttctctccagacagtgttttctgagcagatcacaggatggatgccatttcagcataacttcttcatctaaaagaatcagtggatgcttctatccaatgatgatccttaaacatgaacagccaatatattattgcagtgagttgactatattccatattacttaaatcagaatgtttatggatacattccgacataggggatgaagccaaaaccattgaaataaacaagaggccaacttcctgctaagcattaactctgttcaaggattctcctccacctccaaacacacagtgacaaaggccaaggcacctggagatcaaggattcatgcagcag

SEQ ID NO: 124106 - DNA, 629 bp, Homo sapiens
actgttgcccacatcatgtggtctacctgtgctaataggttcatgagtcttgtgtcaccctgtttacactgaggaaatgaaaccaaaggtattagtgtctctgaatcaggtgcctctggaaggtacagatactgggtggaatgttaggatcatctccgtgctgcaagatgtcctctggtcttcaggacagtgtcatgggagtggaccgaaggtgccatgtctgaacagtcctgggcatcagattcccaactcacctggtagctaatgaaccttgaatatcaaatgcagggagccccacctacccacagggtggagagtgtgtttgatagtaatcttgtatgtgtgaagatggatattttatttccattagctgtgggctcttgaaagtgagcaaagttggttgtggtttaactgtcctcgttttgtcttacaacaccctagccaccccatgcacagccccaaccagtaggggccggtttgactttgagcattttccatgaatcaaccacatttgccagagcacgtaaacaaaagaagcctgagaaaataaaacaccatccgccacatcagcgccctcccaccacccactctgcctcctccaccaccaccactgcattctctctctacat

SEQ ID NO: 124107 - DNA, 288 bp, Homo sapiens
cgtggattctcagatcttcttcatgtgatgccccgccctccacgcaggaccaggtggggccatggactgggcaaggggaacacacccgctccccacttgctctgagtcagggacggtgccagctttgcaaggttcacaggagctggccaggcccctgtgcatgggcaccaccttcccagcctctctgtgcgtctgtttcatggaacaaagcctggtccacgggcttggggccagatgcttctccaggcctcacactcctgcagctagaataagcagccatgtctgggc

SEQ ID NO: 124108 - DNA, 484 bp, Homo sapiens
actgtattagccaggatggtgttgatgtcctgacatcatgatccgcccgcctcaacctcccaaattgctgggattacaggcatgagccactgcgcctagcctgggaaaacatttttaaaataattgttgaggaatataaaacagcttaaaaataaaatgatagagttacattactttcacccgtaaaccgaatgttacttttactaatccatgttatctgactaaacagaaactgtcgtccaggtattctgtttgcttccttgctcctgtctttcacttccctattttaagaatttgactcatgtcgataaacataaaatgctctctcttcctacctctagtagtctatgtaaattattgcttccaaaagtcaccttctcaaaaagtcctccaagactctactcatcctatctaaacacctttacaaaaccacttcctttgggcaccatctgtgtgcaaagatctaaggataccccatctctca

SEQ ID NO: 124109 - DNA, 626 bp, Homo sapiens
ctgccgctactactacgacagcagtatggtggaccccctggcaaacttctctgtcttcttccagccctagtgaaaccatggttaagaaatcctacactaaatgacaaagtcaaatcaagctgtaagaattcagggtccaatccaattccatccgtgaacagttgcaatcccttcccttgatcaaagaactttgttgttggttttgtttatgctttcaatcttgtttttaagacacaaacagggaaggaacttggatcatcatcaacctgaagttgtgtgtacctgaacctcccagaaaagacaagaatacattcctacctcctcattttacaactgattacttcagcaacacatcggcggccatcaagttttactaaattgagaccagaccaactccagagtcatcggacagaggcagatgaggtagcatctggctagagagatggcgggcacctgtcaatggctgctcttgcaaaagttactgagactcgcagtaagaattacagccttcaaatcaaaagaaataagcgtttaggctgcaacacatagcataagacagttgctgtgggactttgcctgtgaatataatttctgttgcaatgtcatggttccaatggaagtggaga

SEQ ID NO: 124110 - DNA, 210 bp, Homo sapiens
caaggctgcttcttactcagctgctgtggctttttggaagttgcagctcagctggccacgtctgcacaccctctcccacgagaccatacagcgatgctccacctcagaatggtccacagggaggaggaagggagaatagtttctctgcaagctccttcctgtcttctgctctcataggtcagagttgctctcccgaggaattaagttccc

SEQ ID NO: 124111 - DNA, 400 bp, Homo sapiens
tagctgactctagaggatacaccttatgctctgacacaccacatacagagtcatttttattgagtaaatgtgtattttagtgcctcccacagggatggaccagtgaacaaaacaatgtccctgccatcctggggtatagagtactgtgtgtcttggggttgcagacaggaatcatgccaccataaataaatctataatacatggccaggcgcggtggctcacgcctgtaatcccagcactttgggaagctgaggcaggcagatcacctgaggtcaggagttcaagactagcctggccaacatagtgaaaccccgtctctactaaaaatacaaaaaattagctgggtgtggtggcggtacttgtgattccagctactcaggaggctgaggcaggagaatcg

SEQ ID NO: 124112 - DNA, 225 bp, Homo sapiens
tgctgggatcacaggcatgagccaccacacccggtcctcatttcctttttagatagagcaagcagatggctagattagggaattttgattctataaagcattttagaaagtcccgtatgatatctgtaaaattggtagatttataaccagttaaatgacagtgttggcctcagaagaggtctctggtagtaagtcataagcaccttgtcctagatcttgacctag

SEQ ID NO: 124113 - DNA, 731 bp, Homo sapiens
ggtaattatagtgctgttaagatctcctggtacagataggaaagtcagccctacaaagattgagtaagtcacactgagttctgcctgactccagagttcctgctctttaccgctgagattgggaggagcatgtggggctggaaaagataaatgcccttggtgtccttttctcttttcactctcagtggttaaaccaagatgcaatcagtatatgagccacctctcagtgtccaaagctagagctggccaaatggagcagatggccaccctgcttactgtgagtgttccctagtcttggccatgatggtggcttggctgttagactgatcaaaaattgcagctgggggtaacaattcatccctcagaggttcagaattagcatcactaaagttagcgacctttaaaatcaaaggaggtcctgcagtttagttccctttggaccaaagtcaggtctggcccttcagaaaaaaatccattattcagtgcagaaagctttcttcaggtagcactggaatcacaatataaagagaccaaaggtaagctagatgaaaattaagcagcattaatgaaacaaagagacttctgaccataatacaaagcagggtccaaaaattctactgctataaaatagggagactgtcctaaatgactttcaaggacccttccaattttaaaagtctaggtatattacttctacatgtttagactttattctagttcatagccacaaa

SEQ ID NO: 124114 - DNA, 930 bp, Homo sapiens
tgagctgagatcgcaccaccgcactctgctccagcctgggcaacagagcgctagactccatctcaaaaaaaataaaaaataaaaaagataaataaagaaggacacatccttacagacccacagcgcatctggcccagcaaacttaatgatcattccttaacatcagcttagaccccgtccagacctggcttccatcaatggcctttaaaatggcctcttgcagttggcttaggaagctgtgtttgtgccaggccccagggcgcatctgatgccctgaggacctggcagtcagctcttgttgctgacatcagactcgcccatcactagcaagcccagcctgcggatgcctcatgtgagaggctggcatgcctccctgtgtcccaggctacctgctcaacctctcagcatggcatttatggtgcccaggggtggcaggtagagctgtaccatggggacggcgatggcagacaccctgccttgattggccccaaatgctttctgccttgggctccctgtgggtgacactgaggtgtccacctctctctctggatcatgggctggctttggggtcagacgtttccaccatggctttgcctcctcctcttgaattggggtgagtcctaggacaggacaccccacctccctgaccctctgtctcttgtcaaaaaaagtctgtgaaaaggtgactaactccactccttgtaagcaaaacacagaatgaaactgtaatgagagctcattcatctgccacatcagcaaagacaaaaaagctccagccatcgttgctgggtgcaggtggggacacaggtgctccaggtatatgctggaggaactggaaactagcgccaccctgtggacagcgacgaggtagattctctgcaatttaaaaaatgctcatggccgggtgcggtggctcacgcctgtaatccc

SEQ ID NO: 124115 - DNA, 345 bp, Homo sapiens
caggacgaccttcagtttcctcatccatgaaacctggggaggttactctcaggaaggcttggatctgtttcttcttcatccctgtttctcagtgtccagaacagcttctggcacgtaataggcactccacaaatatttgttgaacgaaaggaagaaaatgcctagcagtcagtcagtctgttcttacctaagtcgagtgacctccaaaactcgacgctgcttttccctctgctgctaagcctaccagctcccactcacagtgaagccttggcctctcaggccttgcagggtgactcagttcaaatgtacattttattctgcactttctactgcccaccccactgg

SEQ ID NO: 124116 - DNA, 500 bp, Homo sapiens
cagctcggtttcccttttggggtctttgctccaggaagagattcaagctaacgattgactttttggctatcagttaaggagttcatcaaatgcctgagcccctgtcatatgctggactctaccttgtgttaggtatacattttctgagccttaacaaaaagattcttccttaatttatttagcttccccacacattattaagagggggagaaaattgctcaatacacattattatgtggatgtaaaacgtggactgaatggaggaaaggctgtttgcctggagtcttttttgagtatctctcagagaggctcataatttcaggtatgggagaaagtctagtcattacccagtccatcaccctcctttcatgcatgaggatagcaaagaccccaaaaggggtctttgcttcattatctcaattacggggatggtgtttcatggatgtatataacttaggccaaaacttatcaattgctaccctttaaaatgtgaggtttat

SEQ ID NO: 124117 - DNA, 416 bp, Homo sapiens
aggtctgtcgaacaacgtactggcatcgattgctccgatgacggcaaaaagtcagagtacaatactaatcacatttctgaaataaattacatgtgctcaagaaatcttactagtcaaatcaagagcactgagtaccattcttccaaaaaagtaacactgagagagcacagtacaaagaattacggtaaaaagcagacaacatcggcgtgagtcagggaacggcttatacaagtcacatgactcaagagatagtgggagaggcacataattccaatatgggaagatgtgcacagaaggataagtttataatcttaggaaaagatcagcagatttgattacataaaatcttatgaaaggtaaaagatatcttaaaaggcagaagttgagagggcaattgggtgggggatagaggagga

SEQ ID NO: 124118 - DNA, 489 bp, Homo sapiens
gtagacaatgaatgtgttgattgaatagttaatgtgactaggttaaagagaggagaagtgcaatttgatggatatgtagcaatgattattttggcaaaaccagattttcatattcctgaaatatgttattcctagagtttacatagataataaaggtacattataatctttgaatccttaaaaatatacataaatgatttgatatattttcatgacagtacaagcttaatctcttttctaacaaagaaagaagctggtacttggctgagactgttgttcttgtcttaagcactgattgacattaacagcaaaatctcctttttcctgtaatgttagctgtgcttgaagctagctagcatctttcttctatgagagtaaaagctgtttcttttattatgtcgttccgcatacttctctcctggattgtatcacaagggaaaaaatcatccccaatccattcctgcttgtattcccatagaatattttagg

SEQ ID NO: 124119 - DNA, 305 bp, Homo sapiens
gcacctactctgtgccgggtgatggagagtctctgttggacaggccagacaaggtcccagccccagtaaagctgtggattctggagagggacagagacagtgatgataaagacatggaaacaaaacagtctgcaacaagtactgtaaaggaaaacaaacaggatgctgtaacagagaatttgggggactgcttagggttcctgggacatttgaggagctggtaggctgagatctgaagttggagctgaccatgggaagagtagagaggaggaaaaaatgttccagatagagacaacagcagctac

SEQ ID NO: 124120 - DNA, 651 bp, Homo sapiens
tgagccactatacctggccctgttttctttttaaatacagtttaaggcacggtggctcaaaagcctgtaatcctagcactttgggaggctggtctcaaactcccagccacaagtgatccttccacctcagcctcccgaagtgttgggattgtaggcgtgggccaacacacccagccagcttcatttctgcaccgaaccttttattttgaaatgattgaaagattcacttgcagttataaaaaataacgtggaaagatctatgtaccctttacccagtttttgccaatggtaacatcttgcaaaactatagtacaatgtaataactcggatattaacattgacactttactatttttttagatcaaaggtgtatttcatacttaatggtcaaaatgattttcaaaagatagaaaaaaaatttaaaaatagaagtccaaataactaataggtgaatacataaataaaagtcttcttgtttcagcccctggcctcattccctaaaggaaaccactgttaaaaacaaaaacaaaccagggctgggcacggtggctcacacctgtaatcccagcactttgggaggccgaggcgggtggatcacctgagcttgggagtttgagacagcctgagtaacatggagaaaccccatctact

SEQ ID NO: 124121 - DNA, 319 bp, Homo sapiens
cccaccaccaagtcgcccttcctccttagacacagcacaggtactgcatacaggtggcatgctgcctgcagccgggtaagccataactcttgggcagtcttcaatatagatgaagtctttacaaatcctgaagctcctccctgaaattcaaaagtaggatagaaagactgcactttctaatgacaacctctacgtttctaaccgcacggttgatggaacgagtgcgcttatcactcactctgctgacctggcctctagggtacggctgaggttagggatacaacccccaaaggttctgaaggcctgaggctggaaacct

SEQ ID NO: 124122 - DNA, 491 bp, Homo sapiens
tgaagtgtttggagcagggatagaatccaagtctgtctgatttctggtctgaagaggtctgtcattaaatcagacacaagaacgcacaggcccagcaacatgggactattctgtgcaaggacagagagccctccagaccagagtgcacctgcagaactagaggtggccatcactagaaggcatgtcgtgcctcagctctgctacacgcacgaacgtttccagcctaaatgactgacttttgagtcagcccctgaaggggcatgcaagctcatgctctgcaaactggcagcacacctctcaggggtctgctgggtcctcaacaccacaggacgggcatggaccgtctccgtgcagcatcattttactggggctatctggggaggaagggattctattaataagcacagatatattatggagtaggaggcatcattcatgtggaatatataacgaaacaaagcattagaagaaacacaggctttgaagctgga

SEQ ID NO: 124123 - DNA, 618 bp, Homo sapiens
aggcaggagaatcacttgaactcgggaagtggaggttgcagtgagccgaaagcacaccactgcactacagcgtgggcgacagagtgagactccatctcagaaaaaaaaaagaaaagaaaagaaaggctttgttctgaggtcaactgctaaggggacagcaggcaaaactcaaatctgcctcccatatctgggttttggggcaagttttatgggttaggaaggactggttggtatgtgaaagtgctggcagggcaggatttgattggaaggacttcaaatgagacgacttttggtaaggcatggggaggggtcttatcaccagaaattcctagacaactgaccccccacttttgaaaatgttccagtgttcaggttccacataagtcccaaacgtttagttccatggttggggaaaagactttagttcccagtgtcatttgaggtcgaagttttcttttctgtgcatgccctggctgcgtaagttgcaacttcttagctctgtgtctgcaaaataactggccgttctgttatccacagagtagggccagataagactggtctggtggttacaaactgaaattcaaccagagatggatgcagatatacagaggatgtgct

SEQ ID NO: 124124 - DNA, 512 bp, Homo sapiens
aagcagcatgctgtctgtggctcgactctagaggttgcctttcaacgcaggaatcgtcatagttctcaggctttccatgcagttctggttgtgtagagttggtagttgaatatccttaaccttgaataactgacgttcttcctcaggtctggaactactttacagtaagattccacttgtaagactgtagtcaaaattcaaatgcacatagccaaatgcacatagcaatctattttgaggactgactatgcatagttatacacatagttttactatgagtatagcacttttagaaacagcatttgataaggtcatacagttacctagtcccaaagtataaatcacatagcttcattttgaattaaaagggtcttattaattgaatctcatgggagaaatctaaagactctctgctacctcctcttttgacacctattacttctttagtctacaattttattttgaaggaatatatttgttctcctccccattacatcactaactgtatctga

SEQ ID NO: 124125 - DNA, 422 bp, Homo sapiens
cctcacttttacaagatccatgtcctgttcacaagctccctgctcaaaggaccgccatagaaaatggctgcagcaacatatggaattttttttactaaagcaaattcttgtattatatcaatggggcttagatgagagacataaagtgaagccagagatcaaaagcctagaatgcctggttaaggagtttatcatacaggaatccattcaataaatacatcagttcggctaggcgcggtggctcacgcctgtaatcccagcactttggggggccgaggcgggcagatcacgaggtcaggagattgagaccatcccggctaacatggtgaaaccccgtctctactaaaaatacaaaaaattagcctttgcacagggagcggggggcagggggctgaggcaggagaatggcgtggacccgtgag

SEQ ID NO: 124126 - DNA, 309 bp, Homo sapiens
ccatctacttgcatcaaatctccaagatttgagtatgtccttgggacgaaaaaccccaggctggaaaaggtaagtactttttttcttgtattttttctcctggttatctttgattactctttgttatctttggtgactctgattactcttacaactattttatcatcttccagcatttctttattttctgattcgctatttctgctcatatttttgtttccttccttttattttcgttggattagctatgccttttcttactgagttggacacttaacatactaattttcagctgggtacagtggctca

SEQ ID NO: 124127 - DNA, 398 bp, Homo sapiens
agagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctg

SEQ ID NO: 124128 - DNA, 2222 bp, Homo sapiens
agcggagtgggacggccagcgcgtgcgcactggcctgtcagcggcggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataattttaattagttgtggtagaggaatctgggtgcttccaaatttatatgataaaataaataaattttttaaaaactattaacttgttattcaataggtatagtaaaagttaacagattaataagataactgcttaccactagtaatactaataaatgaactaaataaaaatacctagcataggagatttctttatctataaaataaatggatagcactagatgaccactaagacctcttccatcaatgaatattcatggatcaactttgtaaaggaatcaatagtagttgtgaagtacactaagcaaacacctgagggaaaaacttgattcccatgaaaatattcctgaactcagcaccttatatgcattgcattcatactaattgctatgttgccccttataaaccatggactggattgaaaggtgtataattctttattcagggctctggacctcttcattggaaccaagttatataccgaggtaat

SEQ ID NO: 124129 - DNA, 773 bp, Homo sapiens
agcggagtgggacggccagcgcgtgcgcactggcctgtcagcggcggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaagataaagaaaataaacatgaaaaaaatgcataatggattggacaag

SEQ ID NO: 124130 - DNA, 271 bp, Homo sapiens
aaacttgattcccatgaaaatattcctgaactcagcaccttatatggcaaaataataaataccttttattactcaattttaaaataggcaaaaagcaatgtataatatttttccaattgccattccatactcagctgtcttattgttgcacacttattagaactcaatgtgactgagatgtgaaaggttgatataattctatttatgacagggacttagggaacttattctaattgagaatcagaggcttaataaacctgaaggtttaagt

SEQ ID NO: 124131 - DNA, 1649 bp, Homo sapiens
agcggagtgggacggccagcgcgtgcgcactggcctgtcagcggcggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaagataaagaaaataaacatgaaaaaaatgcataatggattggacaagaaaaataagcgattgaacactagttttttatggtcatgttaatattattcctttgatcagaatgctactattatgttatcaaaggatggttgacacagtatcatctttagatttttctaaactgcagagctttttctgttctatcttaaccctattccttcccctgaggacataccagagtgtcagaaagaaagaatgagaactaacagttatacccttaaaaagcttcacagtttatgcccaaacagcagcctgtttgataataactgctttaaaggatagtatattccaaaatatttatgaagtagcatatatttaatacccttttcttttagtttttcctccaaaaagctgaaatctccaaatatttcaaaagtaaaaagtagaaaatatgtttgattacatttttcttttagtttttccaaacatgagagaatatactccaaaagtataactgtagctaaaatatacaatgcttagaggaatatggtaggagataaatttggataataagtaaatagcatattatggttggtttttaattattatactttaagttctggggtacctgtgcagaacgtgcaggtttgttacataggtatatacatgccatggtggtttgctgcacccatgaacccatcatctacattagatatttctcctaagctattcctcccctagccctgaccccctgacaggccccagtgtgtgatgttcttctccctgtgtccatgtgttctcattgttcaactcccacttatgagtgagaacatgcagtgtttggttttctgttcttgtgatagtttgctgagaatgatggtttgcagcttcatccatgtccctgaaaaggaaatgaactcatccttttttatggct

SEQ ID NO: 124132 - DNA, 814 bp, Homo sapiens
tgaaatgtaggtctatatggaaaagttaccattaggaaaatatggccatactgcttttttacccctgcactatttcagtgcaccacagaataggattcgagatttacatatgcctgtttgtgattttatctcagaatataacaactctggattacattttcctctcaactgaaaaccctcagtaatgcaaagaaaggccttcctttttcttcagaatcacaagtgactaaattgccttctagccattttttcttgtaaaaaaagtgttttgaggaggctgtattttttattccatttcaatattaaccaaataggctgagaaattcatagcaattgaattaagacttgagttcaagatgttaaaggaatccttttgtatgacttgtccagaccggcctattgccctacccgtttgattctctgggaggcatggtgctcctcctggctgcacatgctctctgtgaactgatcgcatcttgggttcttctcaatttgacatacttgggagtcggaatgactggatgggggatgggtagaggatgactggcacacttgtatagtatgtaatgttgtgtacatattatttatatggttgtggctcaaataaagtttaattccaacacagtacagattatttggatcccagagccattgtcacacatgaccgaatggaggcttggggcaggaaataggtcctaggccggttgagtctgaattggcctgctcctgggtggggaatgtctttctctttcaagcaatgacaataaacaagaggtatttatcatcaccaataaacaatcccccaagaggtaca

SEQ ID NO: 124133 - DNA, 348 bp, Homo sapiens
acaaagccagactccatctcaaaaacaaaacaaaacaaaaaaaaccatatagtcagtggtccagagactaagtgaaaatttctggtggaaggtgaaaattgatttgaaccttaagggttgcataatttaaaatttcagcttatataattaagaaattatacacaatatttattgaggaaaaattacaaaaagaggcaatagaaatcacttatttcccctgctggatggaatttgataggcgcataaatggtgaatcagttcttaagcatgagcaagggaagaagcaggaaagttcaaagcatctttagaattaatgaatagatcatgtactgaaatactatgatcttc

SEQ ID NO: 124134 - DNA, 720 bp, Homo sapiens
cttttacacaaaacaaaatagaataacacaggattaaaaactgttaatcagtagaacatgtatgcacaaaaaaatgcagataagacgacaggcttattgacagtattcgccgtttttcattctgccttttttaaatgaatttatttcattaaatactctttgtaaacaagatatttaatggttgtactaaactatgatggaattatacttcactgaatatttaagtttccaaaatttgaggttacagtgaggtgaagattttggtgaacatctatatatacttagtacctctattaagtttctagaagtaaaaaggagtgaacgtttaacatttttacaacgttgtacttgatatcccctgccaatataatactttggccttccactagaaacatgagaatgttttttccttgagtcctaacaaaccttagtcttttctgtcactattttaggtgagattaaacatttttcacagcattctgtttatgccttttcaacatttttgtcacagactatctcagattaacacttttgtacctttccatatcaataactaatcctaaagttagtatgctcatgttttaattttttagtacactgtttttcaatttaatgttttcattttttaaatcttttagtttatactctattaaactgaaatattatggtttgaaaacataacttattttttaaggcataacttataatagctttgtattc

SEQ ID NO: 124135 - DNA, 348 bp, Homo sapiens
tgtttcctccatggccaaaaccactgggtatgccaagaatgttaggcatccctaggcatgattccaagtcagtagtcctttagatgcttgtcttagtgccagaacttaatgctacctctggatctaaagccatcttagtactaccttcctattggaaggctgtgacagtgaagttgaggctctagaaaataacttcctgatacggtattgtaagtagctgatatttgttttgttgtctagggttgactggatttactttacctagggaaatgatcaaagaatttagtaactaagagccttaaagctttcttcagtttagtttcagtaagttaatcttacatatttttt

SEQ ID NO: 124136 - DNA, 568 bp, Homo sapiens
gactgtagatagtcatgtatgataattcaatttctggatcgtgaatttctatgctgtatccctacacaaataacttttgagagcataccataagcaaggaggaggaggaagaggggagaggaagggggagaggagaggggaggggttggaggagaggagagcagaggaagaagagtagagaggaggggtagggaggggagagggaggaaacagcacctttgagatgttatccctgaagctcccatcaagaaactaggccagtggagaaaatgaagtccttttagcatagttgttaaataacctgtttcgcccttttcctcacttaccactatttctactactcctctccaatcctcctcttaatttcaagcagaaggtaccttttacttctctaaaaaaaaccctattttacccgtattttagattcagctgcttgctagctttttttactctctctctttttttttctttttttttaaagggtctggctctgtcacccaggctagagtgcagtgacatgatcataacttattgtaggctcaaacttctgggcttaggcagtctccct

SEQ ID NO: 124137 - DNA, 175 bp, Homo sapiens
atagagacagagaaagaaggacagagacacagcggccacctgaatgagcacaccaagatcaacttgactccctgggtgacaaagtcaatcctcagcaccgagcaacacgaatgactccatacatgcgatttcatgggtacagcttcacctttcccccttcttctctttcctgtgc

SEQ ID NO: 124138 - DNA, 560 bp, Homo sapiens
aatggtaatttcactttttgtgacggtactttagagcaaaaccgactttcttcacacaaagaatttgcaatcctattgaacagaggcagtacctgaatatcagaaatccttcattgtttaagtatcatctgatattcttgattggcttcagactgaaggttggagttgaattagggagaacggaggttaagtcctaaccttgaaagacttagcagccattgaaacactgcctttgggcacttattggcctgtatttataaaaaaaaaaaaaacttttcaattcaatgaggggagggagaaaacacaaaacttgtcacattcatcaagtgaagccactggaaagacatctacagaacacccaaaaagcataatctttccgaagcgctgatagaaatggtaattggatgggtcagggaataatacaaccgaagcaggggcaaagcagaatatcgctaaaaaatcaaggtcaaaaagaaaagaacagacccttcttaactagtaaaaaacttacacttggcctttgtactaagggaaaaatatacctgttgctacccgtaatt

SEQ ID NO: 124139 - DNA, 477 bp, Homo sapiens
acaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaaggttcgctcttcttcctgcccctgtcctatctccctgcccacaataatacggggtggaggcacctggaatgtcccttgccttatctaaaagtgctcccatatccaccttcctcatacttatctaagaggtctacataagggagctgaggtccaagtttctctgcgatgggtgttccgtttttgagagatggggcgggggtgtatctgtgtctgactccaggctggaccgtgatctccttcacaattaaactacagg

SEQ ID NO: 124140 - DNA, 496 bp, Homo sapiens
gctctgttccttccaaacttgggaggactctaagatcaattcccaggctcctgcccagccagggtgtgtcgggcagagcgcagagcagcctccgcccctccttgtcctgcttctgactcattatttatctttggcaggaagtaaacacagaaaggagagtgggagggagaggaggagtgagctcctgacttttgacgctggctgaaaaggaagatcatgtgctgaattaggtgtgtgtctgttttctgctcctctggtttcaacagagcatttgaggctttaaacaacaggggaagaggagtatttttccattaggagataatacccatttattgtagcaacttggaacatagcgaagagtgcagagtggagaggaaaaaatcaccaatgctcctaccatatgcagacaatggctttcaaaatattagtgttttcctcacactcttcttttttctagttcttttctttattgattgtgagatagctatattttgtt

SEQ ID NO: 124141 - DNA, 508 bp, Homo sapiens
caggagaggatttattttccttctcacttagtcatgctagaagacagaactctacatctcaagttttatgtcttaagatagagatcttatcatgctttccccttttcaggagctttcagtggtgactttcaatccagactctgtagcttagagttttaaaaagccatcatgatttgacttcccacctaagttgtttagtttaccttctgtctgtgctacatcattcatattttacacttgccttcttgcttctgagctttttgtgaaaggcatccttcctgtccagaatgccctccctctttctgtcatccttccaagaccctttcaacacaaggctctttaaggtctatcgccagcatccccaagtggtctctctatactccgtaagtgagaattcctatgtctgttgctccctaacagtttcctaacactttctctttttctgcgtttttcagtctgcctgtacttttggttatgagcttcatgagggtaaggacatgttctatga

SEQ ID NO: 124142 - DNA, 87 bp, Homo sapiens
aaaatgccttgaaataatgtaaccagaaatacgaaaagatgatacgaaaacgtcgctgctgaaggacatgaaagaatgtaatactag

SEQ ID NO: 124143 - DNA, 363 bp, Homo sapiens
tcagaacactgtacctattctgcaccacagcccacccctcaaagtgctatttgcaatcactcagcctccttaagggtagaaactctgcccctccggcacaggagggtgaccccaggtcctggacagtgtccagagtggtctgatacccttggcaaaccccctgccccctctccctccaggctgcaaactgttcagcatgaggctccagcaaatcccagcaggagaggtggggctgcccagaactggttcttgtttaaacataaacccattcgataattagcaaacagcccacttctaagataaacaaataggagatttggactccaaaagccccaccctagatttctcccttcccacctccca

SEQ ID NO: 124144 - DNA, 549 bp, Homo sapiens
gcagcaatgactttaaaggccagggagaggtgggaaaaggtgagggctcccaggatgcaatgccggagacatggtgatgtccttaggtccaggactgctgggggcaatggcacctgagggaggtaggtgtggagcatgaaggagcacagggtgaagttcaaatcatggctgaggccagttcaagctgagggtaaaggtgcctgaggagggcacgagagtcaagccaggtttgggggacaggggagagtttctaagttgtatgggtctgctgagggatccagcatgactgggtccagtcagggagtttgggggattcagagtgaagggttggatcctggacatttgtgcaggccaggagggaagaggaaggtggtggcagggagcatagagtccatgggtattgggtgtgtgtcccgtcaacctcacatcatgcaaaaacgtaggactgagttgtgaagagtttattcaagtgaaaagctgggaatggccattcaggaaaagacacactccagagaaatgggcacagggctccaaagacaagagttcttt

SEQ ID NO: 124145 - DNA, 328 bp, Homo sapiens
ggaagcaaatcttttacctgttcttcctctttcttttacctcttcttcttttcatttatcccttctttctcttctagcaaataagaatattgcataaatgttcatcttcctcggggtctctcattaaaaagttaaagaaaatatctaatttctagaaggtgactattttctcccttgggggtagggggctgcagagggaatttagagacataagtacaacccatgtgtatccagaggactgatgcccctagggtaagccctggattttgtaggtgcttagaacacttgtttttttaattttagatggtgggggatggtgtacatgtac

SEQ ID NO: 124146 - DNA, 520 bp, Homo sapiens
cagaactcctcggcctggggtcctgtttgccaaaaggaatctggatgttgtgagtgcctcaagtcactgactccccctcctcatgaccaggggatgatgagcagctgtttaataagccaccggtgtcaaacccggtggccgggggcccaggaagaaccccgacttgggagtgcagccccttaggcatctcagagccagggacaggaaagaaagacaggttgtgttgccagtgtgactgaagcaaattaccttccctgggctggtttcctttatctatcttgtctatcttttcttacctccctcccgggaccttgagatgccttggaaatcagatgggaaaagcactgtcactcactgcaggggttgtggtaatgctggttactgatgccactgggaacaccaagctacaggagtcagtcatttgggacagtgccagcagtcagagcacaggtcacacttgttccaaaccatggcagtcggtgcttgctgcccaaactattgtctgagtttattttttaag

SEQ ID NO: 124147 - DNA, 309 bp, Homo sapiens
actcccgtgtccacagcctggatataggctcttttggaaaggagacctgaccctgccaaaagagtgcttccactgagggcaggtctgacctggaggaagactacagggagctgttggggctgccaacactccacagatagctatgggagtgtgctttagtccctggagggtagggacctgggcatgataccacagcattcgctgcaggcctcatggagatgaggaaggtgccatctgagggaagagcattccaggcagaaagaagagctggaacttgcctggagggtttgagcagtagcacagatgtca

SEQ ID NO: 124148 - DNA, 839 bp, Homo sapiens
atagtgaaattgtgacacaccctaaaagaacaagaattactcataaagtgtttttctatttgtttcagagcttgagattccttgtcacagattctcagagagcaaaagtactttttagaaacacatttctctatgaacagtgaagaaatgttaattgggagatgatcctatcaaaaaccatcatggaacttgactgtaactcatacttatttcatttgttatagccaaaattaaaataaaatttagtagcctctcaagaattctagaaatgatgaggtggaagacgtggtaggtccccctcagaagtgaaaaattatcccatcattgtctttctctgggaactacttctttatggcattgtaggtttttctgtgaatgatttggaagagttactaaaaattagggtacaacattgtatttccagtgtgattccagctgtttttaatcattcttatattctgacacctgacctaagaaagacaccagagcatttacattgctcgtttgggggtaatgagacaaagactggaggagagtgttttcttttctctacagttttcctggattttccaaatttccttctgggtgcttgtattctttttaccttctagatggtcaggggaaaggctgagcactcctaacaaatgaagcattgtgagtttttcacaacaagtttcatgactacaagttgatggaggctgggggcattctgataggtcaggaattcttcccctggggtccgtggagtctgagggtcttctcgtagagaattccaaatcttacttcctggtgattgtaaacgtgaagttatgtgtgtgtgtttatcttgagagatacca

SEQ ID NO: 124149 - DNA, 559 bp, Homo sapiens
cctgacagttccctctgtggataagccatagaggtgtccagtgttggtttaatatagcagctggtttgaccgagtaccctctgctgcgtcaggtaatgttaaatgatgtccatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctgtttggtggttttatttgattgtttttgaattctttgtctctgacagaaggcatcttctgtatcctttatgttgtcactcac

SEQ ID NO: 124150 - DNA, 531 bp, Homo sapiens
gggtgacagagtaagattctgtgaaagaaaagtgaagaaaaaagagaagagaagagaagaacaaaaaattctaaaatttatgtggagtcacaaaacacccgaatagccaaagctatcttaagcaaaaagaacaaaactgggggaatcacattaccggatttccaattatactggagagctatagtaaccaaaacagcatggtattggcataaaaacacacatatagaccaatggaacagaatagagaacccagaaacaaaatccacacacctacagtgaagtcattttccacaaaggtgccaagaacgtacactgaggaaaagacagtctcttcaataaatggtgctgggaaaactgaatatccataatgcagaagaatgaaactagacccctacctctcaccataaacaaaaatcaaatcaaaatgaattaaagacttaaatctaagatcttaaactatgaaactagtacaaggaaatgtctggcaaactctcaaagacattggtctgggcaaaaatttattgaataata

SEQ ID NO: 124151 - DNA, 809 bp, Homo sapiens
gagccttccaaactattccagcctctgcctgttacccagttccaaagtcacttccacattttcaggtatctttacagaagcaccccactcccactaccaatttactgtattagcctgttcttatgctgctaataaagacatacctaagactgggtaatttataaatgagagactgactcacagttccacatggcttggaaggccttcagaatcatagtggaagagcaaggaatgtcttacatggcagcaggcaagagaaaaatgagagccaagtgaaagcgaatatcccttataaaactgtcatatcaggtgaggcttattcactaccatgagaacagtataggggaaactgcccccatgattcagttatctcccactgggtccctctcacaacatgtgggaattatgggagcttcaattcaagatgagatttggatggggacacagccatgccatatcaacccctatctctcaaaatatatagatctaaaataaaaattgatgaaagacttaaatataacacctcaaactatgaaactactacaagaaaacattgaggaaaatctccaggaccttagtctgggcaaaaattttttgaacagtaacccacaagcacaggcaaccaaaacaaaaatagaaaaattggatcacatcaagttaaaaagcttcttcacagcaagggatacagtcaacaaagtgaagagaaaatccagataatgagagaaaatatttacaaactaaccatctgaccaggaattaataaccagaatgtataagaagctcaaaaaaactctacagaaacacatcca

SEQ ID NO: 124152 - DNA, 396 bp, Homo sapiens
atcatagtactccctggagaacagcgggggtaaaatctacatctggcatgattcaccaccctagtgataacacatagtacatccgtaagggtcaccaagttccggacgcatcctgagaaatgtgaagactgtgattctagcaacgaggaggagacctgggtcactgggttgaaagatgtgatgaggcaacatgtgatgcccattcttgatggaaacaaaccagcaaagggtttttctcattgttttaagtgcttttaatgaattgattcattaaccacagagatattttccacagcaccacttactgccgaactttctgccaagaacaaggccaaaggcaaagatctccggacagctgcagcatcagggaagattgatgcagttatatcatccccc

SEQ ID NO: 124153 - DNA, 357 bp, Homo sapiens
tggaggaatatattatgttaaggttattctgaacctgtctaggactctggattgtatctcttcatactgaaatacaatttcttattctgaaaagaggataaggggtatgacctttaggtccttttgaggtaggtgctgtctgaagaaagttgctaatacaaacctggccaacatagtgaaaccccatctctagtgaaaatacaaaaattagctgggcatggtggtgggcacctgtagtcccagctactcgggaggctcaggcagaggaattgcttgaacccgggaggtggaggttgcagtgagcggagattgcaccactgcactccagcctgggcaacggaataagaccctgtctcc

SEQ ID NO: 124154 - DNA, 318 bp, Homo sapiens
gtacctgtgtcacagatgttactttgaggctcacacaagataatacactgaaggcacctaacacagtgtctggcacaaaataagtccccagttaactacatcacaggaagctggttgatttgaccttctttatgaaccatcagggactcagcctgtcccaggcagctagatttcccaacgcaacaaaagtcggctgggcctttgatctctcacaaggaatcacagctgagctacagctcggagtagttatttgcttccctggcctatacccctccactccccagaggcactgaagtagaagtagtaagaccctgcctc

SEQ ID NO: 124155 - DNA, 627 bp, Homo sapiens
cgttatggaggaagttgagatcactatcatctatagtctgtcacgtctaaatagaggttaccacgacttacttaacgtggtaaaggctacatcagagctcttcagcaaaccagcctagtggggagactggagacgtcttcccttcgaagctgggaacaaggcaaagattctctctcgcactaaaacagtattagaattcctgacccccagtaagataactccataaccagcagaaggaatgtgaacatttgtaattatctgtttacagtaagggccatctaacatagttcactgattctagcatgtactttttaaattttttttaagacgtgatcttgctttgtcacccaggctggagtgcagtggtgtgaacacggcccaccgtagtctcaacttctcgggctcaagcaatccccccacctcagccccccaggtaactgggactacaggtgtatgccaccattctgactaatttttgtatcttttgtagagactgtgtcaccatgttgcccaggctggtctcgaactcctaagctcaagagatcctcccacctcagccttacaaagtgctggaattacaagcatgaggcaccatgtctggtccttttttaaaaaatagagacaggg

SEQ ID NO: 124156 - DNA, 441 bp, Homo sapiens
ttcattgtactccagggcctgcacacctaaccgtggcaccaccacagctacagtccttgcagaatggccaggattttgaacagcagaattaggggagaggatattcagacacagccagtggaataaacaaaggcacagatcagaagtgtgttttggaagtttgattcagttggatcaggggttataacaggcaactgctgggagatataagttgggtttagacatggaaagcagtaacagctacagagttgggctttcattccactggaggcttttgagcaaggaggtgacatgatcacagctggcctttgggtgactgactggcagttagagatacaaccaacaggaacagggggagcctggccagggaggctagttagggggctatcgtagcagtctaggcaagagacattggagccagcatgaggtggtggcatccag

SEQ ID NO: 124157 - DNA, 495 bp, Homo sapiens
tcacccccagcccccaagggcaacccgctcaggtacctttccacgctgtggaaactttgtgctttcactcttcacagtaaatcctgctgctgctcactctttgggtctgcgccaacttaagagctgtaacactcacagtgaaggtccggggcttcattcttgaagtcagcgagaccacgaacccaccagaaggaaccaactctggacacatctccggacacaatgagatttggatggggtcacacgtccagatgatatcatcttccctgtcagcacagggtcaggcaggtcctctttcctcttcctcagagtagactgttttccctcatggtgttgaccacatgtgaaattatatctctattgttttgtcccttgtcagcttacctgttggacctaaatgtgattatatcagttctgtatctgtttgggttcatggctgttctcctgaatctagcacggggcctgatcgtgtaatacgtactcaaggaatctgca

SEQ ID NO: 124158 - DNA, 738 bp, Homo sapiens
atatgtaattgcacatctcaactcaaatagatcacatttcaagtgctcaacagctgaatgtggctactatattggacagtacagctctgtttaactactaaattataggacatacgagaacagagggacatggcatcacaaggatgcaaacaacagtgtatggagtctattcagatcctaatttgaacaaaacgtaaaacatttacgagagggcaatttgaacaatgattggatatttgtgatattcaggagttgttactcctttatttagatgtgataatggccctgtagttagattttttttttaatcacttaaagctacataatgaaatatttacagatgaagtaatttgatgcctgagatttgcttcaaaataatccagggtgagtggaggatgtatagatgaaacaagattggccataagctgataatgatttgaagctggatgatgggtacatggaaaaaaatcattgtactattctctttacttttgaatgtatttgaaattttccccaagttaaaaaaagaaaaaaaaagactgtgggataacattacaataacactgctcatattcttgaaagtacaattcattaaagatactaccatgagtctctctaaacctgaaagaaccagtggctactgccaccaccactacacacaggtaataaaccaggaaaatcttacaaataaaaaccgaacaagagtaatgctcatgttttgttttgttttttaatttt

SEQ ID NO: 124159 - DNA, 456 bp, Homo sapiens
atggggtgttggagccagagtggggtgagatgtgcacctgtgttgggggtcaggtgcagcctggtgtggcatgtcagagcatgagcatgttgagggcatcatgcgtgagggtggcctgcaggggtgtcagagcccagcagcatgtggagggtactgacacagtggggtggcctgacgtgggctgtccaagtccaagtggcagaggagtgagtctgagagatggggcagcctagcccggggagtcaaagcctaagcagggtgaggagctcccctgggcagagggtggccgagtgtggggtggcagagcccagggagtctgggaaagcatccatagggagagggcgtcattgtggaaatgggagaggaactacctacagggggctagatcagataagtaagtgtatatataagggactggagccaggcgccttgccatcaaatcagggaggtacagat

SEQ ID NO: 124160 - DNA, 444 bp, Homo sapiens
tgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctct

SEQ ID NO: 124161 - DNA, 369 bp, Homo sapiens
ccttctttactttcctcctctacctcttttcagataaattctggatattctcacagaccttctatttaattaaacaggcaggtgagccatgctcagtctgctcttcctgctttctcacaggttgcttctcatatctggaatttgcccatttacccatttttaaaatcaaaaattaaaagatacagaagaaaattaaaatcactacaaatccagtatcaaatgctttgagtattctcttctgagaaactacagtaaaaagatctcatgtattttcagaaaattctactgaaacaaactcacccaagtttttgtgacatcaaaagcactaacttaggccaggcgcagtggttcatgcctgtaatcccagca

SEQ ID NO: 124162 - DNA, 390 bp, Homo sapiens
ccgccttggcctctcaaagttctgggattacagatgtgagctaccactcctggctgctcctgtcatttcatttgtttttccagaaaattatgcattgtggttttgtactatgaaggaagtcatggaaaacagaaatgtattaggcatggtcctgtttaccccatatcttatactccataaaaagtaataaggcaaatacagcaataattctaaacttggaatgttcatgatcactatcataagagaaagtgcattaaagaagaaacagttgattttctggctgaacaatatcaaggacaattttaactggtttcaagttggactgaactagaccaactcttagctactctagttctagccatagaaattagattgaatggagaaaaggat

SEQ ID NO: 124163 - DNA, 697 bp, Homo sapiens
gtcctgtgattactcaatgtttaaccttttgaaagactgccagacagttttccaaagtgggtgcatattttatattcccaaaagcagtaaatgagggttccggtttgtccacattatcaccagcacttgttactgtgtgtctctttggttacagccatcctagtgggtgtgaagtggtatctcgttatggttttgatttgtaattccttgtcggctaacttgtacatatttcttaggctttgtagaagaaaaattgcatattggatgacatagcagtacacgtcttagttcaggctgttataacaaagtaccgtagattagtggcttataaacaacaaaacttttttttcacagttctggaggctgggtagtctgagatcaaggtgctcacagatccattgtcttgtgagggccagtttcttaatttgtagatgactgtcttgctgtgtcttcgcatggtgaagagcagagaaagagagatcctgtgtctcctcttctttttataagggcattaatcccattcttgagggttccaccctcatgacctaattaccccccaaaggccccatcttcaaatatgatcacactggggatttaggcttcaacatatgcattttggggggagtccaataccagtacatgttataagcatgaatatacagatactatattttaggtgattatattacatatccct

SEQ ID NO: 124164 - DNA, 276 bp, Homo sapiens
tttacaaatctaacactgttagagcccccagaatataatgaaactgtaggccaggcgtggtaactcaggcctataatcccagcactttgggaggtcaaggctggaagatcacttgagtccaggagtttgagacaagcctggacagcacggcaagacctcatctctacaaaaaattcaaacatgagctgggcgttgtgttgtgtacctgtggtcccagctactcaggaggctgaggggggagaatcacttgagcccaggcgatcgaggctgcagtga

SEQ ID NO: 124165 - DNA, 738 bp, Homo sapiens
gtctcaaagaaaagcttctcatttactaattttcagaaccagccattggtctgatagttacctgcaattgtggcaattttgaatgttttttgtttagagtttttttaaatattattcatggatttttattcagtgttttatagtcacttataatgggtattccttttgatgctcaaattatgcccattttggtcagtgggagtttatttagtcagcttctgtgtccttttcacccagccccatttgtatttgagtaccacctcgctttccagcccaaaagatgcccaagctcatcttgtactttccctgccacagacctgtagtcagccatttgctgaagtgtttttaaatgaattgatggtgctatgataggagtttataaatgctttgattgaaaaggattatttctgtaactgtgttcagtgccatttcttcctaaacgataactgtgagaattatactaccaggggacaaggaggaagtaattttgtttgctgctagatctctagttttcctttttgccctcatccaagtaaatgagagaaagaggagaaaccaccttttcccactgaagactttattcttggatgccagtttttacctattctttttctctgccatattttctttggattaatactgttgtttttgctttctttgtttctggtgtgtttattttagaataaccacacagaatactccctaatttcattcactcatcactataaaatattaggt

SEQ ID NO: 124166 - DNA, 503 bp, Homo sapiens
ttacactggcaagattgtgggtggagtggcatgggaaggtaaatgtgagcagacacactcagggatggagctgcgctgaccatatgaaaaggaaggggtggatggagagagagtgaagtgctgtaccggaggaaccctaattacacaggataaagccttaagggagcaactgttcatatctacacaaatcgatggggaaataaaagaatggaagattcaaaacagaaacagccatctgcacatataataaacatttggcaagttgtgatttctccatctgtcccccgatgagcctggagtactaagctgatgtatagcaacgacgcttaacaagaaaagcccttgagatgtcctcttccctatttctgtcagtttctcattctgctttataaattccggtagtgtgaccctttggtcatatttggaaagaagatacagatattaagaaacaaaagagattttgaagtacgtgcttgggtggggcacgaggggacagtgtggac

SEQ ID NO: 124167 - DNA, 479 bp, Homo sapiens
tacaagcctgtagccctaggcaattcctttcaagggggtagccttatcccagcccttgatttcatgtgagtcttctgcctcacatgggttatttagttcttagtaccctgtatgagtcttgcccctggatgcctctgtttgctgttggcagaattgagctggtctacatcttcaggctacttaccatattgtttctgttccatttctgggctatggagatgtttttaagtgtgaaaatgccttacatttttcccattttatattaaatctattatcactatcattttggattggcgtggtcctcaaagccccatcttgactagaaatcaactagcatttgcttctctgcagttcgtaatctagcttcctctctcacctttctcttggcaattgccctctctgaagtcactgctgttgtttccgagtcactgaatgaaaccgtttttccttcagcccccattttccttcactcctctgca

SEQ ID NO: 124168 - DNA, 168 bp, Homo sapiens
tacaagcctgtagccctaggcaattcctttcaagggggtagccttatcccagcccttgatttcatgtgagtcttctgcctcacatgggttatttagttcttagtaccctgtatgagtcttgcccctggatgcctctgaaggcccaaaatctcctcctgtccctctcca

SEQ ID NO: 124169 - DNA, 484 bp, Homo sapiens
agcaacttttcatgctgtggaagcttagttcctttgttcttcctgctaaatgttgctgctgttgactctttgggtccgtgccgcctttgagagctgtaacactcaccacgaaggtctgaagcttcactcctaaagccagcgagactaggaacccaccaggagggaggaacaactccagacgggaggaacgaacaactccggaggcgccacctttatgaactgtaacactcaccatgaaggtctgcagcttcactcctgaggccagtgagaccacacatccaccagtagaaagaaactacggacaagtctgaacatcagaaggaacaaactccggacataccatctttaagaactgtaacattcgccgtgagggtctgcagcttcattcttgaagtccgcaagaccaagaacccaccaattccggacacgctgggatactttgtgactttgtttacagagaaaaaataatatattttttcattcc

SEQ ID NO: 124170 - DNA, 547 bp, Homo sapiens
  misc_feature (526)..(526): n is a, c, g, or t
ggaccatgtttccacacggtcctgggcagacttaaataacgggcttaatgtggaggtggttttgtacactctggtgcctgtgctgttcctagcttttccaccagcagtccacactgctgagggttgccttctatagtagtcccctcttagcctcagttgcactttctatggtttcagttacccacggtcaaccatggtctgaaaataggtgaatatgatacaattagatgttttgagacagaaagagcccccattcatgtgactcattacagcatagcattataattgttctattttattatcagttattgttgttaatctcttactgtgtctaattcgtgctctgaccacagtgagtcattgaaatcactggaccttcaggtgaacccactggttctctcttaaggtggggactattgatgtcacaggcctgaatccattctactagtagatatcacaataaaagcaatagagatactaacccagaggtcaagactatcccatttaacacaatgactagacccanatggcaaagggaaataggtgg

SEQ ID NO: 124171 - DNA, 300 bp, Homo sapiens
accagggaagttgaatttgcagtgagctgagattgtaccactgcattccagcctgggccacagagcgagactccgtctcaataaataaataaataaataaataagtaaataaataaagtgtagctctggtcttactaagtgtatgatgtttgtctccatgaaataataataatgtaagatctgagaagttaatacttaaagtaaaacctacagcaaaacagtctgctgaatttgtctgtgatctcacaggagagtctagttgtaaaccgaagcaaggatggtagctaatatcgcagcagt

SEQ ID NO: 124172 - DNA, 414 bp, Homo sapiens
tcttttggttttgtattcccattagtatctagctaacagtaaaatcctactataagtggggtataaaatctggcatattgttattaataggttagtaaaatcatcagtgtgattttgcacagacggccaatagttataaaggcaatcaccagtcatatcagaactgcagcctcctggtaagaatagttgctcagagttttttcagtgaatgaggatttctgtttttattaattatgctaatacagattatttaagttcccacttttcatttaattctaaatacaactacgttggggattattattatttttttaagaagcaggaactggccagttcctgcttcttgaaaacacagctttagaactttacacagaatgtgctgaactccttgctcctaccaccttctaccactgc

SEQ ID NO: 124173 - DNA, 440 bp, Homo sapiens
tctagaggattcagcaaggtggttgtgggtaggatgactggttggtgttagagtgccactggggtgcttgggaactttggttcaggaaagcactgtgcagtccttttaaaagatgtctgcaagtttattagcagtccactcaaaaggtggagtctaagttttctcaccttgaatatggttgacttgtttctaataataggctgtggtggaggtgatgctgtgtgatatctgggaccaggagagaaggcaatatagaatccccctggttctctttcttgggacactcacccctggaacccagccaccgacgctgtgaggaaggaagcctgggccacatggggagaccacttactggtgttgtagcttggctgagctcccagtcagcagccagcatcaaatgccagacacatgagcaagctcctcattgactccagcaccag

SEQ ID NO: 124174 - DNA, 262 bp, Homo sapiens
cacagtacaagctgggtgtagctgaggaacagcagcctgtgtggctagagcatgtacgacggggagagctatatgttgtgcacagagctccgtggaaagtggctatgacactcgctctgccagctacagacctggtcttcagccacttccactgagcggcatcccacacaattcttacactcctgccatgttctaagttcaccctcattctcccactcttagcctcaccttgccctcattactgcttgctttcctgactctg

SEQ ID NO: 124175 - DNA, 528 bp, Homo sapiens
ctcttaatctcctcaattttatgccattccaaaatagaagtctctctgatgatcaagcctttcaatctttacagatggctcttttcccttctacttccttgatcagtgatttcacagacttgactcctttaatctgttagtcagtgtttggagactaattattgttgctgtttgctacaaacccctcagtttatggataacatcccagttatagtatcccagaaacaaaatttcatagcttataagactatctaaatttttacccttaaaatctagactgtttaaagttttatgtagtacatagattgtgtaactgtgtactatagaaaaccatgtactgtggcttcttcactttgaatgtatgtagaaagagtgattgttaattgttagcttttgcaaattaagtgtattctaatatgtgctgaaaactttaggtccatttatacagtattttatttcacaggttctttccacatcccagtatttactactaactacaaatatgttcgtttttcacctttacatttg

SEQ ID NO: 124176 - DNA, 528 bp, Homo sapiens
tcttttttggtttgcccactgaggtatccaaagaacctggaacagcaactgctgttcttattacacatttgttgaatgaatgactgaaactcacaaagctgaatgtacaaagttattgactgaagcactatgtatgataatggaaaagcagatgttcagctaaaggcgattaataaattatagtatgactataaaatggaatattttgcagctatttaaaaagatgaggtagatttatatatgttaacatagaacaatgaccataatataaataaaaaccaacaaattacagactagcaagtatattatgatatcacttttgggaaaatatgtgtatatgtacacataaaaagcatagaagggcacatacactaaactgttaataatggttaactttgggtgatgaatgggggggttttcttttcctgtaccaagtgaaaaatggaaaatttaaagcttacagaatttattttgaaataacattgctggatttttcccccccatgggtatattattttatagttagag

SEQ ID NO: 124177 - DNA, 524 bp, Homo sapiens
caaacaccgcatgttctcactcataagtgggagttgaacaatgagaacacatggacacagggaggggaacatcacacaccagagcctgtcagagggtggggggctaggggagggacagcattaggagaaatacctaatgtagatgacaggttgatgggtgcagcaaactgccatggcacatgtatacatatgtaacaaacctgtacattccacacatgtaccccagaacttaaagtataattttaaaaaatttaaaaagagtcgtaactgcatcttggctaaaaacaaatgtaaatagccataactgcatcttgactttattggccctaaaagaagaagaggagtattaggttagaagttgttcagctgcttcaccttgcattgaactgttctgagagaattcactcaaagtttaaataacttgcacagagatctctgaactcaaagttcatgctctattttggtgagtggtggtgccctttccttctgtggagattagaataagcaatgagtcactctggctg

SEQ ID NO: 124178 - DNA, 290 bp, Homo sapiens
gctcccactgtaatctcaataacacagatgttttttccaattcaagttgtgaatcttaaagcaaatctgtcaattagaagagagtcatcaggttctgtagttaaggtcttccagtgctaattcaagcaatctgctttccatctagcagaagctacaccccacatgtgtgtcctgtgtgattgtaactttgtttttaaagcactacctggggaagcatttcttataaaaattgtcgaaacaacgtaacactctcacccacatgtatttcctttcagtttcaacccatccag

SEQ ID NO: 124179 - DNA, 462 bp, Homo sapiens
tggagggaccagaatccaagttccatctgcctctgcccaggaatacccaatactatccagggtctctatcaccttttgtatctcacacacaaggacacagctaggcattcaaatgcctgtggaaaggtgaaatgaaaattgtacctcaagttccaatcctccccaagtggcctccaggacaaactaggggcagaccctcaagggatgcaggtagttctcaacttttaaggcaacctccataccaccctcgtctcttctgtttcctcagtttcaatccttaaagttttctcaggagttcccaaagacccctcaagaagagaaacaacattgggtgccttaattaactaaaatccttttagtgtttcctcaaacttgtcaggaagagtgtttcacctcagagataagaatgagctagagaccagtggattagttgaaattacatatccaatatcgatatgtaac

SEQ ID NO: 124180 - DNA, 372 bp, Homo sapiens
cttattaggtagaggctctaccagtgattaatttggctgcagtgtacctccctccctccatgtgtttctcacctaccttctactgcagtggaggttcctggcagggcaggagaacatagctcatcgtagagcatggagagcccagagcgcatacgcaaggcacagttcatgggttccccttcctcttcccttctgcaccctctgactcctgaaaacatccccaggagtgaaactggatgcaagcgtttgcactcagtgtttacctgtggaagtttcggtcacccacttaaccaagatccctgagctgtgcatgttagttgctttttcatcatgtctccatagcatggaattactgaggtacagctgcatgat

SEQ ID NO: 124181 - DNA, 572 bp, Homo sapiens
tggtgttctagaggatccctgcatttactccatggcgaagcagtggcagaaatggagaaaagagttgggtgcaggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaaaagagtgctgattagaaagagaaaggagcccaaaggcagatgggaaaaccagccaaggatggagagacgtctgttcattagtttgtagtttggacctcacctatcttaccaatgtggtattatgctctagtaaaaagtcagcgatggccgggcatggtggctcatgcccgtaatctcagcctcccaaagtatctacatttttttctctgtccctctttccaactgaatatagacttcaccaggccatggagtaaatgttc

SEQ ID NO: 124182 - DNA, 478 bp, Homo sapiens
gcggttctagaggatccctcacgcccatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctctagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagt

SEQ ID NO: 124183 - DNA, 375 bp, Homo sapiens
cgtaaatattatttgtttatttaaatatttttctcatgtctctcctaagattctgtcaatcttactacttttaaaaataatctatgatccaaatacatgtgaaggtactttatcaatagtaattattttaacatattaattattattattaaattttgaaagatttccttacaagtggcagatatatgttttattttgtttcatttttacaaagtaagatcttaaatattctaaagtttgtattgtgacttccagtaatgtaaactatatgaggctaatcctcttttcctcctttttgtttgttaacctcatttgggataactgtaactagtattattttatttatgtaataaaaatatatgtgaaataaagtgt

SEQ ID NO: 124184 - DNA, 306 bp, Homo sapiens
ggaggaagaagtggaaaaagggcacttcagaccaaaggcacagcatgagaaaaggcttgtgggtatgaaatagtgcatgcactactgtaagaagttggcatgtgctagatcacagagaggggtgcaggggggttgagatgggagaagagtcataagctgaagaacaaaggaggttgaatcagtggaggctttaaccagaaagtgtggaacattcaaaaggctccaagcaagaggtgttttagaaagctgtgagaggacatgctggagaaggcaacatgagagtggggagactagtccaaaggccac

SEQ ID NO: 124185 - DNA, 526 bp, Homo sapiens
aacattagcttagggggtaaagtaggttacccaactcggaaaagcaacatcaaagtccttataattaacacatattaggggcccaacttaaatttcaagcagatgtcatgagctgctcagagtagcgtgttacaactctgcgttataaggtaaagtgacttagagtgtaacagtagtccccaaacaatgtcaaatagacactggtaagtatagattgctcctctccttgcatcacaaatgttaattcaccttgcccccacacacattaaaactcagcatatttcacaaattgagtgtttcatttctatttcaggtagacttatggtaagtcagttttgctccccaaataagttagccatatagtacttctatatgcaaaatttgaatctcaattttactactcaagcaggaagtaaaagtcatttttctatatcttctttgctcccagactgtgttacagtttacagatctgaatattgtcacttgtacaccatacatacacagaggtctaaaactctctacaagt

SEQ ID NO: 124186 - DNA, 143 bp, Homo sapiens
tagctgcagtcctattgtcagttgtcagcactctgcctgttttcttttttgttttttcgggggttttcctgtttttttggtttttgagatggagtctcactctgttgcccaggctggagtgcaatggcgtgatctccgctcac

SEQ ID NO: 124187 - DNA, 152 bp, Homo sapiens
taagcatttcaagcaggtttttaaataaatgctttaattttttttataagataggaccttggctttgtggagcattatagagctatattttggagttgaaatttgagctcctttttggtaactgtggagttactgctcaggaaatgaactgt

SEQ ID NO: 124188 - DNA, 165 bp, Homo sapiens
tgctgggattataggcatgagccactgtgccctgccaagttttatgttgtatctatgtcttcttcagctctcagaagtttggtggtaaggatttgtaccattccaactgcaaagaaataaagttgcctacaatgaatgaagaagcaaatgtttacaaggcatgca

SEQ ID NO: 124189 - DNA, 358 bp, Homo sapiens
gaacgaaatggatattgcacattttaatggaaggactgaaatcctctgcaccaccaaaagttctagagaggacaaagcattactccctcctgttatccagcctttactctgcctttgcggctccagtgagggctagttgtgctggagcacgtccgccagggaagaggtgaggatggagtgttggtgagggcatagacccccgtgtagttctctgctgccccaggccacatcctcccaccaaggtatcaggtggcaagtgggcccacaacgtggggactcagtgcttagttttggagaacacaaaagtgcgactacttggaagcttctcttttaggtagaaggagatgtaagaacccga

SEQ ID NO: 124190 - DNA, 252 bp, Homo sapiens
cagaagttctaagtctgttctcattacacagtatcattgctcttatacattatatttaaaagcacattgtatgaaatgaaaaagtatccaagaaatggcccctgtaccatgaatctggccacatttcagctgtccaatataaaacttatttttgatgagacagtaaaaatgattaaggctcaatttctaaggtgcaatgttagaaaattctccagattctgatttgtgctcacttccttgggactcaattac

SEQ ID NO: 124191 - DNA, 698 bp, Homo sapiens
gaaggccaaagggtggaatacctctccagccctttttctaagtggtgacacttagaaaaggatccctagaggtcaggcctacacctcagagtgtccactcaccttgcatatgtatagctttggtcccgagggaagtatgaatcttaattttaagacactgggtgcctatcactttccaggacggtgtttgggattaaggatgcacaatttggtacaacaaagccttagctctcagtcagcttagtatatcccatatatgcctgggtaagtaatgaggttaaaggaagtaaaatgaaagattcagacaactactgaagaaaggtgatttatttggcagttgctttgtttcaccagtttatctgagcagtgtcattgagacatatatgaaaccatgtaagatcaatcatagagccttttaatattccagagcttgaagagattttaggatcacttagctataacctctcatttaacaaatgaagagcatgaaacccagagattttaaattacttactctgggtcacacagctaattattagaatctcagggtggattttagatacctagtgtaaccactcagataataacaaagattaataattatagccaacatttacctaaagttactataatatgtatagtcatatacgtaatctcagttctgacagtaactcaatgtaataggtttaccataccca

SEQ ID NO: 124192 - DNA, 268 bp, Homo sapiens
tttaagattgatagatgtcccgaaagaagtgtactaccgagtcactttctctctgcgcctctgttttcacatctgtaaaatgtttccacatctgtacatgcagtagcgtgccttacgaggtttgtccatccatagatggttgtgcagatggaggagataagcatctttaaggtgtgtgagggccatgtgatatcaacttcaccagccctggtggactctaggcagcatgttttggggcctcagccctgtctgggtgctgggatggcag

SEQ ID NO: 124193 - DNA, 197 bp, Homo sapiens
tagaggagcttaattctgcacccacagccgcagcgcggagccggatctggtcctaggggtatgcttttgggtgcagctcttcactttgaggcttcagtccctcttctgcaaggaagaagttggtcatagtggtccctaagggcattttttgttccaagtcccctttaatttaattacatttgctgggtggcagaatt

SEQ ID NO: 124194 - DNA, 488 bp, Homo sapiens
tgatagggtaacagggagtgaggcagctgttttgggacagggcacacagccaactagcatcatgatctctatcataagaggctcctcctggtcatgtcaatacagatttgattctacttttcacatggctgatgagttacctggatctacacatttcaatctcaatgttccaaagaaagcctacacagaggagcttaagcctagagtccattcattctaatgttcagaagaccacaatttgagtagacttaaaaacctcattactgttgaaaacaaattttggctcaagtaaaagctaactttgctcagttcctgactttcacttaaaaatgttgttaatgatttgctcatatttgaaatcaaaatgttaaaacaaatttggagacacgttgttaacacatactggtggcctcaatattctaagagcacaaatgagcatgtgcaacctccttagcattatgatgtcaagaaaacctctatccctccat

SEQ ID NO: 124195 - DNA, 399 bp, Homo sapiens
tctttgacatctactttcagggaaacttaatcagaaagaaggcaacgagtctcaggcttcattttacatacctgtctcaagagataaaagagaattccttcttcatagctttaatgcagtgccaagcttaagcagattacctgttgcttcccttatacctgggccttactttggccctgtttggcctcatgaatttgactatatctgtatgaaagttttcaccaaaaatagcacttttcttaggttatattatatccttcacatgctattaacccacatatttactacttttcccagggaagggaagaaattgtgggcatgggaaagatggcaactaagaattgagatagttctttatttagttcactaggagaacagattgaggaatggattgggaag

SEQ ID NO: 124196 - DNA, 463 bp, Homo sapiens
atttgatgacagaattcccagatggtgacatgcaatggttttgcagagtcaagagtttctctttgggacaataatttggcccatagaaaccatgatcacattctgaataaaagtagagatgacaaggcctaacaaaatatttttctaatcaccgaattagtcatatgaacaatgacactttgaaaagtaaatcacatttacctatatattaagttagaccatttttatgtgaagttgtgactgcttaggaaagtgggacatacggtcacatcgccctgacatgctgtgggtgttatttaatttcattatggatattgtttaacaaacataaaagtaaaaagaacagtgcatccatcatctaagttcaacaacatcaacattttgcccattccgtagaaacgtaaaaattaaatgtcaatgaccctgaagccttctttgtctgagggttttatatttttaaact

SEQ ID NO: 124197 - DNA, 294 bp, Homo sapiens
atcatcataaggtcagcttccaggaaaacctgaactgaggactatcagtgtagttttataaaacaagtggtattttatctgttaacaataacatagctcagaatttttaaaaaatgaataaatttaactggaagaactcttagtgttctgtcattttgtcacagatatgcaccagccagtgaataatgttttcagcataatttcagttagtcttggatgtaaattaacactggtgagtgtgtgttcacttccacatggccataagcctgttatcatctattttcttccctatcc

SEQ ID NO: 124198 - DNA, 196 bp, Homo sapiens
aaccctgctgcccttttgaattatgtcatttccttagcaagaatttttatttattgcttaagcatttaaagtgatttttataaaaacaagattgctcattgtaaatcatttacatagtaaatgtgaattgctattctttaattaacttgtgtttaaatagctgctgataggtcaaataaaatgcctgaaaatgacc

SEQ ID NO: 124199 - DNA, 518 bp, Homo sapiens
agacctcaattataccaatttctgcttagtagatgattgtcaaaatggctctgataagagtaatgtgatacaactctaagcacaaattgtggaagggaaatatgatctaatcatatgaccttggttaataagtttccaaaataggcctcagtaggtcttatctacttgagaatttcataatctgatgtcagccttgtctttcttgacctctgttgctttggatactgtgaaacagattcctccttctggaaatcttttctccctttgggttccataacctgatggtcttcctgctaccctgagagctccgtctcggtttcctctgtgagcttgcttctcagatggtgctgtgcctcaggccctatctcagctccgaccttttcccagtcaatttcatatacacttatgactcagctaccataaatatgctgaccatttccaaatctcttatctcaagcccaccctcttctcttgaacttgacacccagaacttccttttatttgtattaacaaaagaa

SEQ ID NO: 124200 - DNA, 345 bp, Homo sapiens
cagcagtagcagcaatggggcatgggaatctggctctgcctcaggaagggcatgaaaggaacctgtccctggacacacgctgagcagcagctccaagccacctccaggctagagcaggggcaggggctcccaaacggccgggacttctcccacaaaggagttgtttcagtcagagttctccaggaagacagaacccacagcggggagacagaggggtgagaagggagtttggaagggaattggctcactcaattatggaggctaagtcccatgacaggccgcctgcaagctggagacccagggagcccgggctgtgactcactcctggtccaaaggcctcagagc

SEQ ID NO: 124201 - DNA, 306 bp, Homo sapiens
acaggtgatgggaacacttcctttctcaaagcagccgtgggtggctgtaaaggcaaattatcccatgtaagtgatgccccttgagtttgtgagcagcacaaatggagggagggagggagggagggatggattataggggagaatcagaaaacaggagaaagaaacaagtggaagaaaatgaaccaaaaccacataccaatgtatgctttacatacatatatatgagcatttgaaggcatgtggtttctttcactaagtacttctctaagagctaccgacgtgggatgttttagcactaaaactcat

SEQ ID NO: 124202 - DNA, 435 bp, Homo sapiens
gcctttttgcagggggagggagttagtttctccagggaggcaattcataatgtgagtctgaaattgaacacaggaaggcaggcagctgtgcttacgaattaactagagctgatgtttaatttgcttcttattgatgccatttcctcactggttcattagctgtagttggagaataaatgccttcacagttcattctttatgatgtcctcagcttctgggtcagcctcatttgttccttatcttccctccaaaagagggctctctcttagcctctcctcatgtctaaaggctcatctgtgaatttctggggcagggccttggcttcagtctctgcacagagcagggtccccttggtatctacagtgtctgcccactgagactaccaaggataatgccattgcaacagtccagataggggtgttggaaaataacttg

SEQ ID NO: 124203 - DNA, 678 bp, Homo sapiens
ctagcatgctcacatgtgtgcacacacacatacactcatgctgtgaaagaaacattgagggtgctgtgagagtgaagaaagaaccctaacttagatctagagtgcaggaaggccttttccgaggagtgatttttaagctgagccctgaaggacaagtaggagcagcaagacaaagggatgtagaagagagtgtttatgcagaataaacagtttatgcaagggccctaaggtgcaagagagtttggcacattggagaaactattaataatgaggtagtaagaatggtgcaaaagtggtaggaagctggtgagataggcaggaagcagaaaataggggctctagccaggtgtggtggcattcactgtaatcccagctacctgggaggctgaggtgggacggtcgcttaattaagcccaggagtttgagaccagcctgggcaacatagcaagacctcatctcttaaaaaaaaaaagaaagaaaaagaaagaggctgggtgcagtggcttatgcctgtaatcctaacactttgagaggctgaggcaggcggatcacctgagttcaggagtttgagatcagcctggccaacatggtgaaaccccgtttctactaaaaatacaaaaattagctgggtgtggtggcgggtgcctgtagttccagctgcttgggaggctgaggcag

SEQ ID NO: 124204 - DNA, 355 bp, Homo sapiens
tggcctgccaattgaagccccagcccagggcccttgccacagtgctagtgggccacccttgcccatcatgcagcatggcatccatctgctcagcaccctacacaacaccggaggtaggggagcccaccacggaacccctcaccaagaaggtcctcaccatggagaaactgaggtactggaggcggggcctctgcagtcacgctgggtcacgtgctccagtcagccaagctgcagcggccaccaagggtgcccagggtctggcctgttggtcacagtgttgacctcatggcctgaaatgggtcttccctgaccagacaggttccagcccaccatcatctatcactgcctcagccct

SEQ ID NO: 124205 - DNA, 207 bp, Homo sapiens
tggtggggaaggcctgtgtgaattactccagggaacaagtgggaatgaggcctgcaaagagaagggactgaaagcgggaagggagataagccagagaggtctgcagggctggagtgtggacttgattccaggaacacaggcagcctctggaaggatttttaaaaagataatggctgggcatggtggctcatgcctgtaatcccagcg

SEQ ID NO: 124206 - DNA, 524 bp, Homo sapiens
ggatagggagataaaaagacaactgtcctttgtctgatcaacagaaattgacaagaacaactgaaaaaacaatctggcaagaaaggcaaccacttaggacaggggcactgtcaaatgaaaacatctcaataaccatgtgctcgatacctaaaataaacctaaaaatgaaaagaggaccggagtttttaataagacattttgacaaagctgttaaaaataatctttaaaataaactgagtatcagtggtctgtggtccctctccttatggcccatgctgtccattttctcccatatatttactctcttttaccacatcacctatccttctgtgtatctgaatgccagttgaaggccacagcagttttgtgtcttagtctggacaagaatatgtaatgtatagtcagctatcccttggtatcctgggggatttgttccaagaccctcctcagatacccaaatccaaagatgcttaagtcccttgcataaaatggcatagtatttacaggtaacctacacagagcct

SEQ ID NO: 124207 - DNA, 224 bp, Homo sapiens
cccgctgctctgtgtagccttgggacatggttccctgcctcccagccattccagcttaagctgtggctcaaaggggccaaggtacagctcaggccattgctttaaagggtgcaagccccaagccttggtagcaccttggcagcatccatgtggtgttaggcttgcaggtgcatagatgacaagagttgagctttgggagccttcacgtagatttcagaggatgt

SEQ ID NO: 124208 - DNA, 672 bp, Homo sapiens
cgcggtggctcacgcctgtaatcccagcatgttgggaggctgaggtgggaggatcaccagaggtcaggagttccagacctgcctggccaacatagtgaaaccctgtctctagtaaaaacacaaaaactagctgggcatggtggcacacacttgtaatcctagctactcgggaggctgaggcaggagaactgcttgaacctgggaggcggaggttgcagtgagccaaaatcgcactattgcactccagcctgggtgacaagagcgttaactccatttcaaaaaagaaaaaaaaaagtaactgttaactttaagcatcttcaactgacaaaccaaatgacattactttggaactgctccattcaccggacgaggaacaaaaaaaaccctcaagtttcatttcagtctctccttgaaaggtatttgattcctggcggattccaggtgcaaataatggttgaccattacaaatctgtgaggccacctcattatgagttcatatggcaaccaaatcccattttccctctgcaaattcaatccgcatcaatagccccatatatcactggctactgctgttggctgcctgattttgaaacataaaattttttttgaaagattactgccaacacgtaataggcaaactgcaatttcaattccctacgcatgtgcttgaag

SEQ ID NO: 124209 - DNA, 479 bp, Homo sapiens
aaagcaaacttgcagttctcaacaaagtgttttccactgatgtctgctaaaatggtacttaggaggtaaagtatgtaagaatatccttctgatgcaattacatttaataacaatatcagtgtgggccactttcttagctaccaccagttctttaatgtttttgaaaattaacttccagtcttggccacagcagcctaagagtccccagaagtagccagttttaggcatatttgaaaggaatctgtcttttctacttgggaggttgaggaactttcaccttctttctcattcttctcatttctgttaacttcttcctcaatctttctttgtgctttcaggatcttctgttttattgactgtctgtatctttggtcccatgtgttgactgctttctgcaatgattcaaaactttttattttgggaattctaccctagcctggtccttgtcccactgtgtcatgtccctgttgattgcagta

SEQ ID NO: 124210 - DNA, 390 bp, Homo sapiens
aattaatggtgactatgataacacttttcacccgatccttgctagtgcattgacttgcgttgtctgcatcgagttcttaaaagatgcttggtaaagtcttgggtcacagttttaacttctgctggggttcctgctccacagccctcatttagaactgtttcactttggctattgtttagctttgggccatatttggctgttttttagctttgtaaaaatgctcatttaacggacacaaggcctgggttagaaaatgtagtatttccttccccctctgtttgcgtaggagctagcgctagtggaagcccatctctcccttgcaggattttgtggaaagtgacgaaaataactcaaaccacatcagtgttctgcttgatttccaccattctt

SEQ ID NO: 124211 - DNA, 415 bp, Homo sapiens
taaagaagatagccacacaaagaaaagtggaaggatgccaagaagaaggcacagcatgtgcaagtctccagaggcaggctggaaaacactggttgaactggatccaggaactgaaaaatatcagtgtggttggaatgactttggagggagacaggaaagggccaaatatataacctaaggttaagagtcagaataaaatccaaacagcagagggactatattatagagttaagcaggggagtgatatattatttgtgattatttgaaaatatttttatgaaacatttcaaacgtgtaaaaaagatatgaacactcatgtaccacccagcattatcaaatctaaacgctattgttagattcaaaattttgttaataattaaaacatacatgatacagcaatgcaactaaacaactg

SEQ ID NO: 124212 - DNA, 232 bp, Homo sapiens
aggaaagttgggggtgggaaagacaatggaactgtacacagtgatgtcattctcagctgcaagaaaaaaatcttaaggcaaccggattatatttgataaaagattaaagttgcatgcaaattctaactaaaaacatctgtttcctgaccctgtgcgagttctaacgttttgataggaattctggttttggaatttctgagtcttaagtttaccttcctcaactactgcctgg

SEQ ID NO: 124213 - DNA, 310 bp, Homo sapiens
tcataaccaagaagaatgtgctaagtggcaaagtagcaccaaaaccaattttgagttgacagggcaggttgcaatacagaatcaggaaccaggcaatgtaacatcagaataccatatggaaaaatctttcaaaccacaaattgataatcacttccctgtctaaaaacattaatggctttccatttgcacacagataagtttaaattccttagcatagagtgtggcctcattaataagatagtccccatctatcactgcagacacgattcctgaagtttcttgccagtactacttcaattacatgcagtgc

SEQ ID NO: 124214 - DNA, 1084 bp, Homo sapiens
acccctactcatcttaaggaatgcttccttaagaagtctgacacttttttcttttttttaccctggaaaacaatcagtccccttttacaaatctcttaaggttataaactcaaactgcactagacaatagaggcaaggaaaactattttgaagaaggcccaatttgaacctcagctcgctagatctgttgtctgctgggtgaatcctggggaattcattgctcatggaagagtggtgttttgaccgtcagtgggtatacagtgattgatgctttgagaaagccatgcaactcagaatcactatttgtggaacagcctccatataacatgatgtgtgtatgtgtgtgtgatgtatagctggctttgaataaccacgcttaataccctcagtggaacgtggtgcatccttcatactccatggtacacaatgtatactcacatactccaaggtacttcttatcctttctaaaggacactgtaatacatacacagtaaaacctcagctgaccaggatagtcctggttagataaaaattaagcaaattttctttatgtctaatacatatgacagtggtgtgctggtaaaacccttacaaccagcaatccagggggagaaaaagccctgatttgtggatttcaatgctgcaaacgctcctacatggtctatcttgagctgccaaggtgatgtcaactggcttgcaaaacttctaaaacctaagtcagctcttgggagctgtgcactggtgctggcacaccgctgacatttagtatcccactgacattagcacaccgctgacattagcaccctgatactagaatgttaaggatgtgccagccctgctttccactgtgtgcgctgctggctccgggcttctggagaaatcttgtctcgagcacttatagtcactcttctgttaaagagatatgaaaatataggctgttggcgatcaggctgcatagcccagttgtttctttctgcccatccagatgtaaacctgcatttctatgattttctgcttccctgtggaaagggagtgcagagagcaacatattgttattcaaatgttgctagttgtatttttttgg

SEQ ID NO: 124215 - DNA, 572 bp, Homo sapiens
ttaattttgtatttttagtagagacagggtttctccatgttggtcaggctggtccgaactcccaactcaagtgagtcacccgcctcggcttcccaaagtgctgggattacaggtgtgagccaccacacctggccgtatttttattttttgacacagggtctccgccctgtcacccaggctggagtgcagtggcttcatcacagctcactacaatctccacctttcgagctctagcgagcctcctgtctcagcctcccgagcagctgggaccacaggcgtacaccaccacgcctggctagaggggggacttttgatttgggtactgagatataaggaggagctggtctcaattccctgttcatagttgggtaaactgaggctcagagaagtaagtagtccactcgaggtcccacagctaattcaggtctgggatgtgaaggcccagcagggcctggggagtccaagagggatggatgctccaggctgagggtgcagcgaggtcaaaggcaggaagaaagggaagagggagcgggtcgtggtggctcacacctgtaatcccagcgctttgggag

SEQ ID NO: 124216 - DNA, 410 bp, Homo sapiens
tcgctcgctctagaggatccaccttaggctctgacccacctttgctcgtggcattctcggcatataggattcagctggcttcccatgtccctttccatatccggaccaaatcaatccttcaagtctgaattattctattctgtttccctgaccacctcagcgcctaggattagatacctcctttgaattcttagaacactgtctgttggacataactgttcagtatctgatatcccttgctattgtttgttaaccttttccatgcataattgaatcttccaccaaggctgatgagctatttgagataaagtcccctgcctcaaggaaaaagtcttctgccttaaataccaaaacagtggtttgaccagatttgaaggatgtgttcctgaaagtagaatgtcctcatgaat

SEQ ID NO: 124217 - DNA, 697 bp, Homo sapiens
gggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaa

SEQ ID NO: 124218 - DNA, 505 bp, Homo sapiens
tcatgaagctttccctctatgtattctcagggaagttgtacagtttcgggtcttacgcttaaatctttaatctattttgagttcatttttgtatataagatccaatttcaggctgggcgcggtcactcatgcctgtaatcccagtactttaggaggccaaggtggttggatcacttgaggccaggagtttgagaccctcctggccaaaatggcaaaaccccgtctctactaaaaatacgaaaattagccaggcggggtggtgcatgcctgcaattccagctactcaggaggctgaggcataagaatcacttgaaccagggaggttggagattgcagcaaggtgagattgtgccactgcactccagcctgggcaacagaacaagactccatctcaaaaaaaaaaaaaattgttttattattttgcatgtggatagccagtttccccaacatcatttgttgaagagactatcctttccccgttgtgtattctgggtactctttttga

SEQ ID NO: 124219 - DNA, 207 bp, Homo sapiens
aactcagcttctttaaggctttttttttccccccttatgtctcatgatatgttagtaagcatatggccatgtttagaagaaagtaatgaaaaggataagccagtgctgcataagtggtttctgaaggcatataacctggccatcttaagaacagttcgttgagaaattgctgagatcagtttaaggagtaacttccttttttttttt

SEQ ID NO: 124220 - DNA, 185 bp, Homo sapiens
gatgtcatgttgtacaaatgagaacgacaacctagatctgcttcaatgctgggacctacgatacaggaactcaataagcatttatttatcaaatgaatgaagacaaggcaactacccactttcattagatggacatctgagaataaaccatactactccaaacataataacatccattctactac

SEQ ID NO: 124221 - DNA, 261 bp, Homo sapiens
ctgaaagtgaaatatttgataattcctagtttcatacacctactgtatactctcccaaatgtctaaagtgaaactattttgtgagagatattgacattaagctttcttccagctttactcttgcaaacattgtctaggaggaaatgtagccatttgcatattgttttagcacctaaatgtagccatttgcttattgttttagtctggaaggtgttggagccggtgaaggagcaggtgtcatgctccaggttaatgtttgct

SEQ ID NO: 124222 - DNA, 503 bp, Homo sapiens
ggaggcagaggttgcagtgagccctgatgacgccactgtactccagcttgggcaacagagcaagaccctgtcccaaaaacgaaacaaaacgccctttgcatgttcagtgactggaatgtcagaagtgaaattgatgaataatttttgtaatatttaagtgcattcaaaatgttggacaggtaatttagatatctgggaatattgtagtttactggtttttttttttttcattttagtactagttgcatatatgctctgacatgaggtattgaagaaatatgaaatgtgtagtctctgctacgcttataaaacataattctgaaaatgatctttaatgcaaagaaatatcttctaggtttattttatacttattgatacttatatttagttcacattcaatctcttagatataagaaaactgtgagtgattatcagtttgaagggatttgtatattaatgtttgtatgctttttagtgtaataaaaactgtttcaatcttaaat

SEQ ID NO: 124223 - DNA, 730 bp, Homo sapiens
gacagtgagacaagaacttctcagcctcagggcacttgtggtcctacactgaagctattcagcttcttcgctctgctgatccctcgtccagtaacaagagaatagtctatcttctcgatatacttcagagctggaagaattatgtgagctttgttatgacaagccctctgatgagtgtatgaatgtccaggcaacactgtaaacgtaaagtgccatagaaatgcaggccggcgttacttgtaggctcaattcccaagtcttcctagagttttactcatcagaaagtctacaggcagccagttccaacatttttggcaagaacaacaaaatatattaaatttatactatatattatagatagttacaaaatatatttttaaattttaaattcttattttaaattagtattgaagtctgttaattgcaggaagaagatacataacagggaggtttggccaggttttgtttaacatcctttggggcccaaggattttataatttctgagatgagagtttagagtttctgactctcagcatagatttgatttattaggagaaatagagatgatactgtcaatgaggatttccagtcatttcctttgataggctatgctgtggtaatgcttcattgtgttaccaaaaaggggtcccgatccagaccccaagaaagggttcttggacctggtgctagaaagaactcagggcaagtccataaagtaaaagcaagttt

SEQ ID NO: 124224 - DNA, 284 bp, Homo sapiens
cctgcctcggtctcccaaagtgcagattacaggcgtgagccacagctctcaagggagctccttaaccttcctgcctcagtttcctccttcagagtaatgtcaatgaaactggaacattaagagtgagcagagttgatgctcacattaaggggggtgttttaaaggatgcccagggggctttgcttctcccaaacatcggacactgcctggaactgtccctcgggttgcgcagagcgagcccagcttctgaggcgacagagcccgcacccagcagtggaacccgt

SEQ ID NO: 124225 - DNA, 459 bp, Homo sapiens
ggtaagaggataggaagagagaatgggttcccagaagctcaatgaagaaagtatttcaagaaggagctgattaggtgctgctgatgtgttctcattcaggtttcagttggaacaaggggaataaagggaggactgaggtgttatatttaataatagttcactggagataccaaaacacctttgttggtgaaatagtggggatggcaccctgttttcagtgagcttaagagaatatgaggggagaggaattaggaaaaagagagtagagacaatgctttataaaggagtatcgctgtaaagtagatgactatataatgactgatcatggaatttaagttcagtaaagaaggaggtgagagaagtgaaaggtataggaccaatggattgtagatcctggagaggttaaagaatttttggagtaaggaaactggagagagtgagctggaaaaatagtggtag

SEQ ID NO: 124226 - DNA, 263 bp, Homo sapiens
agcagagccccctgaacccttctggttttggagtgctgcctgattcacgaatcctttaatgcttaactattacgtttatctgaagtttttcttttaatattcataggtcctagcagagggtagaaaatatttggggtgtgactcatgcctgtaatcccagcactctgggaggccaaagcaggcagatcacttgagctcacaagtttgagaccagcctgggcaacatggtaaaaccccgtctctacaaaaaccacaaaaattag

SEQ ID NO: 124227 - DNA, 540 bp, Homo sapiens
actgaggtcaccaagaaagtggcaacgagggcaagggaacctggcctcacagcatctgtgctcctggggcatgccccggaaagccattgctacagccccaagtgggcagacgaagagcctctgccagaacccccaggcagtcccagtcccgacctagggcctgtgccatgggtgcacagaccactgccgtcaccttaggagcctgcctgccgcctgcctgctcacaggtctacacagggacacgctcagtccctctgctcaggggctggctcccctctaacaacccggcttctagggcctctgccctgggtctgccttcctgcttttatagatgtctccacttcttccaaggaaatcggggtcatcaggcataaacaacctcaacttcccaccccatctcctcagagaccaaatcctatgtcaccaactctacctgtcagaaagcagtttttgttccaatgtccattctagaaacttttgtgcctccctccacctgccttagacaagctcccaaagagaacagccaccccatgccatctc

SEQ ID NO: 124228 - DNA, 401 bp, Homo sapiens
gaattaaaacccagggaagtgatctaacttgctgaagattacatacaaatgagggagaaatgaatgaagggaggagggggagagaaagaatgtgtgtgagagagagagagaactagaatagtggctgccaatgtagaatcttatctaataaattagagtctggtgaattttctccggattaattaagaaaaggagataacaagagtttaaggcggggttcccaaacttggctgcatattggaattatcttaggagttttacataaatctcaatacctggttcctattcccagagtctgattctgatttaattggtttgagatacatctcagacaatgggatttttaaaaagctcctcaagtagaaccactggcttaagtcttcgttgttagagcctaggaa

SEQ ID NO: 124229 - DNA, 547 bp, Homo sapiens
agctaagattaagccactgcactccagcctgggtgacagagtgagactctgtctcaaaacaaaacaacaaaaacaagcaaggcctgcttaaggagcgtgggctgaggtgagaccctttcctgtgtctgttatttagactccccctcccaaagggggtgaagaacaaattatggcatctctccaagcttcccctgcctataaaaaggccagttggcaaaagtaaagagttctactttctaaagtgacagattcaggccaggcatggtggctcatgcctgtaatcccagcactttgggaggctgaggcgggtggatcacctgaggtcaggagtttgagaccagcctggcaaacataatgaaaccccatctctactaaaaatacaaaaatcagctgggtgtggtggcatgcgcctgtaatcccagctacttgggaggctgaggcaggagagtctcttgaaccccagaggcaggggttgcagggagccgagatcacgtcactgcactctagcctgggtgacagagcgagatgccgtgtcaaaaaaaataaa

SEQ ID NO: 124230 - DNA, 485 bp, Homo sapiens
cctctcacactgtgggatacagttgggctcccttcttgaccttcctttccagagcgccaccctgcctcctgtcttgccggctgttcctcctcagagcctgtgctggttcatcctcatattcctgtcctttctctactgttgaggggacccaaaactcagtcctcagaattttctttaccttagtcatctcatccagaggtcacgttggtgatcaccctcaagtactgattacatccgcatttatttctggaactctccccaggactctagactcatacatacagctgcttttttgacatttccacttgactatctgctaggtatctcaactcatccagaaatgaactcgtttttccccgtatctccaacccaacctgttcatcccagtttttcctgtgttcataaatgtccactctggttgctcaggccgaaagtcttgaagtcatcctagacgcctttctttctttcataccccacatctaatt

SEQ ID NO: 124231 - DNA, 298 bp, Homo sapiens
cctatgcataagcatgtaccttccccagagtgtatgtttaatgtatattccttctctacttttttctcttctggaaatttttaatggttttcaagtactgtagcttctggtaacaagcagtgaacttaatgttaatgctatgagccttggattatgctttctctttcctgaagttatttatgccttaaggaagaggaacctgtcattgaaataaaaacatttaccttgtagaattatttgcagtgatttgaaaatatttggttaaagcactatcactactacttaggagaagagccaa

SEQ ID NO: 124232 - DNA, 575 bp, Homo sapiens
agctcaagcagtctttccatctcagactcccaaagtgctgggattacaggcatgagccactgtgcccgaccaaatattcttctttttattagttgatgtaaaagtctaaaaacaagttttgaaattaacttgatgcctttatttatggcaaatgggcataagatcattttgacaatttttatttatattatatattctaggacctttcttatctatgcttaatgtaagttaaatggttgtgagccacagacacaactgcttaaagggaaaaatggtttatttctcacatactctttgaattcctttcacatgattatttaatattacattaggagaaattttagggaaaaaaagatgctcataattctacctgctcaatgaaacatttttaattttttatacatatatagtgctatctcatttttatccatcaaacttacacatgtgtaagtattattaggagtatgcttgtagtttgtattttttgtttgtttatgaaacatatattttctctgttgctataagtgtttgtaattggttgttaatggccaatagttgaataaatcagatttcac

SEQ ID NO: 124233 - DNA, 424 bp, Homo sapiens
gaaggagtttctataaactaccatatagacaggatggaattcagaagcagcaataacatctggctttacccaccggatcagaactgtatgaaaggctgtctaactccagagactggtaacttttagcttaagaatagcacagatagggcaccaaaactgaccagggtcagttgtagataaactaccttaaaggagcagaggctcagtaactaggaagatgggcaagaagaaaggggtacgaaggttggcagatgggctgcacctattaaactttgtgtgcctatcaaactacctacatgtttgtattcactcaataaatcacacagctcaccttaaaacaccttatgaaatcatactctaaagtgggtctgaaacttcctcctttcacttaagaacatgttatggccaggcgcagtggctcacg

SEQ ID NO: 124234 - DNA, 274 bp, Homo sapiens
aagatctgactgggtgggcaacatagtgagacctcatctctatttaaaaaaaaagttttttcatctatagaaactaacatttaattgttagcagtcttgcccaagacctgcggggtcaggagtccaggactgtcctgggtgcccccgccttgcctggacgtgagagtgctgtgtggggccccgggagcccctggtcccacaggcagggccgacaggcaggtgccgtgcccgtcctccctgcccacgcaggtgctcagagggacaggtgggccag

SEQ ID NO: 124235 - DNA, 284 bp, Homo sapiens
actaaacttcctttctctcctgttggtgcagactcattttaatactattttacgtaaaataggtggaaaatagcccaggagataaaaatcatatgctaaaatcaaatctaaaatattttttgcactgtttatttcatatgcataactgaagagaaactgtaatatttttaggacatttccaccagaatttccaacagatgggaaatagtaagttagtaccattattccctcaattgtctggtcaagaaatttgagaatgttctttgacttcccttttcctccca

SEQ ID NO: 124236 - DNA, 380 bp, Homo sapiens
ctgccgcctactactaccacggggtgatgatcctcacctgatgcttgacaccatgctcttggacttcctagcctctggacccaagagccaaataaacttctgttcattataaattgcccagtctgtgatattctgttaaagcagcagaaaatgaactgagacacaagatcattgtgtttagatagtgaaagtgctacaagaagaactgcaaatgggtggatcaaggcaggttttaaaacttagaaaacactgagcaggacgtggtggctcacacctgtaacctcagtactcaggaggctgaggcaggagaatggcatgaatccaggaggtcaagagcatcctgactaacacggtgaaactccatctctactaaaaaaaaa

SEQ ID NO: 124237 - DNA, 219 bp, Homo sapiens
gcctggccagaaagtgagtgttggtgacatgctctaatctataaaccgtattaatgttttgccagttgtcctggtaatgccctttatagatttctttttttttgagatggagttttactcttgttgcccaggctggagtgcaatggcgtgatctcggctcactgcaacctccgcctcccgagttcaagtgattcttctgtctcagcctcccaagtagct

SEQ ID NO: 124238 - DNA, 757 bp, Homo sapiens
caaacagatttttcagctccaatataattttatcaaacccctattgtatatgtgtttcattgttgactgaaacatcattacgcagcacgtgactataatagaataatttttggcaatgcaaaggaatgaactgatggacacagcatgggtaaatcttaaaatcatgctaagtcaaagaagccaaatacaaaagaatatataatgcataaagggggatggacttaaaaggggcacgaagaatcttttggagttgatggaaatggtcagtatttgattaatgttgtttcagaggtgtatacagctgtcaaaactcattgagttgaccactctaaatggattcacttggttgtatataaattaagccatagtaaaattgcttacaggaaatatgctgaggaaaagacatctaacacaaagagcataaactttgtgatacctttatttgaaattctaggccaggtgtagtggctcatgcctgtaatcccagcactttgggaggccgaggcgggcggatcacaaggtcaggagatggagaccacactggctaacacggtgaaaccctgtctctactaaaaatacaaaaaaaattggccgggcatggtggtggccacctgtagtcccagctacttgggaggctgaggtgggagaatgacatgaacctgggaggtggagcttgcagtgagccgagatcatgccactgcattccaacctgggtgacagagcgagacactgtctcaaaaaataaaaaaaaaataag

SEQ ID NO: 124239 - DNA, 674 bp, Homo sapiens
gaccttgaaatgttttattttgatggggcttaaatgagtgtatacatatataaagacactgagctcatattatgatttgtgcacttcatattttgcctcaattaattttttttacaaaagattcatggaagcctggtgtgtaattgtgtaaaaaagtggaaacttgcctatcagtagaagaatggatgaattacggtattgttacacagtgggattatgtataacagtgaaaatgaatgatctaaaactacgtttatttttgggtaactctataaaaccatccacaatatggtatgaaaaaaagtcatacaaggacacaaatgacattcctatgtcaaatatgttaagaaaattgtatgctcatgaattctacctatggtaaaaataatatgtgcatgggattagtaaacactaaattcaggataatggttatctctggttgagaagaggaatggattagagcaaaaggcatagttcaaccatatctgtaatattttcttagtctgcatggtgggtgtgcatgggtgtttattaaattttatgcctttctctatatttgaaatatttaatttgcaaaagaaataattataagaactctagttaaatatagcaaattaaaatttcacatttaccctcctgtccccttgcaactgtatcataatgagagtagagga

SEQ ID NO: 124240 - DNA, 377 bp, Homo sapiens
aaaaaagcagatttgtaaatgggcaatggattcgaatagacatttagccatagaaggcatccagttggtgaaaaggcatatggaaaggtgctcagcatcactgattatcaggaaaatgaaaatgaaaaccgccacgagtggtttagaccatagcggcatgcatgaaagttttcagacctccagttgttgggagtggctgaggagattggggagcttctgtctgagttggaagagtggagtctcaacaagaaccagcgtattctggacatgtgtgcgccctggagtgttcatggctggatgccttgtctacctgtgccttacagagtgacaccattgtggtgtggtcgatcagaggggcaggaggctttcagagggag

SEQ ID NO: 124241 - DNA, 727 bp, Homo sapiens
ggaaaatcccaggatagggaatccgtattcaagactgtgcatccttttcctaggtctgtctctaaggcatgaataaattgaatgtacgcattgaatctatttctgtcacatttggggccacaacatatggagagttggcttgtttttctaacttaactgactttgtttaaagacccttgctcagaggagagttctcaatcaaagtagccatactccattccccatgggaggccatccaaccctgggcctgaactttgaacatggcaccagttggcaaaaggctctgcgaatctacccctttgtttttaagacagtgcctgggtgtttggtccagcatgggtgggtaacttagggggtcttcacaattttactacacatcttgaatggcataaggcagggcaacctttccagctgaagtgtcataacatagaagtggattgtggtgaccacaattaatgtattagaaataataggtagataaacaatgttggcaagttattttcttgaagatatattacagtattcagtgggtacagagtttcagctttgcaaggtgaaaagagttctggagatggatcatggtgatggttgcacaataatgtgaatgcacttcataccatcaccaaactgttctcttttttttttttgagatggagtcttgctctgtcgcccaggctagagtgcagtggcgtgatctcggctcactgcaagctctgcctcccgggtt

SEQ ID NO: 124242 - DNA, 328 bp, Homo sapiens
ctagaaggattactttggatgctacaaagaggaaagtggatgagaaataggcaagatcagatggtatcaaagcaaggagacaacttatgaagcttttttggccatctaggctaggaatgatgattctctaaaatggagtagtatcaataggaatagggtgatgagaatttcacagcagatcaggagatagatggattggatacaagtgagaaggaggcattcagggtgattcttcagtctttaactattcaactgggtggatgtcctcatgccattttcagagagagaaaagatagagagtaaatttgggtaaaggaattgaaaatga

SEQ ID NO: 124243 - DNA, 143 bp, Homo sapiens
caagagctctttgtaagcaatggctccacaaagtcaacctgaaagccatctggtcatagctgattctatgtgcatcatcctcaaacaggacattccagtccaaaccttggtaatagaaccagtgtttccaattgtgtcctgtt

SEQ ID NO: 124244 - DNA, 478 bp, Homo sapiens
gcgttctagaggagtcatcgcattactccaggatacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaaggaatgctagaaggtcccacactgaaagttcaatgctctggctccaaaatgacagctatttccactcactcctcatgggccagcacttagcatgtggtcctcagccaaccccaaagggactcaggaaggaccatcccaccatatggctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccact

SEQ ID NO: 124245 - DNA, 473 bp, Homo sapiens
gggtgatctagaggatccctgccatttatacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaaggaatgctagaaggtcccacactgaaagttcaatgctctggctccaaaatgacagctatttccactcactcctcatgggccagcacttagcatgtggtcctcagccaaccccaaagggactcaggaaggaccatcccaccatatggctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccact

SEQ ID NO: 124246 - DNA, 151 bp, Homo sapiens
tctgtgtactctggcccctgttacccaggagaacattcggccctacttcaaactctgtggttgagccctttgctttggtctgtgggctgcagttttctcattatcagagtaataggctatggttttgcttagcaggaagttagtctgcctg

SEQ ID NO: 124247 - DNA, 318 bp, Homo sapiens
ctttaatgagtatagagtttcagttttttaagatgaaatggctctggagattggctgcacaactgtggtccttagcactactgaactgtacacttagagatgggtaagatggcaaattgtatgaaatgtgtactttaccacaatttaaaaaataattttactttttacagcagaaaaaaatcattttcatttgattgcatgaataattctttctttggcctgagagcataggtcaatcaagattatttttaaggtatatatgtgatatcatctagattaaagaaaatccttcaaattatattttcttctggcatctag

SEQ ID NO: 124248 - DNA, 614 bp, Homo sapiens
cctaggtagatattttatagaaatttacatccaagtttataccacagtaaatctctaagggacagatttcaaggaaaccccctgaatagttggattactgttttcttgcagctaaaaatttttgattatgtgcccaaaccaaaacaaaagattgcatttagcttcctcgatgagaatttctgaaaccaaatacaaatgaaaccacaggaggaaagataaggactcacaagtttatgaaacttgctaatgggactttaactccctcttagactcactcactcaactttcttattccatttgatatattttattttacattattttgaaaaacaaaatgaaacattgggggatatgttccattttgaatatagaactattttgagaattgtaggaaaatcattgtatatttagaattacacgtgtcctacaaaattgtcctcatacatttattcatccatttagcaaatcttttttaatatctgtcatgttaggtactcttctgtacacctgtgatacatcaataagcaaagctgacaaaattctttgcccttatactgcttctattctgggaacaggggctgtgaataaacaaataaaaaaagcctgtcatattg

SEQ ID NO: 124249 - DNA, 549 bp, Homo sapiens
gtaactggatgcaacctttttgaaggatatttaagcattatatgtcaaaattaggtatacagccctttgaatagaagttccacttctagaaattgcaaacagatacttgaaaaagtataccaacagacatgtactgggatgtttattgtaactaatagcaaaacaaaacaaaacaaacagcagacaacagccttcctattcactaatggatatgaaattacggataggtaaattatggtatattgacattatacaagcactaaaaaaaggagcttagatctatatgtcctcaaacatatcctccctagatgcatgggcagaggtatttacagaacagtttgtacctacatgtctttgtgtatgtgatgacgtggatgtgtgtgtatataaacatctctatggaaagtgcataagcaatggtagtatctaggcagtgggactagaagttgcggggtggaaaggctattttaagccccagtcatgtttttaaaagacaagaaaaaaaaaaaaaggcctgcaactcaacacttgatctgatgaggttatttg

SEQ ID NO: 124250 - DNA, 462 bp, Homo sapiens
aaaaacagccattccagaagtagactctagtaccttatgtagtctttttcccatcaagccatcctgtttctcagtgtgatgcagttttttgaaatacaaattagatcatgtttgtttccaaaatgatcagttccactctgaaaaggtgttccccttttatagctacagatctaaattaatactgtgagcaagttaaaaattgaggaagagatcctggccaaataattcctgtccaaccttccccataagtagactgaatgcctcagttaacatggagacactttttccttctgcacaaagtcattgagatataatttggaggcttcagataagaagcactcaggattgggaaaacagcaaaggttgtataaggccagtatttacctaagggaagggtcagagatctttcataagtactagttaagacttacagtagagatacctgtagagacaaaaaaaaaa

SEQ ID NO: 124251 - DNA, 785 bp, Homo sapiens
agggctaaagatgaggattcaaggccaggagcagtaatcccaggactttgggaggctgaggtgggaagattgcttgagcccaggaggtggaggctacagtgagctgtgatcgcgccactgtactccagcccgagcaacagaatgagaccctatctcaaacaaaacaaaataaaaaacattaatagcagttccaggaccagatcctgcaaggtattctctcattgctttggttgcatttggttgtaattcttttactgcattctctcatttggttgaccataagcctttggtaatcactggaacccaatcctctggcctagcttttcaaagggtgtcccaggcagatatttcattttaaaaaatttaaaatccacattcaagtcagtttgagaacactatattagaggcataataaaagattccatgtatttaagaaaataaaggagaaaaacaaattatctaggcaaaacaggagaataaacattcaaagcttaaatactgattagggatgtcataaaatagaagaaaaatgttaggtatgcagcaatagcattagaaagccaaatcaggctgggcatggtggctcatgcctgtaatcccaacactttgggaggccgagacgggtggctcatttgaggtcaggagttcaagagcagcctggccaacatggtgaaaccctatctctactaaaaatacaaaaattagttgggtggtagtggcacacgcctgtaatcccagctacttgggaggctgaggcaggagaatcacttgagcctgggaggtgg

SEQ ID NO: 124252 - DNA, 668 bp, Homo sapiens
gtctctgggcctcagttttcacacctataaagtgattgacattgaggttaaaacatctgtttttgatataaatttaatataatgtcaaaggttaattgctttataaagctaatgttgactactgcaagggttggtaaatgaaatctgcctctcccctctccccatcttagggatggttacattgtgaaagttgctgagagctctttgagttattggcgtgtacctattcttctattcatagagaaaataaaatatgaatggcaaaacgaattggtaaaattgcagtgggcatgctcttaaattagggagggatcattttatacacattaacagattattataattcttgagaagaaacattaagtctgtttcctaggttcctgttttctagttcttcattacaatagtagatacgatgtagaaatcctgtaattaacattactttagccttggttgttacaggctcttttggactaggatagattgttgataaccttgataatcaaagttactgccacatgaaaataagagttaagaacaaatatttgaattattctaacagtctaaggatcaccatcttagatttgtaaaactggaggtttattgcagcatgaatatgtagatgaactttttaaatatcatttcttagctctccaatttacagtgat

SEQ ID NO: 124253 - DNA, 531 bp, Homo sapiens
aagcggctggaagtgggcctggaagagcagcaagtcggcctccctgggcccagctccgtcctctcgacggcctctccaggtgcaaaacttcctcgagtcagcctctccaggcccagctcccctgcctcgaggaatactggtgacaaacctttactgagcatctaccatctatcagagaccgagcctggtactggagaagtaaagacaagctgaccactggcctcaaagacgtcacagtgtcacaagagccccagatacacggacaatgtcgtaagtgcaccagcagactgtgtgggttggtgaaggtaggatagcagagaaaaaggggccaaacatcggacgagctagacggcaaagtattgacagaagaggtctgtttacaccgaatacatgagttaaaagtccagcagacaaaaaagggatacaaactacgtaattcctcacatcttttccagcctcaacttccccgaatccaaggccggccatggtggctcacacctgtaatcccagcactttgggaggccaagatag

SEQ ID NO: 124254 - DNA, 324 bp, Homo sapiens
ctagtatcaaagatctcatgtgatttcatcaaatgatagtaaaatcatttcatctttctttaatgcctataagcaaggaggtacagtcttacctaggactttaatccttttttttttcttttttgtagagacagggtcttggtatgttgcccaggctggtctcaaactcctggcctcaagtgatcctcccacctcagcctcccaaaatgctgggattacaagcatgacctaccatgcctggccaaatctattttttacaacattcattatcaactatatttaataagacaactgtgcctgtaagatctagcaatactaatacaa

SEQ ID NO: 124255 - DNA, 1355 bp, Homo sapiens
agtggtcactgattatttagggttaagcctatttagggctaatccagtagtagctgccatgcttcaggttagtatcccattgggtgtagttcatggggtaagtggtcgaaagtaaaatgaataactttgtatgggccgtgaagtttgttgtcaggaactagaccttcataaccctttaagcaggttgccactggcccatatgctgctttgtgtaagacaaggttgtccaactcgcggcccaacgcaaatttgcaaatttaaaacatgaatttttttgcgatttattattttttttttagctcatcatatatcattagtgttagtgtattatatgtgtgacccaagacagttcttccagtgtggcccagggaagccaaaaaattgaacaccctggtgtaagttataagcaagcacctttttctcaagacactatgtgttcagctgctgagaaaccattacaagtaataagtatatttagattccgcaccgcccccccccccgccgccttgtctccaggcaggtttctaactcaccaccaagcaagggggactgcatatcctttgtgtaggaggcttctaaagatcttctcttctcttgagactttctcctttaaaaaaaaagaaagaaaatacctgcaagttctccaagggatgtctgggatcactaaatagtctgaggtggtgtttccctcaggcaaggctgtgccctagttaagagcatggaggtacactgcctgcttgtgaagcctggtggctctcaccgctgtagcactttaggaaggttacttaatgcccctggctctttatctgtaaaatgaagttaaggaataaatgagaatgcttaaacacagcccaggacctaacacagagtaaaagctcaagaatacccagagggggtcagccttagtgggctgtaacttgtataggatttgggggtgggaatacagagcagacattgctaattcatgctttgcctgatctcaagaaataagaactctaccctaggcttactacctacggagtaagaactacttggccctctgggactgatcttcaagcactggtcatggtgggaccaataaggggccggtgttcagtagaaaatactggctttggattagcattttgcttcttcccaagatcatatggccagcaaggtggccaaatgagtatcttctctgaatttgctttattggtaagatgggtctgctgcccactgagggttaagtgaagccctgtgcaggaaagctctgaggccctctgagctgtagtgggagctcagtaggagcctgtgtgccagcaaccacagtcctgggtgtgctttgagggggtctgcaggttgctgcccagggtgga

SEQ ID NO: 124256 - DNA, 996 bp, Homo sapiens
gcggccgctcccacttcagattgggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcctccgccaagctggccttcggcagcgaggtggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtgtcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaa

SEQ ID NO: 124257 - DNA, 892 bp, Homo sapiens
gcggccgctcccacttcagattgggcaacatggccgagaggccggggcctccgggcggcgccgtgtccgcgaccgcgtaccctgacacccccgcggaattccctccgcacctccaggcgggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtgtcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaa

SEQ ID NO: 124258 - DNA, 1065 bp, Homo sapiens
gcggccgctcccacttcagattgggcaacatggccgagaggccggggcctccgggcggcgccgtgtccgcgaccgcgtaccctgacacccccgcggaattccctccgcacctccaggcggtaggtggtaagagacgtcggggactgaggcctcttcccttaccagggacctaaaaccttttctccggttgggctagttcgctctcggggaagaactacacctcctacatccaccctctacctctcattttaagtcccttgtgcctgagcatttctctccacgtgactcttaaggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtgtcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaa

SEQ ID NO: 124259 - DNA, 1034 bp, Homo sapiens
gcggccgctcccacttcagattgggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcctccgccaagctggccttcggcagcgaggtggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtgtcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaaaagggaaaagtcgacgccgctgagtttagtagtaatat

SEQ ID NO: 124260 - DNA, 509 bp, Homo sapiens
gcggccgctcccacttcagattgggcaacatggccgagaggccggggcctccgggcggcgccgtgtccgcgaccgcgtaccctgacacccccgcggaattccctccgcacctccaggcggtaggtggtaagagacgtcggggactgaggcctcttcccttaccagggacctaaaaccttttctccggttgggctagttcgctctcggggaagaactacacctcctacatccaccctctacctctcattttaagtcccttgtgcctgagcatttctctccacgtgactcttaaggtgagaagcctcttgcccatccctttactccgtaattaacgggtgttgtgaccagatgaccagtctgccccactaccaggaaaattgggagtttgggatactgtaggcataagaggatactgacagagacgttctggatgttttcctgacgctgagaactcctaaacttgcatcctggcgtctgctaaggtgtatctctgcctctccctcccacgt

SEQ ID NO: 124261 - DNA, 565 bp, Homo sapiens
tctaatcacgccaaaccctcgtccagtgtaggtggtaagagacgtcggggactgaggcctcttcccttaccagggacctaaaaccttttctccggttgggctagttcgctctcggggaagaactacacctcctacatccaccctctacctctcattttaagtcccttgtgcctgagcatttctctccacgtgactcttaaggtgagaagcctcttgcccatccctttactccgtaattaacgggtgttgtgaccagatgaccagtctgccccactaccaggaaaattgggagtttgggatactgtaggcataagaggatactgacagagacgttctggatgttttcctgacgctgagaactcctaaacttgcatcctggcgtctgctaaggtgtatctctgcctctccctcccacgtcgtagaccagcctctgcttgctataggggtttcattgcgtctgcagcccaaggttagcctctgacctggacagtggtcactgattatttagggttaagcctatttagggctaatccagtagtagctgccatgcttcaggttagtatcc

SEQ ID NO: 124262 - DNA, 1169 bp, Homo sapiens
gcggccgctcccacttcagattgggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcctccgccaagctggccttcggcagcgaggtgtaggtggtaagagacgtcggggactgaggcctcttcccttaccagggacctaaaaccttttctccggttgggctagttcgctctcggggaagaactacacctcctacatccaccctctacctctcattttaagtcccttgtgcctgagcatttctctccacgtgactcttaaggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtgtcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaa

SEQ ID NO: 124263 - DNA, 775 bp, Homo sapiens
  misc_feature (29)..(29): n is a, c, g, or t
  misc_feature (47)..(47): n is a, c, g, or t
cggtacccctcaacgctttatacttctcnacgctttatacttcctcnacgctttatacttccgtattgaattcaagtataatattaagtatgcatggagaagtataaagcgttgagctcaacgctttatacttcctaagtggggaaccaggacttctacccccacctaggaagaataaggcagcattcctctctttcacctaccagaactgtatcagaaaaagtcagtagaaccaagtttagttaagatccagtctcataatatgaacatatccaggaccacttatcataccaagaaccagaaagctctcaaactgaatgaaaaaggcaattcatagaacccaacaatgagatgacagtgatgttagaattatctgacaaattttaagcagccatgataaaagcagcaatagcaatcatgcacacacttgaaacaaatgaaaaagttgaaaacctcagcaaagaaacagaaagtcacaggaaagaaatagaagtataaagcgttgagctcaacgctttatacttcgaagatgacctcgttccggagctgggtatctcaaatctgctttcatccagccacggcccaaagccatctttctgcctactggatgcttacagtgactgtggatacgggggttccctttccccattcagtgacatgtcctctctgcttggtgtaaaccattcttgggaggacacttatgccattgaatctttccccagatgattagggtctaggaatgtccatactgtggccttttcctgatatacatgct

SEQ ID NO: 124264 - DNA, 495 bp, Homo sapiens
  misc_feature (379)..(379): n is a, c, g, or t
  misc_feature (382)..(382): n is a, c, g, or t
  misc_feature (387)..(387): n is a, c, g, or t
  misc_feature (391)..(391): n is a, c, g, or t
  misc_feature (405)..(405): n is a, c, g, or t
  misc_feature (443)..(443): n is a, c, g, or t
  misc_feature (447)..(447): n is a, c, g, or t
  misc_feature (450)..(450): n is a, c, g, or t
  misc_feature (452)..(452): n is a, c, g, or t
  misc_feature (458)..(458): n is a, c, g, or t
  misc_feature (462)..(462): n is a, c, g, or t
  misc_feature (464)..(464): n is a, c, g, or t
  misc_feature (466)..(466): n is a, c, g, or t
  misc_feature (469)..(469): n is a, c, g, or t
  misc_feature (473)..(474): n is a, c, g, or t
ctcaactatttgttagctctaagtggggaaccaggacttctacccccacctaggaagaataaggcagcattcctctctttcacctaccagaactgtatcagaaaaagtcagtagaaccaagtttagttaagatccagtctcataatatgaacatatccaggaccacttatcataccaagaaccagaaagctctcaaactgaatgaaaaaggcaattcatagaacccaacaatgagatgacagtgatgttagaattatctgacaaattttaagcagccatgataaaagcagcaatagcaatcatgcacacacttgaaacaaatgaaaaagttgaaaacctcagcaaagaaacagaaagtcacaggaaagaaatagaagtntanacttnctcnacgctttatacttnctcaacgctttatacttcctcaacgctttatacttccnatgnaantnaatatnatantngnatncagnngaagtataagcgttgaggggt

SEQ ID NO: 124265 - DNA, 705 bp, Homo sapiens
  misc_feature (29)..(29): n is a, c, g, or t
  misc_feature (47)..(47): n is a, c, g, or t
  misc_feature (589)..(589): n is a, c, g, or t
  misc_feature (592)..(592): n is a, c, g, or t
  misc_feature (597)..(597): n is a, c, g, or t
  misc_feature (601)..(601): n is a, c, g, or t
  misc_feature (615)..(615): n is a, c, g, or t
  misc_feature (653)..(653): n is a, c, g, or t
  misc_feature (657)..(657): n is a, c, g, or t
  misc_feature (660)..(660): n is a, c, g, or t
  misc_feature (662)..(662): n is a, c, g, or t
  misc_feature (668)..(668): n is a, c, g, or t
  misc_feature (672)..(672): n is a, c, g, or t
  misc_feature (674)..(674): n is a, c, g, or t
  misc_feature (676)..(676): n is a, c, g, or t
  misc_feature (679)..(679): n is a, c, g, or t
  misc_feature (683)..(684): n is a, c, g, or t
cggtacccctcaacgctttatacttctcnacgctttatacttcctcnacgctttatacttccgtattgaattcaagtataatattaagtatgcatggagaagtataaagcgttgagctcaacgctttatacttcctaagtggggaaccaggacttctacccccacctaggaagaataaggcagcattcctctctttcacctaccagaactgtatcagaaaaagtcagtagaaccaagtttagttaagatccagtctcataatatgaacatatccaggaccacttatcataccaagaaccagaaagctctcaaactgaatgaaaaaggcaattcatagaacccaacaatgagatgacagtgatgttagaattatctgacaaattttaagcagccatgataaaagcagcaatagcaatcatgcacacacttgaaacaaatgaaaaagttgaaaacctcagcaaagaaacagaaagtcacaggaaagaaatagaagtataaagcgttgagctcaacgctttatacttcctctacgctttatacttcctccacgctttatacttcctcaacgctttatacttcctcaacgctntanacttnctcnacgctttatacttnctcaacgctttatacttcctcaacgctttatacttccnatgnaantnaatatnatantngnatncagnngaagtataagcgttgaggggt

SEQ ID NO: 124266 - DNA, 855 bp, Homo sapiens
gcatggtggcacacacctgtagtcctagctactcaagaggctgaggcaggagaatcgcttgaacctggcaggcagaggttgcagtgagccgagatcatgccactgcactccagcctgataacagagtgaaactccgtctcaaaaaaataaaaaaacaaagtcaagaaatagatgctggtgaggctgtggagaaataggaatgcttttacactgttggtgggagtgtaaattagttcaaccattgtggaagacagtatgattattcctcaaggatctagaaccagaaataccatttgacccagcaatcccattactgggtatataggcaaaaaaatataaatcattttactataaaggcacatgtacacgtatgtttattgcagcactgtttacaatagcaaagacatggaaccaacccaaatgcccatcaatgatagattggataaagaaaatatggtaaattttaagcagccatgataaaagcagcaatagcaatcatgcacacacttgaaacaaatgaaaaagttgaaaacctcagcaaagaaacagaaagtcacaggaaagaaatagaagtataaagcgttgagctcaacgctttatacttcgaagatgacctcgttccggagctgggtatctcaaatctgctttcatccagccacggcccaaagccatctttctgcctactggatgcttacagtgactgtggatacgggggttccctttccccattcagtgacatgtcctctctgcttggtgtaaaccattcttgggaggacacttatgccattgaatctttccccagatgattagggtctaggaatgtccatactgtggccttttcctgatatacatgct

SEQ ID NO: 124267 - DNA, 726 bp, Homo sapiens
gggccatctccaccactgtgtctaatggccatgtgaggagctagaattcccaccctgcccagcagcaataaagatgccctccatgctcaactatttgttagctctaagtggggaaccaggacttctacccccacctaggaagaataaggcagcattcctctctttcacctaccagaactgtatcagaaaaagtcagtagaaccaagtttagttaagatccagtctcataatatgaacatatccaggaccacttatcataccaagaaccagaaagctctcaaactgaatgaaaaaggcaattcatagaacccaacaatgagatgacagtgatgttagaattatctgacaaattttaagcagccatgataaaagcagcaatagcaatcatgcacacacttgaaacaaatgaaaaagttgaaaacctcagcaaagaaacagaaagtcacaggaaagaaatagaagaaatagaagcatacaaagaagaactaaatgaactgaataatacagaatgaaaacaagaaacttagtgaaaagcagaatgaaggagacagcagaatggaggagatagaagaaataatcagtgaggtagaagaaagaataacagaaattactgtttgaaaaactgagagaaaaatatgctggaagaaaaagaaacagtctcagaggcctgtgggactaaaacaagagctttaacatttgtgtcatcagagccccggaaggagataa

SEQ ID NO: 124268 - DNA, 576 bp, Homo sapiens
gcgtgcagttgtctgtgagtatgcatcgtgtgcttgtactcccagcgttgtcccttagggacctgggagcagcgacacccaaagcagcgagtacactcagcacccagatctcctccacaaggaaccagggctcctgggagaaatggccgattgcagagctgaagcagggacaatacaagaggaaactggaacgacttatgtgctggaaagtgaggagctagcccaagacaagaggacatgcccaaaggcccagaagccacactgaaggggctcctcctggccacagatgggtaatttgagcatcaaaatcaatgatgactgtaacataatcaccattaagaacatgggaaaccataagatggcactggtgattacttacaaaaaccacctctctgcgagcaactcagtaattagacatgaaagaaccacgtccaggtggagacacctggcattccctgcctgaatcaggtggccaaagttgccaccaccccaacagagcaaactggtatcgcgccctcatgacagccgcgccaagatgagcacagcttcactgctgcgccactgctgccaacgatg

SEQ ID NO: 124269 - DNA, 398 bp, Homo sapiens
gcagttccctccacattagaactctgctccctggttaggatccacatgtgcagcaaagtcatggccacctgccctaagcatggacgacccatggatgtgagggcttgctgttggtttctggggatggatttacccacagtgatgagtacgagttgcacgagttgacttgtgtgaacagggcatagcccctgatggttgtaaattagcatctttgtgtagaaggttttatcatgtggctatatggccctcaagaagagagtaacatggaggggctgtatgatatctggtttaagaagtgaaacagactgtgactatgaccctttttctcgaagcctgtggccatgcccctcatccctatgggaaagtaattttctctatgtctctgcttccagggccct

SEQ ID NO: 124270 - DNA, 383 bp, Homo sapiens
gcatgagttactacgcccagtcgaaacatttctgtagataggaccataggtgcttgatatgtgtagttctgccccttccacatgttgttgcaggagagtagttttatatgcctgatgatcagaacacttgacacttacaagaatgtggtctagggacacctgggatcctcaggacccttttaggatttactgaggtcacaagtattttcataataatgctgtcatttatcttttaactcctgttccctcctgagtgtacagtgcattttccttgtagctgcttcatgtgctggggtgtcatctgtctgacagtgtgtttgtgacaatatgtgcttttctattgtttttctaaaattttatttttcggtttctgatatgtagta

SEQ ID NO: 124271 - DNA, 472 bp, Homo sapiens
ggtaagatttgcatacagtgaaatgcacaaatttaaaatataccatttggtgagttttgatctacaactgtgtagctcaaacctctgtcaagaattagaacaatatcacctcagaaagtcctctcttgcctgcttctaatcagtcttcttgcacgtcaggcaaccattgtcctaatttaaaaaaaattatagataagttttgcctattctagaacttcatgtaattggaatcatacaatatgcatactttgtttctgtttttttcaccttagtgtttttaatattcatccatgtttatccatcctattagtagctcattgctttctgttgctgtgcagtattccattgcataaatataccacactttttatccattatcttttgatggacttcttggcaatttccatactttggctattatgtataaagattctatgaatattcttgtgcaagtttttcatggacataatgt

SEQ ID NO: 124272 - DNA, 157 bp, Homo sapiens
ttccactgacggtgggatggaatctgtgccccctgtgctgtcgcacccctgggccttggcccatgcctttgcctgagctgtgtctctgcctaaaatagcacccatttgctcctctaaggctcgcctcagtgatttccgaaacccatttcctccatga

SEQ ID NO: 124273 - DNA, 326 bp, Homo sapiens
caaaagtcttgttaaataggagaaataactgtgaaaggaaaggggaggaagcaggattggataggggaagacatgtagatacagatctgacagtctctgccaactcatcctggaactcctgagcagactgcctatgagaaaagtcctgcattgggtggcaatgtctaggtcttttaccagcttaagtcactggttgtgactaccccaagaagagcatgacctagattccaatcctgaggtggacctgaagaagttaacagctggtagctctaagctaatcacactccttacaatgaagcagtgagttctttcttgaaggaatttct

SEQ ID NO: 124274 - DNA, 595 bp, Homo sapiens
gcagagaatgagattcgggagcagaaagttgagcacagatttcctttactgaatgtcaaggtgggcagcacagcacattgaaaatgtcacagctgattttacagatttcaggacaccatagaatgtctgttttttatctgtagaaaggatctaaattgatttttacatgaacatatattatttgtgtaagctatagtgtagagaagtaacattaatcataattgaaatctaacactagtgttgtatgaaaggagagaaggttagcactccccttgacaaggatggaagaggcccttgggcctgacaacacgcatacgcaaggacaaaaacccaaacaccgcatgttctcactcataggtgggaattgaacaatgagaacacatggacacaggaaggggaacatcacacaccagggcctgttgtggggtgggggtaggggggaaggatagcattaggagatatacctaatgctaaatgacgagttaatgggtgcagcacaccaacatggcacatgtatacatacgtaacaaaactgcacattgtgcacatgtaccctaaaacttaaagtataataaaaaataaataaataaataca

SEQ ID NO: 124275 - DNA, 411 bp, Homo sapiens
gcatcaatcacttctaaaacatccttcacaaagaactgtaggccttctgcttaaacaaactcaatgcctggaaactcatctccccaaataattcattgttttcagataatggtagtattagaatgtgctttcatattttgagtaaactctattgattcctttttctggaccttagaatagcaaagaatgaatttagtcacttttccatggaacattccttcaactatattagagagttatcacattttaggtgatattctcctggtcctcatatataataattttaagtccctgccatcctcatggctcttctctgattctggttctacttatcagtcttctcctgttcttttggggggcgaggagcatattggttttttaagagatggggtctcgctctgcttcccaggc

SEQ ID NO: 124276 - DNA, 427 bp, Homo sapiens
ggtatctcaaaatatcaatgtcggccaggcgcgtggctcacacctgtaatccctgcactttgggaggccgaggtgggcaaatcctttagcgtcaggagtttgagaccagcctgggcacataaaattaactttagttttttttgtctctaaaagaaaatttaaaaacaaaataaaaaaccactaattccctataaacctcctttcccctgacctcttgcaacctccattctttcactccagcctgggcaacagagcaagactctacctcaaaaaagaaaaaagaaaaaaaaaaaagaacagtcttttcaatacccaaatcacttcattaaaaataaagacagcaagataatcacatggatagcccaggagccccaactactttattgagctcactgtaggaatgagattaggaagctataaaattaag

SEQ ID NO: 124277 - DNA, 437 bp, Homo sapiens
agctctcactgtcccactgtgttgtcacagtgtactacatcattgtcagactcactgttttcatttccatacacacttagattataagagtttgtaacgttttcacaacattacaggtcatgaaacaatcctcattttcctataagttattccagtggctcacatagtccttgccacttctccttcaccatgcaatgaggtacaacctggtattggttttgtgcttgactctgaccctcttgccatcttttgtaaggttctgtgtttaaatattgcatttcaggcagctgtggtgttgccagccttgaggcagggttctggagcctgaagacatgtgtccttggcagtaacctgtgtgtagacccacctttctgaaattagacccagatgctatctcaaagctaaaagtcattttcttgacatcaagcatttttggc

SEQ ID NO: 124278 - DNA, 383 bp, Homo sapiens
tgtgaactttaaaaatctatcttccttttacaaaatgagtgagtttgtggagtttaaatatcactaaatgatttagttttttcaaaaattaacttcccttgctgatacaaatctctttgatggaggaacactatctcttttttaaggaaagggcatggagataccacttttagtcttagtcggaccacaaagcatttatgccttcatcatgagccatcgtttattgaatttgcagtagctctgtattgagagctaatggaagtagaaaaagatttcaagcaaaccctaagaaaccaccacaccaggcccattttcttaatggaaagtttgctgattctggagtggaaataaaatgatgcaaacaggtatggaacgctgcctca

SEQ ID NO: 124279 - DNA, 169 bp, Homo sapiens
ctccattccccatccgctaatttttatgagaacagtaaattattactattactattatttttgagatgtagtcttgttctgtcacccaggctggagtgccatggctcaatctcggctcactgcaacgtcccgtttcccgggttcaagcaatgagaacagtaaataaact

SEQ ID NO: 124280 - DNA, 567 bp, Homo sapiens
gagatattgactcctttaaatttctgcctgtgtcctattttaaaagtggctctgctggatggacaagtggtggaaggaaatttggaataagcaacagagattctggttgtcttcagtaaaaaactatgcattggggccgggcgtggtggctgacgcctgtaatcccaacattttgggaggccgaggcgggtggatcacctgaggtcaggagtatgagaccaacctggccaacacagtgaaaccctgtatctactaaaaatacaaaaattagccagttgtggtggcatgcgcctgtaatcccagctactcaggaggctgagtcaggagaatcacttgaacccgggaggcagaggttgcaatgagccaagattgcaccactgcgctccagcctgtgtgacaagagggaaactctgtctcaaaaaaaaaaagaaagaaaatagaactatgcattgcttagggtgcacccttccaattatctgattctagtctttcactgcctttgagctatttttacaactaagttgtagagttaatgcaaaataattcttgtctatggatgtgcatatt

SEQ ID NO: 124281 - DNA, 308 bp, Homo sapiens
cacctcttccccaaccaccagctgactagagatgcctccaacagctacaggaggctggacccacaacaggaaaggaacctgggtccatgaaagactgtgtggagcagagaatcccccaccctagttcccagcaactaccagagactgtggcatgagcaaaaaaaaaaaagaaagaaaatagaactatgcattgcttagggtgcacccttccaattatctgattctagtctttcactgcctttgagctatttttacaactaagttgtagagttaatgcaaaataattcttgtctatggatgtgcatatt

SEQ ID NO: 124282 - DNA, 308 bp, Homo sapiens
gtcaaggagtggaaattctgccctgacctgtggctcctaacagcaagtggagactgaatgggccctgggagcctggcccacctgacgctcatcagatgttaagcccagttccctgtggttatccccgagcagcaaatgtcacacagctcatgtcacacagctccaaggacacacaggtagctgtcaaaattcctggggtaaggatgagttgaggccccaggctgccccacagggctgggctaggagtctgaggacaagtgctgagcatgtgctgtgacaacacctctgggtcgatggtctgggcctct

SEQ ID NO: 124283 - DNA, 155 bp, Homo sapiens
ccaatcaatgactaacacattctggaagctccaaacacaaagtgggtatggaaacagacttttgtgtagccccaaattaggcatattcaattgcttgttgacataggatacattccaacggggaatggaaccagcttatgggtcttctggagaag

SEQ ID NO: 124284 - DNA, 266 bp, Homo sapiens
cctccccatgtggcaggtgctgcatccacataatgaccagcatatggccctgacctcctggagcttccagtctagtgaggagagggaggcaggctgtaaacaattaaactcttcactattttgtcaatgatacttgtgaactgaatggtgggtaggtgatctgtcttagccagggtggtctaagacctggagaatgagaaagccagagataggattgatggagaaagggcattctgggctgagggatggtggaagctacatcctag

SEQ ID NO: 124285 - DNA, 382 bp, Homo sapiens
aatctacttgaaatcctattttatatcaaaagacgtttttctttttgagataaggtcttgctccgttgcccaggctggagtgcagtggcatgatcatggctcactgcagttttgaccccccaggctcaagcgatccttccacctcagcctctcaagtagctgggactacaggtgtgcaccaccatgcccagctaagttttgtaacttttgtagagatgaagtttcaccacgttgcccaggctggtctcaaactcctgggctcaccttgtcctctcaaagtgctggtattacaggtgtggcccatggtacctggctgaaaagacttttcttctttggtcaactctgacagcatagcatgtactatgcgatacattagtccctg

SEQ ID NO: 124286 - DNA, 402 bp, Homo sapiens
gccacaacatatacccaacgatacaatacaatattgctttataaactaggaactacctataacagacgcatccagcaataatgcactgtgcacacacaaatactccaaagagtggattcctcattaatctgataatgctgaatccaactttatttttcattacctttaaccaacgttttaacttcaaacagtccacctggtatttcccaaatacaacatgccagggaatcagtttcatattgtgcccaagtcactcttcaccactgagaatgacatttttctttattcctcattcccatcagccactttttaaacaacctgaggctaggcattgtggctcacatctgtaattccagcactttgagaagccaaggcaagacgattgcctgagccaggaggctg

SEQ ID NO: 124287 - DNA, 716 bp, Homo sapiens
aacttcacaggaaaaagtcacaaaagtcagtcatcaatggcccataagggtgaaatccatgaccctcctccagaggcagttcaaactgtaactcctgtggaggttcacataggcacctggtttacaaccacacctgaaggaaatcggatcggcaccaaaggattagaaagaatagcagacttgaccccattgttatcctttcaggccacagatcctgtcaatggaacggttatgacaactcgagaagacaaagttgtcatagttgaaaggaaagatggtactcggatagtggatcatgctgatggtaccagaatcacaaccttttatcaagtttatgaagatcaaattattctgccagatgatcaagaaacaaccgagggtcctcggactgtcaccaggcaggtgaagtgtatgcgggtagaaagctcacgctatgccactgttatcgccaactgtgaggacagtagctgctgtgccacctttggagatggaacaactattattgcaaagccacagggaacataccaggtgttacctccaaacacaggctctctttatattgacaaggattgttcagctgtgtactgccatgagtcaagcagtaatatatactatccttttcaaaagcgtgagcagctgcgagctggcaggtacatcatgaggcatacttcagaggttatctgtgaggttctggatcctgagggaaacacttttca

SEQ ID NO: 124288 - DNA, 191 bp, Homo sapiens
caaactgatttccaaagaagtcaagtgactgcctgcaaatcctatgtgccatatttgaatctaagacacagttgactgtaagatgaaccattgatttaaaaacagcttcttgaggagaaaatgaatcaccatattagatgtatgtagcaaacgtaaaatgtacctggatatttcacaaatgctataatgtg

SEQ ID NO: 124289 - DNA, 737 bp, Homo sapiens
cactttataatttgtggatgagacaataagggattcaggattatgataggcagtggatgattttggggggcttgttacatctccattgtaccttggacgtgatgtggcaagacttgatattcatttttttttttattttaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaagtaagtgtaaatgtaagaaagaaaataagaaaaagctttatgttatgtatgttatgttgggatatactgttcctataatatccaaaagaaaaaaaaatgtggttgtagataactttaaattgtcttttatttcctctgatatatctatgtaacttctaccttaccagtctttttcccttaatctgccagagttcacgacggcctaaagttcttcaaagagaggtagatgtgtatgatattttcattaactagcaacatggctttaactggaaatggggaaaaaccgctttgaagtatttgtgtgtgtatgggtgtttaattaatatggttaaatttaaaagaaggtttcttggatttatgtgtgttttttttttttgacaaagtgatttaagcttaatattaaagaaaatttatattattga

SEQ ID NO: 124290 - DNA, 733 bp, Homo sapiens
tataatgagatgttccgatatacacatacattgtgaaatgatctccacaatcaagctaattaacatatctattacctctacagttaccattgtgtgtatgtgtatgtgttgaatcagtttaatctaagatctagcatcttgcaaattgcaagtataaaatacccccatcccattgacccactctcatctcatcaattcaagtaccaccttcaatcactctcagctgttcacatttttttactgagccaaggattcaagcactctttcttcactttccgtctaattcctgaattgaagtttttcaaacttgggatgagaatgagcaatatttcaagagcaggaaattagtgacagggagagggaactttggggagagggattaactaaaatagtttaattaaggaatgacagacagttatccattcctggggattctcttgaaaagctttttttgtgtctcccttctattgttgaaagatgacatggattcatgtgagacatttataataagaaagagaactagaatggcagagtctgggaagggagatgagtgacaagagggtccctatttttttctactggtctgggaccaacaacacatcatttaggaaatagattggttactctacacacttggcacaatgatctacagatgaagggcccaatctgaaatgtaactatgcatttgtttaaactgcagtaaaacacactgaataccttatagcaaaatgtg

SEQ ID NO: 124291 - DNA, 728 bp, Homo sapiens
ataattatgtttgtgtgtatttaggtcctagtttattaatctttgaaagtcagatattatgtcttatcttttaatccctcagagcacctcactcattcactcaacagatactgaataacctgcttgtgccaagtattattaaactagtctagattcttagggtatatcggtgaacaacaactataaactcttgccctcatggatcttacactataacagggagtaggggagtagctaattggatagtaaatcatatagtaaatgcttaatgtgtaattgttgaatcgaatcttaagctaaggaatttgaattttctattgttggctattgaaatccattgaagggcagtaataggagcggactgtctcataagatatgaatttggcagcagttagtataaagagaaggtagagatggggaatgccatttggatatggtctaggcaagcagtaatgaagattaaataagattgtggttgtggtaatggagcaaaggaaagtaacttatttgaaagatattgtggaattagaattgataatacttagcacatattttcctaaagttgtcttaatatcttttgttacatctgggtccctgtacctatctttgaaacccatttttaaattacttttatttatttgattaattattggatacttattgtctagagtagaaaggaccccctgtcaaaaagcttgatatctgaatccggctctaccattaagaat

SEQ ID NO: 124292 - DNA, 218 bp, Homo sapiens
cagaatccttatgctttgaggcctccgtgctctggctcgtgcccacctctccagattatttccagacacttcccgctgcaatattgcactaccacctactgtctgtcttttcggacctccaaaacaccgaggtcttttctctgtcaggatcttcacatttgcttttctctctgctgaaaatcctcttactccaggctgggcgcggcggctcacgtctg

SEQ ID NO: 124293 - DNA, 286 bp, Homo sapiens
gtccctccatttggggtccctgacttcctgcaacaccacagcacttcatttccaacaaatgaaatgaaagctgtgccaaaatgaatgaaagaagtgccgccccaccccacagcccagacaagtttggctcaaagatctggtctgcttacccactggtcctgctctattggagagtgctgtagacttttgaatacatataggaaaaagtgattcccattattaaagactgaacatttccaaataacaaaatcacatgtggcaaaacttgtgagcatttctgttgttt

SEQ ID NO: 124294 - DNA, 328 bp, Homo sapiens
cgtgagcatgtgtaaggccagagaaggtctcctggaggaagtgactcagggtgagattagagtgatcagtcagcgctaaccaggtggagtggagaaagaagggcaatgagcattccagacacacgggacagcctgtgcaaaggccctgtggcgataggacgtgagggtctttaaggagctgagagatagcgtttaaggagggcagtgctttcttccctgatgggactggaggtgatgatggtgcctaatccctgcatccctggcagaggggaagcttgtggggcttgcaggagctgcctctctgccccacacccatcagccagaggag

SEQ ID NO: 124295 - DNA, 325 bp, Homo sapiens
tttgtggtgagtgttcatatgagattgtgtgtgtttgtgatgatatgaaagctgttgcagtaatagtgaatgaaaacatattattctgctttagagaaaagaagatgccttctttcttatcagtgcaacaaatttagggattaactgaaactgatctctggtggcatttctcagattctattaaacctagtctgctaaggggctgtccaggtaatattagaagatttcacttcgtagaggagacgcaaatattttgaaacaaaatctcaccgctcgcagcttggccaaactggctccaacattcagctggtgttcacatagcttt

SEQ ID NO: 124296 - DNA, 452 bp, Homo sapiens
gcggcgcctactactaccgggcgggacgcgtctggcctttcttactcattttaaataacttcaaacttatacaaaacattgcaaaaataaaaataggacaaagaacacaattcaaacacttctctctccacttgaggccctttacctctagacacatcagtgtctatttcctaagaatgaggatgttctcttgtgtgccacaggacacttgtccactactggccctgtttagaaaatgcttgccgagccctgtgctggagcatgtgttgcccaggtattcatgtgtaagaatgttcctcagaggtcatgacagccaagtgtctgcaaatggcattggttctgagcagcaggagacaggacatgtagcctggtttgttggttgggtggaatagcacgcacacgtcaacatggtgcttcaggagcaccgcctggcagcgtgcatgcgtctcgta

SEQ ID NO: 124297 - DNA, 280 bp, Homo sapiens
gcaggcctcctgtctggagagatgctggcaatctctagctggctgggctcacagggactgtggggaaggggacagcctagaacaaaattatgaatagtcccaacaagtgggcaaagctctatgatgggggaagtcaggatgggcaaccctctgcaactcaggcatcaggacatctattgaaggttactaaggctccatccatccggctggactgggcaagattccaacccctgagagtaggactagtgatgccagctactagttatcaataaacactgtg

SEQ ID NO: 124298 - DNA, 307 bp, Homo sapiens
cctcatccatcccacagacaggcatctgtctcccccaaactcctagcctcttcctgtctgtccctctcatttggcttggcctcatctgccttgccctacctgtgtgtaagtgtgcacgtgcgtgtacaaacctggtctcccagctagactgtgagccctgagaagtgagctactttgatgatgtttcatcacaatcccaacattacttggcatgatgctttgtccctggtggatactcaacaaacatatacagatcgctatgcacccctcccatagccacatcattaggagaggtccaggatgacgt

SEQ ID NO: 124299 - DNA, 331 bp, Homo sapiens
gtaagtgtgcagttttgttacacctgtgaaggatttcaaattgctgtatgaaaagtacaatggagatacgatgctagctttagatagttcccaggtataatagatatatatgtagaaaaccatttttttgtaactgattagagaatttcttcaatggtaacctgatacctggaacagttgcacagttaggtgattacagtttgaaatcttttgattattttagcatttttgctatgttacaaatttgcaaatagtgtaactgtagttgagctatagctttgaaattgagttttattgaactatgttataatgtattatgtaattgtgtttc

SEQ ID NO: 124300 - DNA, 571 bp, Homo sapiens
cctgtaggaagcttaggcttggttccaaggcctcatgacatggccggggcattaccagtcaggctgagctgggggacagaggtgatggggacagcaggcatgttctgtcctcacgaggcccacagtctaggcagggacagatgtcagcagtcatgaccactgcagggcatgcttggagagactacaggacatcgagggggctcagtcagagagctgcaccatgatcccggctctgtcaaggatgagtcatctggcctcagtttccctgtctataaaatgaggagtctgggctgcacagtgtcaaagactcagagaacctagaggggctttctgaggccgctggctccaggagcctaggacccagtcctaccaccatgtgagcaacactgccccacactggatcatttctctgtgtgttccgggctgcgttagagaccaggaattccgccaagcctggggacaggtgttatcctgtcccctccagagcctggggggaagcgtcccctgacctgaggtgccacctctcctgctgctcacacagactgctcttccctaactcagagccagggtg

SEQ ID NO: 124301 - DNA, 425 bp, Homo sapiens
ctacctcagccttccgaaatgctgagattacaggtgtaagccaccacacccagatgaatgagttctttagagcccagtaaaagacttgtgcccatcagttaccaactccaccctgcctgagctgctggactcagtgtcccattcgcctcttctgaagagtcacttgctttcaccttactcagatgaaggggcaaaggaatatccaagtccaattatttttcttccctgctttcaaatacccaatcctcctgactgatcaagataccattagcttcatttctccccccaagtgttttcagcagtttactttccctagccagacaaaattggcacctgtgtgtgttttctagaattttaaaggaattccccttaactcccctcacaggcatattctaatttaatgactatatctccccttcttttcc

SEQ ID NO: 124302 - DNA, 547 bp, Homo sapiens
gaatataaaatagctgctctgaaaagctcatcagtatatttgtcttatatatttgaattgagcagcattcttgcaagtacttttttctgtatcaaaatattgtgcgtattagaacttgtctgaaacatttaatcagaataatcttaaacatctataaattatatggagggtaacttcatttggtttagataaacagcaatttaaaaaatactaaatttagatactgaatatagactggtatttcttactgaattttagctaatttttttctttccataaaacagttttagcagagctttgttacaggtattataggttagaatttaatagaataaaagatctggcatggtaaacctctaaatcatatggactgtagacactcagttacccttcatatggtatctaaaacagaccttgccttaaatatctcattggtaaaatgttgcttttgtttttaaagttcttctttctgtcattcagcatttcattcactcatgtcttcatacaggctgtagtccaaatgtttattttctttattcaggaaagc

SEQ ID NO: 124303 - DNA, 465 bp, Homo sapiens
cctggaggagctaacagccaagaagtatgggaccaagaatatgagagctgccctacaggcttgcggaggaagaaaagattcgaagcagcagcgtggcacaaactgacgggacattatccaccctggagtatcagcgtgaggccattcctaacaggctttggagcccagctctctctttcccattctctggctcagtggctatcctttcttcaagtgcttcctggaagcctcctccctcccccaagtgccaaggggcgccgagtctgtttctcacctctgctcaccaggtccctcctctccaggccataccaggtttctgatcaatccgaggcagggactgggggcatagtggggccagggtaggggcaggcaggcacagcagtgtgcactgtcacagcaagtgggctgggtctgggaatttcagttgggtttagaagctggcctccaacatggccactgtcttcc

SEQ ID NO: 124304 - DNA, 401 bp, Homo sapiens
tccacttttgcaacctcctcatttttcctcttgctggcgccatggaagaagtgcctttcgcctcccaccatgattctgaggcctccccagccaagtggaactgtaagtccaattaaacctctttttcttcccagtctcgggtatgtctttatcagctgcatgaaaacaaactaacacagttactaaaatttttttctcttctaattgtccatatcagattgctatgagaagaggaaagggttaagctagacctaaatataatactgtatgtaagaagttgaaaaaactgtgataaattatctctacatactaataggaaagatatccaagatctacgggcagagtcaaaaaagcaagtttgcaaactgagaggcagagtaagtatgatactgattctgtga

SEQ ID NO: 124305 - DNA, 491 bp, Homo sapiens
atatagttcctgccattaaggagctttatatgaaataggaaggcctaaaaataaacaagcatttataatttgatttaataagagataagaccatgggcacagattggaggattcttaagggatatttggttttttagaattaataagagttaacttctcatgggaaaggattatgggaaagaagaagatattgttggtggggtgcagtggcacacgcctgtaatcccaacactttgggaggccaaggtgggtggatcacttaagcccaagagttccagaccagcctggccaacatggtgaaaccctatctctactaataatacaaaaattagccagatgtggtggtgcgcacctttagccctagctacttgggaggctgaggcacgagaattccttgaaccccaggggacagaggttacagtgatctgagattgtgcagctgcactgcagcctaggtgacagagcaggactctgtctcaaatacataaata

SEQ ID NO: 124306 - DNA, 790 bp, Homo sapiens
ctcaaataaaaaggctgtagtgcagtggcatgatcatggcttgctgcagccttgattcctgggctcaagccatcttcccacctcagcctccccagtagctgggactatacacacataccatctcatctggctaaattttaaaatttttttgtagaaatggggtcccactgtgttactcagtctggtcctgaactcctgggctcaagtgatcctcctgcctcagcctcctgaagtgcagggattacaagcatgagccactgcatctggcctgatttagtgagtttggacaaatgtatacagtcatggaaccaccaccacaatcaacaaaaggaacatttccatcctcttacagttattttgtgatccttttagtcaatttccttccctcattctcagcctcttccatttctagttgtatagttttgcttttctagaaagttatataaatggaatcatatggtatgtagccttttgtgtttggctttttttatgtagcataatagttttgagaatcatctgtgtcgtcgtatgtatcagtagttttattctattttattgcagaataggtagtccattatatggatgcacaatttgtttatacatttaccagttgatggacatttgggttgtttccagttttttatattatgaataatgctgctgcaaacattcatatacaggtctttgtgtggatatacgtttctctttttcttggatagatacctaggagtgagattgctgggtcctctggtctaaggccgggcacagtggcacatgcctgtaatcccag

SEQ ID NO: 124307 - DNA, 380 bp, Homo sapiens
tttgcttctcttctcaagtctgggattgctaagtagcacagagtagtggtgtagcattgagcttcaaagatcaaagtgtgggggaacacatcatgatgtatggcttccttacatgtagaagaatggcagatacaaataacagtaatgatttttatttgcaaagcactttacaatttacaaagtactttcacatctattatctaacgcaagccccaaactaaccctatgaggtatgaagggatcaatatttccttctaggagaaattaagcatttagagaagtgacttgccctcatttacaaaactacttaattagaaacagaagcctacatttttttattctcagttccaacttcatttttactatatgatgcccttttg

SEQ ID NO: 124308 - DNA, 202 bp, Homo sapiens
gcaaatcacttctctagagtgcattttctcttttgtttagtaggtacgaaaacaagagaaacattcaattattgattaggtattatgggtcaggcacagggataagcattttacctgcatcatctaatttaaccctcacagtagtcaaatagagtaggtactgttatcccccttttacagataaggaaactgatgcctggag

SEQ ID NO: 124309 - DNA, 1577 bp, Homo sapiens
agacaagggcggcttacaggagctcctgtggtgcccggctccacacactgccaggcagcccaggtccacatctgtccaggagtctcctcggcggccgatgatgccgcccctcccagcagagtggggtgggcaaggccggcagtgctgtgtgactgtgtgcaagttggcccctcacgggcctcagtttccctgtgtgtctggggaggctgtcagagtggctgagctgacaatttgtcacaggctctcctgctgggcacccatgcctccgtgctcccatgcccctccccgcaggcctgagtttcctgttcctctggtctccatagaaacctctgtccctggtcagcaagagcctgactcctcacttcctatctctgctggggcttctcctgggccttgttggagcccgccctgggcctaagcctctcccatagcgcagctctgcgtgacagtgtcttctcacctcgtgctcttggtcacctccacctcgccacacagtacgtgtaaaggtcaccctgagggcttcaacaccaagagcacagcaaaatggctgtccctcggtctccgggtggggagcctgttacaccaatggggacaggatgggaaaggactcaggggaccccatcaaccctcggccggctctggggcctgacaaggacagggcctgggaaaggacagaggaagtcaggagacaagaccattggtgtctggccgtgcacccttgctggacagtggctgtggctgcaggtggccgagctgcagtggctgctatcggggcaggcaggccggagagcttcatcagctacagctggagcggacaggacacccaccctccagagcccaggccatctcacgccctgtgctagtttcaagggcgttggcatcctgaatctgccactgccaccctagactgatccactaacctttctgagcctcaattttctcatctgcaaaatggagctcacaccacctggttcagaagattggcctaaaggaggtctggatgcgatgacagagagagagtgcctggtgatacctggcagacagcagggcctggcagggcctacacccaccatagacaccagagcatgtgattgtgctacctcctggggtctgtctgcccaccagtgaggccaggaacccagaaagggaagcaggagtgcccagggtggccaccacccaccgcatgaggaacagagccggccacaggtgtcacctgggtatctgctcgtgccatgaggaatgccctctgcacccggtaccaggcctggccccctgagttgctctcacaggataccccatgggactgacccagagcgcccactccacaccctgggcagggcctcgtccgccttctgctccgtgaaggctgggcatggtgcatggcgaccccacctccagcagccccagagcaagggcctgcagctgcctccccagaaccccctcggctctgctcccacagacctgggttggagggaaggaggtggggaagctggaagggaggccagtccctccccagtcagcctaggggctggggaggcagagtcctcctcccttccccaggctgagactcaccacag

SEQ ID NO: 124310 - DNA, 384 bp, Homo sapiens
tcaaacaaccttcaaaggtaggggtgagcttctcagccctcttttagggataagaaaatggactcaaagttggtaaataacctgcccgagaacacacagctagaaagtggcagagtctggactcagacagagcatggcctgactgccagcatttgaacacaactctgccacttggctgtgtgatattggggggtgacagcctcatctgtaaaatggagacaccagccaggtgcagtggctaatgtctgtaatcccagctatttgggaggctgaagctggggtttgagataagccctggcagcatagagactctacccctaaagaataaaaggaaaaaaaattagccaatgcctgtggtcccatctacttgggaggctgagatgg

SEQ ID NO: 124311 - DNA, 811 bp, Homo sapiens
atgtgtatatatatctacacacttacatatatgtattacatatacacccaccattacataccattgtttttctgaacatgtaatatatagtatatacacacatatatagtatacccacataccattatgtttttctgaacatgtaatatatgtagtatacatatgcgtatatttagtatatagtgtgtatatatgtttatactatatatactatatagtatatatacactttatatatagcatatacatactctagcatatacatacatacatagtatgtatatgctatatataaagtatagtatagtacaatacaagaaagatatactatataatagtatatatagtatatacatactatgtatatactacatatacatagtatactatatactatgtatatgtagtatatacatatatggtatatatatgctatatatagtatatacatacatggtatatatatgtattatagtatatttattggattattgttatatgttattattttatgtattggtatatgctatacttgactattatggtatgcaatagtatatgctacaagtatggaaatgcttggcatgttatggacaatttcgcaactcgtcccgacaactcagtgacgaaggctcaacccacattccgaggagacaggcctaaccaacagacacagcacgtctcatgaacgaggggttactgcaagcaccgacaaacacgcacaacgagcacgcagacacaccaaatcacacacacaagcaccacattcaaaagcccctcgcacgcccgccacgcgcagtacagcccacaa

SEQ ID NO: 124312 - DNA, 497 bp, Homo sapiens
tgaagagttgtcttcagccatgctggaagagagtcccaagaaggtcttcatagtgaaaggatccagttcagaatcatgccttgtatttggttgtcatgtgtctttagcgtccttcattctggatcatttcctcagtctttccttgattttcatgaccttgagtctctggaagaatacaggcccattattttgaagcatgtcccttaatttgggtttgtctgatgtttccttaagattagattcagggtgtatgtgtgtatgtgtgtgtgtgtgtacatgcacttgtatgtgcacaggtgcttgaaagaaatggtcctatattgcctatgtttttgtgaaacatgctttctttcccaccccacaagggcatttgtgtgtttacatatgcagctagatcattcattttaactgcaagatgggattctgtcctatgaatatactgcattttgtgtagctattttccttttgatggatttatggagttggtcgcaattttt

SEQ ID NO: 124313 - DNA, 272 bp, Homo sapiens
agtggtgagctagatcactttgatactgcctgtttctatgggcaactttgacaggaacaacaacagagaatatttttctccctctaaaagggctgtaagagaaatcaggattggaaagagactataaaagacttgatgacatcagccttaactttttcctggaatagaagtcttcctcacaagtagggcattcaaactcagtttgagccagagatgaggagctcactacctccacagggcagcatgtgtcacttttcaataagctccacagc

SEQ ID NO: 124314 - DNA, 172 bp, Homo sapiens
ctgaaccgtcctttgctgctctcatccttctccaattcaaaatctaatttggtcctgaaccctcctctctctatatactctcttcttgatgactccattattcccatgtaaatccatgagataatgtgtgtaagctgaccgggtgtgatggctcatgcctataatcacaaca

SEQ ID NO: 124315 - DNA, 568 bp, Homo sapiens
gggagctttaattgagagaaccagtataaactagaatgccccatgtaaacctgacagatggtcacattactatttcaactttttctaagtatagagcaaaagacagactttcaagattttttaagataccaaaatgatcttagtaccaaaacttcacaaagatagctggcatgggcatgtgcctgtatgtgcacacactgcagatcaatcttgatgcaaaaccctttcataaaataccatcagatagaatttagcaatgcagtccgggcgctgtggctcacgcctgtaatcccagcactttgggaggccgaggcgggtggatcacttaaggtcaggagttcgagaccagcctgaccaacatggtgaaaccgcgtctctactaaaaatacaaaaattagccaggtgtggtggtgcacacctgtaatcccatctattcgggaggctgaggcaggggaatcgcttgaacctgggaggtggaagctgcagtgagccgagactgcgccactgcactccagcctgggtgacagagcaagactctgtcttaaaaaaaaaaaaaaaaaaaagaaaa

SEQ ID NO: 124316 - DNA, 411 bp, Homo sapiens
  misc_feature (5)..(5): n is a, c, g, or t
agganacccaaccctgccacccacagcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtagggctgttgcgctgcttgaggccacttctcttccaggcagggctctcatcggtggtgtgggggctgggatgggactcagaaa

SEQ ID NO: 124317 - DNA, 170 bp, Homo sapiens
aaaacaaacaccaactcatgtatccagcccttgtctaggccaggagagcacaaatatgaataaaaagtagcccccaagaaaatgttggggccgtaaggtgggtggaacatgacgagcttaggggagggtagttcacgctctggctctcagaagaggcaacacttgagccg

SEQ ID NO: 124318 - DNA, 533 bp, Homo sapiens
tacactagtaaatatgctggagtacatgaatgaacctttgagtcggcactcagaccacccacagccaaatcacttggggactccttaaaaaatgccctctgcttgccaaggcagctggcaggaaatggccagtgggggccccctccttttgacagcaccctgctctcagaggttgaaccctcagagaccacagggagccaagccggggttcccttcccacttggggtttccttctaattaggacacaatggaacagggctagactactcatttcacacaaacatcagactgggccccttgtgaaaaccctttcagtgccccacaatgctgaggaggaaagtccaggccccctcacaggacattcaatgcctgtcgctggctgccactgctgacctctccagccacacccgtgccgcagccccttatactctactgtcacccccaaccaggtttgtggtcccccaatgtgtcctgtggtcacactgcagcctctgtgcacacctaagacccccaggagagcacatacctcctca

SEQ ID NO: 124319 - DNA, 510 bp, Homo sapiens
taaagaattcaatagtgtgaactttactttacatagttatatgggaattttgcaatgtcagttttaaaatttgaactggataatttttctcctgaaggcttcagacatgagcacgcttccaactcatgttttgctttaccctgtttgactgaactctctggtgattctagtcaactggaacttcagcactccagttctgtcccgactgatgacccttcttgctgtgtcctcacatgatggaagaagtgagaagtctttcttgaatctcatctataaaagcaattagtctattcgtgagatctctgcccccatgacctaatcacatgccaaagcccccacctccagacactatcacctcgggggttaggatttcaatataagaattgggagtgggccgggcactgtggctcacacctgtaatcccagcactttgggaggcctaggcgggaggatcacgaggtcaggagatcgagaccatcctggctaacactgtgacaccccatctctacc

SEQ ID NO: 124320 - DNA, 221 bp, Homo sapiens
aattaattccagaaattaaaagttcattctcccacctcaacgcccatggaatcctgaatgtgatttacatgtcaaaggctgactcagatttaatacatttacttcggaaaaacttagagatgcctgtcaaattacaaagcaattgcctaaacattccagtgacatttaactgctatcaaacagttgaaagttgatctttaacagaatacagctgtgggtgc

SEQ ID NO: 124321 - DNA, 464 bp, Homo sapiens
caagttcatatttgaggaaagtgaggcataagttcacatagctgctaatgatggatccaggacttaaacccaggtctcatggaaccctgagtaacccctcccctccccacgccccaggctcttgttttcagctggacagtccttccagggtcacactactacagacccaagagctactgctcagcctacccctccccagtgaccaaatctggagggcactgaaggaattcatgtgccgtctgtcccttaatctgaacacagagcacacacatctctggccccatggagcccacatccccaaccagtgtgacaaggagcccaccatctccaggccgccctgtggagcagaaagaaggctgaccagaggctgtgaaccaggcaaatccacccaccacagactgggccctaagttccctataaagggagatttagaaagccaggaaatccagtgccaaggttcactt

SEQ ID NO: 124322 - DNA, 483 bp, Homo sapiens
tttcactatttgacaaagatggtgatggaactataacaacaaagaaactaggaactgtaatgaggtctcaggcagaatcccacagaagcagagttacaggacatgattaatgaagtagatgctgatggtaatggcacaattgacttccctgaatttctgacaatgatggcaagaaaaatgaaagacacagacagtgaagaagaaattagagaaacattctgtgtgtttgataaggatggcaatggctatattagtggtgtagaacttcaccatgtgatgacaaaccttggagtgaagttaacagatgaagaagttgattaaatgatcagggaagcagatcctgatggtgatggtcaagtaaactatgagtttgtacaaatgatgacagcataatgaagaccttgtacagaatgtgttaaatttcttgcacaaaactgtttatttgccttttgtttgtaacttatctgtaaaaggcttctccct

SEQ ID NO: 124323 - DNA, 182 bp, Homo sapiens
tcccctgtcctctgctctccccctatctgcctggaagtgtccttgccttgggagtcctccctcccacccaggtgaattcattcctcctttaatgctctgtcatccaagcgcttactctgtccccatccccaccatgactccaggagagtcagggcgctgtctgactctcatccatctcccca

SEQ ID NO: 124324 - DNA, 373 bp, Homo sapiens
cacaggcttgagggtcaagctaggctgtaagacagaaattcactctgcatttctaggaagatggcttgtggcttttacacaggaggactctgaagaacctgctatatcaagtgtcagttatgtgcaagaaacgggattagatactgtggatgaatagggaagtttactagtccttgaccacagggagttcacacattaatacacatgaaaacaaaactgccagggtaaagcccagtacatcctaaatgccaagtgaatgatatacacaatagccagttgctcagtggaagaaccagaaatttgcctggggaaggtctgtgtagacttgcttccatatctgcactgactttgggggtcaggggatctcttaagg

SEQ ID NO: 124325 - DNA, 703 bp, Homo sapiens
tacttttcacaggatttatagctcgtgctgggcccatgcccgagggtgcgtctgtggggagagaaagggctggggacagggatgtaggacttttcttgttggtcctgagcagaaaagttttgacatcaccatctcttacctccctacctaagccttaaagtagaattccggctggaaaatggttttgtgaatttaaattgttttcaagcaaggggagataggcgaaatcattctctctccctaattaggaggatggatggagctgaggactccccgggagggaactggaaggaagatttcactgggggtcagcagggcagctcaatctatgaaaaaatgccaaatagttgatgtttattaggaaaaactgctccctgctatatacccttcataaggctagttaattcccccgtgagcacatgcattctgaatctctgtatttcagagaaaatacccaaagcttgcacccacaccaccttccaaaacaggattaaagagatgtcctcctgagccatgttgagattggtttagaaatctcttgagttttaagactgtttaaaaacggttctggcttggagactggtttccctttggaaaccagtgtctggtggaagctggtatttttataactctaggctctctatcagatcctgtgttaccatggttgctaaggggaacactggcttcccctggaaagtatcac

SEQ ID NO: 124326 - DNA, 101 bp, Homo sapiens
tgctgggattacaggtgtgagccaccatgcctggcctgaatccaggtcttaatcctcagagttcatgccttttttcctttcctttcctttcctttttttct

SEQ ID NO: 124327 - DNA, 648 bp, Homo sapiens
aggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattacttccttttcaagttgtgaaacatgttaacctgtggtaaaatacttacaagatgataattaccatctaaccgtgttgaag

SEQ ID NO: 124328 - DNA, 609 bp, Homo sapiens
tgcagcagacaaacagggctaacaaatacaaccacagcaaccagcctcaccacagtagaccctcatgtgcctggaagtactacaatcctagtacgcttctgcagtccattcattccctcactttcccagacaactccttcactcctcaggcttccaaatctcctcttggctcaccttagatattccactgagaaaattagaacaatcagaaaagaattccaactacctccgaacccacctccatcaccaggccttccttttgttactggggatgaactggtagagttcctatctaagacaactgctccacttctcactagatctcaaggactcaaggacattgctcagcaattctctcccttttccccacatcactttgcctctcaccaggaccatcccatgagcacagacatgctatcatttccctaatcttaaaatccctcagccgggcgcggtggctcacgcctgtaatcccagcactttgggaggccgaagcgggcggatcacaaggtcagaagatcgagaccaccgtggctaacacggtgaaaccccgtctctactaaaaatacaaaaaaaattagccgggcgtggtggtgggctaatagtccc

SEQ ID NO: 124329 - DNA, 308 bp, Homo sapiens
agtgaggaacggccaggtataattggtattttggtgataggattaacaggactggctcatggataagatataggggaggagaaagaagacaagtcaaagatttttggcctcattagcttgtgcagaaaatcagatacttgtgttctcccagttcagtttggtatgtctactgggcattaaagtggagatgttgaatgaattgtttaatatagcagtctgagggaaaaaattagggctgaatatttaaaactgtgggtcattagctacttcatctgctagattccaaggtcaaaatataccgaccatat

SEQ ID NO: 124330 - DNA, 719 bp, Homo sapiens
tgacttggtggtataacctagggctcaggtctcacctctcagatgagggctctgagttcatacagccctttggatctcctggtttttttctgacagaatctgttttggttttgtttgtgttttgaatgatactaagggtaataaaaattcttatttgatatacaaatttctcagaagattggcatttagtattcagctttgctatgcttaattacttcattttcagaagaagtatacgatttataaagtatatgatatggaagttataaacattaacatcacataattaaagaaacatacccattttagagattgaagagggtgatttgtggcttcacaaaaatagaataatcactctagctaccattatttctttcatatttgaagtttttctatttctttctaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaaaaaaaatg

SEQ ID NO: 124331 - DNA, 522 bp, Homo sapiens
  misc_feature (17)..(17): n is a, c, g, or t
  misc_feature (29)..(29): n is a, c, g, or t
  misc_feature (51)..(51): n is a, c, g, or t
  misc_feature (64)..(64): n is a, c, g, or t
  misc_feature (78)..(78): n is a, c, g, or t
ccctgtggtcccccccngtaaaagggggnccctagacccgaggcaagctgnccctacccctagnatccttccccaccngacggagaacccctttacaagaaagaaaaaaccttccatagaaaggtacttaaacttccacccctgtttagccccctattaaggttgcctttggatgtaggaagaggcccccacattggaacctaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaaaaaaaatg

SEQ ID NO: 124332 - DNA, 820 bp, Homo sapiens
tatattctagtaggacaaaatagacaataaataaacagagaaataaaaagtttctgatggagtcctacaaaggaaataaacagtaatgagatagtgtgacttggtaagcatacagaaggtcagccgtgcatctatctgtttggttattgctgaactagaagctataagctagctactcaataaaggaaacatgattttggtataatttgttataccaaattgcatctttattataatattgtttattgtaagagacttcagtctaaaataattgttcttggattgcatccaagaaccaaaaggctgaggttattatgcggttcttctgtgatatcaccccaaatgatgtgttgaggtaccagtgtttattctcagattttattttcttttatgacttttcagctctagcaataagttagaaactgtctgaaaatattactttaaatacaattcagaaactttaaaaatgttgggtttttttggtccacccttaagccctgagtctgtgactcttgagagtgcatgaacactgaattacagctggcaacgtggaggaatttattatttacatttgtgctcatgtgtctgtttaactacttttttcttaggtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaaaaaaaatg

SEQ ID NO: 124333 - DNA, 763 bp, Homo sapiens
gacggagtcttgctctgttacccaggctggagtgcagtggcacgatctcggctcactgcaacctctgcctcccaggttcaagcaattctcctgcctcagcctccctagtagatgggattacaggtacacaccgccacacctggctaattttttagtatttttagtagagacagggtttcaccatgttggccaggctggtctccaactcctgacctcaagtgatccgcccacctcggcctcccaacgtgctgggattacaggcgtgagccaccgtgcgcagcctttcccctttgaacttaacacttttggtaacctgactatattcagatattctagatctataattttattttgatttttctaatttgttctaatgattaaatactcttaagaaaggccatgggggatggctttcatttcgttccagagactccttcagcagtcgtcatttctgtctgggtgattgagacccagcccagacctgaatgcggacactaaaaagatttaaagactttgagagtcccccagctttctgaccctggcttttgtggagaggtctgggaagatgggagatagtgagctcaaagaaggagaagataatggcgtatgtcccacattttctcccagggtatggcagcctccctaatacccttataagctaggaagctcctaggatgctgtagctcagacctgagctttccgcgtcagcaagtaggaatcgtttttgctgcagagaataaaaggaccacgtgccctcgtgccg

SEQ ID NO: 124334 - DNA, 941 bp, Homo sapiens
gacggagtcttgctctgttacccaggctggagtgcagtggcacgatctcggctcactgcaacctctgcctcccaggttcaagcaattctcctgcctcagcctccctagtagatgggattacaggtacacaccgccacacctggctaattttttagtatttttagtagagacagggtttcaccatgttggccaggctggtctccaactcctgacctcaagtgatccgcccacctcggcctcccaacgtgctgggattacaggcgtgagccaccgtgcgcagcctttcccctttgaacttaacacttttggtaacctgactatattcagatattctagatctataattttattttgatttttctaatttgttctaatgattaaatactcttaagaaaggccatgggggatggctttcatttcgttccagagactccttcagcagtcgtcatttctgtctgggtgattgagacccagcccagacctgaatgcggacactaaaaagatttaaagactttgagagtcccccagctttctgaccctggcttttgtggagaggtctgggaagatgggagatagtgagctcaaagaaggagaagataatggcgtatgtcccacattttctcccagggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaaaaaaaatg

SEQ ID NO: 124335 - DNA, 254 bp, Homo sapiens
ggtcatggtaaacttgccagtgtatataaatcatccaaatggacatggtgatgaggagttggacctgtagatctgaagcgtagagaggaaggcagagttggagatgtagatatgggagcctctggcctgtggagagagtgtatgatcaccatcctggactacacgtggagaagaaaagatgaccagcgacagagggctgggtagagccagcaaaggagacctcaaaaggatggcagacagggtgaggtaaggtc

SEQ ID NO: 124336 - DNA, 480 bp, Homo sapiens
attttcagtctgaagaagaaaagacaaaatagatgacagaaggagtattagaagggagagcgatgagactcagttggacaccgagagagcaaagaagcaataatacgtgaagatgaaaatgaaatcaatttcagcataagaagacaagaacttatggtaaagctgcccacagccagaagaggatcctagaaggacaggaattccctgtctgcagcatttcataagcatgtaatattgttgcagggatactgcagaaggagttgaagcagtggacagacagatgatataggtgattttacagcctaagaaagccctgtgcttgtgcccccaaaacatgaggtgctagtgaatgaatgctgggggaaagcccagggcctaggtgttgcaatgttctgtggttggcagatgctttttgttttgttaaaaagtgcaacaaataaaatttatcaatacttttctgctactcaggaaaaaaaaact

SEQ ID NO: 124337 - DNA, 387 bp, Homo sapiens
ttctccttcctcagcctcccaagtagctgggactacaggtgcccgccaccgcgcccagctaatttttctatttttagtagagacagggtttcaccatgttgaccaggatggtcccgatctcctgacctcgtgatccgcacgccttggcctcccaaagttttgggattataggcatgagccactgcgcccagccaaagctagatttagaaatccattatttcacataactggtctcagataaaccagtctacatcacaatgtctaaaatgaacaacacctgtgacaggtcagcacagactaagtaagtgtattagtgtcaatttatagcttaatttctctctcttttaagatacagacattccaattattttctttctgtatcctttg

SEQ ID NO: 124338 - DNA, 164 bp, Homo sapiens
accaaggcttacccacatccactcctggtaactaaagaagatgcggacattgacagattcagttcatcttttcacaacctgctaaaacaggcttgatttttttctggttgaactgcctgcctatctacctccctcccttcctatctacctgtctatgttatgtg

SEQ ID NO: 124339 - DNA, 554 bp, Homo sapiens
cgcggtggctcacgcctgtaatcccagcactttgggaggccgaggcgggcggatcacgaggtcaggagatcgagaccagcctggctaacatggtgaactcctgtctcaactaaaaatacaaaaaattagctgggtatggtggcaggtgcctgtagtcccagctactcgggaggctgaggcaggagaatggcatgaacctgggaggcggagtttgcagtgagccgagatcgcaccactgcactccagcctgggcgacagagtgagactccgtctccaaaaaaaaaacaaaaaaagatgctttactttgttttatacattccaaactactcctactaagaatagtaatgaaaaaattctccggccgggcgcggtggctcactcctgtaatcccagcactttggaaggcaggggtgggcggatcacctgaggtcgggagctctagaccagcctgaccatcaggggaaaccccgtctctactaaaaaaaaaaaaaaaaagaatacaaaattagccaggcatggtggcacatgcctgtagtcccagctacttgggaggc

SEQ ID NO: 124340 - DNA, 358 bp, Homo sapiens
aatgttgtgtgaccatcccctctatcttgttccaaaacatttccatcacttcaaagtaaaacaccttaaacactaagcagtttctcctaatttccctctccccccagtgcctgtcaaccaccagtatgcattatatctatagattttatctatcctgaatatctcatgtaaatggaatcatatatgacctttttgtgacagggtattattactctgttgctcaggctagagtgcagtgactttttgtgtctggttctttcccttagcataatattttcaaggtttgtccatgttgtaacatgtatcagtactttattctttttgttaataggcgaataatattccactgtatgtatgt

SEQ ID NO: 124341 - DNA, 715 bp, Homo sapiens
caggagaatcgcttgaatctgggaggcagaggctggagttagccaagatggcaccattgcactccagcctgggtgacagagcgagactccgtctcaaagaaaaagatatgctcattttgatttggaataaagctgcctggccaaaagatggcttgtggctagaagaggaaggacaaataagaaaacataaatggttcaaatagcactctatgtacaaaaacatgaaaaggtgaaaatttcttaatttcaactttttgttagaaattagtacgtcacatatagtcctccagggagcgctctgaggctgttactagtcctttagttaataaagcgagaaggccctgtaacttagcctataggattttagcgctgacgcctccgaacccacccaggctttcgcctcggaaaggcacggaagaggccccatgttaatacccgcagtctaggacacggagtcatcctcagggccctgtcacccgtgagtgagattacagtcattatactgcgggggcgggcgtcattatactgtggaaggtggtgctgcgggaactgtacagagacctagccgggtgttcctgccctgcggatggcagcggagaaccctggggggcgtttttagcctgcggatcgcctggtgctgctgaagccgcgcttgaagacctagctgagtgtcctcccctgcggaagcctgcggaggacctgggcggactcttta

SEQ ID NO: 124342 - DNA, 145 bp, Homo sapiens
  misc_feature (34)..(35): n is a, c, g, or t
  misc_feature (37)..(37): n is a, c, g, or t
caggattatatctgcaccacagcaatttgccccnnanctgtttctgacaacctgtatgtatgaggcaagtagtgcagttcaggatagagaatggaacctgccctgggagatcaggctgtgaatcttggctctgccaacttactct

SEQ ID NO: 124343 - DNA, 305 bp, Homo sapiens
gcaggcgtgggaagggctgccgggccagcactgtggggctggccgcatgtgtgggctgctgtgcgtgtttgcaggtgtgtgtggacgtcttgtgtctgtggctgtgtgatgtgtctttgcggactgggcccatatcacgctcccacctcctccactgaattgggctcctgtccccacgccttccctgcgtcccaggccagcctgggggccgtgctccacctcccctcccgaactggactcctgtccccacgccttccctccgtcccaggccagcctgggggccgtgctccacctcccctcccgaa

SEQ ID NO: 124344 - DNA, 434 bp, Homo sapiens
aatgccgcgtgtctcagcctgggcactgcaggcacctggggcacgtgggcagccgacctgggcattgtgcagtgtggagcagcatccctggcctctactcactagatgccaggagcacatccccaaaatatccccagacattgccaaatgtcccctggaggacaaaattgcccgataaagaaccactggtgtcaagaagtacagaaaacctgccaccctcatcccacacacctaacattagaaaatccaaatgtaatttgatttaaagatgttttcttacatataatgggccattaaaaccagagcaaacaggctgggtgtggtggctcatgcctgtaatcccaacactttgggaggctcaggtgggaggattctttgaacccaagagttgaagaccagcttgggcaacacaacagtgagacctcgtctctaca

SEQ ID NO: 124345 - DNA, 631 bp, Homo sapiens
gaccaaagaggctgggccccgccatgggccagacggcaggcgaccttggctggcggctcagcctgttgctgcttcccttgctcctggttcaagctggtgtctggggattcccaaggcccccagggaggccccagctgagcctgcaggagctgcggagggagttcacagtcagcctgcatctcgccaggaagctgctctccgaggttcggggccaggcccaccgctttgcggaatctcacctgccaggagtgaacctgtacctcctgcccctgggagagcagctccctgatgtttccctgaccttccaggcctggcgccgcctctctgacccggagcgtctctgcttcatctccaccacgcttcagcccttccatgccctgctgggagggctggggacccagggccgctggaccaacatggagaggatgcagctgtgggccatgaggctggacctccgcgatctgcagcggcacctccgcttccaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccac

SEQ ID NO: 124346 - DNA, 413 bp, Homo sapiens
ctgcccaagtatacacagcttgttgttgacagaaccagaacaacacacagttctcttttcttccagaaaagtggggctggttccatttctcactcctgtcttcctttggatggaggaaaatgataatgaaacctaacataatgcctatttcaacttcagaaattttcctcaaataattgaatcagtaggtttgaggcttcttgggaatcattatgttagacctgaaacagaaatagccaatcccttggttgaaacgtgttacatttaaattgatactgcttttccccaaagtgcaattagaaaagacaaagacctacttctgtaaatgttgttaagggaaaatggagcaggtgtctcctttctttcatttctctgggtcagttgtactcctgaagtctctctctgtttagatg

SEQ ID NO: 124347 - DNA, 125 bp, Homo sapiens
cgtgtgctagtgtgtgtgtgcgtccacgtgtgcgtgtgtgtgcgcgcacacgcagcaccacctggtggccactcagctcactgcgcccgccacagggctggcctgtgcttctggctcagaaaact

SEQ ID NO: 124348 - DNA, 137 bp, Homo sapiens
gcatcacgcaacttaccagagacgaggcttaaacacaagccttcattttctcattaataaatccagtggtttcccttggagagactgccgctagccactaaataaaccaaaaagaaaactctctggaaaggcaaaca

SEQ ID NO: 124349 - DNA, 351 bp, Homo sapiens
attcactcttacatggctctgttcccaccacccagtcactcaagccacacatgatggagtcagctctgagccactccttcctaccttccgatttcaggccatctgagagcccttttgaacctccaaaatgcaccttgaattcactcccacttcaccatctcccctaacctgggcagctacagcctcctacctgggctccctgcttccacaactgcctctctccagttttactggccacagagcagccagtgacctcctcctggcctcccacaccttgaccaccgcactccagccggctccctcctcctctgcttggcagaggcctcatccttcaggtctcggcttcaatgc

SEQ ID NO: 124350 - DNA, 669 bp, Homo sapiens
ggttcatatattatagtgattgccacccctcacaccctggtgtgttcctacatttacgttattgaaatccctaacaaccttctcacccacttttgcttagaactggtgaagcacagaggtacgtcagaaaatttttcttttttttctttttctttcttcttctttttttaaatacagggtctcactctgttgcccaggctggagtgctctgttgcccaggtacatttatggctcactgtagcctccctactgagctcaagccatccttgctcctcagcttcctgagtagctggaactactgtaggcatgcaccaccatacctggctaatttttgtattttttgtagagatggggttttgccatattgcccaggctggcctccaactcctggtcttaagcaattcttccacgtcagcctcccatagtgctggtattgcaggcatgagccactgtgcccagacagaaaagttttctaaactagaaaataaactcatttatttattcaacaaacacaatcaactacattcactgttgaattatactcaatacgaattaactcactgaaatcaactaaaacaatccccttctgaatttttgttgataaaatagatacctgaagcatatgataagggaaagagagctagtcttggaatccagtcctacctctac

SEQ ID NO: 124351 - DNA, 487 bp, Homo sapiens
tgcaaatcacttagaggttttgttaaatacatacggtaggtaaccaaaatacatatggtgactatatttctatgtaccagtgtttcttttttctagtttccaaccagacatttccatataggaatcatctaaaactcttcacttccatccttttaaaataattttcccttatttgactcccaggtcttaaatctgctgatacaaaagcagattgggggtgggggagagctgaaataaacaagtgagatgtgtattttacttagaagtctataatttgcatttctttctttttccaaaatacagacaactgtgaagagataagcaaataaatccctgagggagtatgaatacaagcaatgaaaaagaaggctgggatcaggtgtctgtgaagcaaattacacctgaactccataaacttgccatctgtccaaattgaacaacttgtccggaactactgagaaaatttctgaagcacaggttgattgat

SEQ ID NO: 124352 - DNA, 408 bp, Homo sapiens
tgagactctgcaaaattatcatgccgtccttgggctcccggcttttattgcttctcccctcgctcattatgaaatgattagttgtctccgatgcccttttgaattgctgctaacgttgtactgcggttctgttaccctggttctgaataggagagtcttggttcagggttaagttaatgtagtcattactggcccatttggggacccattcatcatgctaatttcatgtccaacacttgggggaatagagtacaaatactcaacgtgaagcaaatgcacagtgaatccaaaagacgcacatgaaatgtccagaactcagtcacagaagacaggcatggggagctctggggccattactttccataactgtgggagcaatgcagacatcagagagggcctccaatgggg

SEQ ID NO: 124353 - DNA, 634 bp, Homo sapiens
ttccattcatttctgcttccatgatctctgctcacactgccccccatactggcttttccctttcttcaacttccacaacaggccttttctgaattgatacaaacacattcacacaggtaccacaatgtgtgtcatctcaaaagcagaactgagctggtttgtctttttgtctttttgtctactgaagcaacacactacaacagctaaacagattttacaccaaatctgaagggctttcttctgtgtgtgacacaacacacataacaaaaatttgccatgattctgtttaaatggacagtttagttactgttaagcacattcacactgttgtgcaaccaatctccaggactattttcaccttgtaaaaccaaaattctataccaattaaacaactctcattcctcccgcacccctgctccctactcctggcaaccactcttctatcttatttctatgaatttgactactctaggtacttcataagagtagaatcatacactacagtctgtgtcaattaatgatagggataccttccaagaaatgcatcgttaggtgatttcatcattttgcgaacattgtagagcatatttacacaaacctagatggtggagcctgctacacaccgaggctatat

SEQ ID NO: 124354 - DNA, 503 bp, Homo sapiens
tttaggtatttccaattaatgcattttgaatgaaggacctagatgatcgcagtcagagagaatggttaagaggtggttcctgttctcagaatctgaaacttcccaagggttaattttatgttcagtgttttgggagattttcttgtgctttaaaaggaactaaagggactttgaagttagttacattgccttgcataatctgcaagataaagtatatccagggaggagataactgtgggctctgaaaagaatgaaagtgaggctgatactttacaagccattcagaattggtgaataggttttcagtggttgttcttaaaacttccagggcatacacaccaatttcaaaaggaacttaaagaactatgaatagttgtgcctttctgttttacgggctaagcctgtatacttatgaaatttgagtatagttttagttggcaaaacacttgagtttaaaatgctacccagtgtgtcactttttttggtaacatgtatttggcgct

SEQ ID NO: 124355 - DNA, 335 bp, Homo sapiens
tgactgcaggccaagcctggctgagaagcatttgggtacagaggggcttttggggaatgatcaggggtgatcaggagcaccagctcctacagattgtttgacacatgccacaagccttgaaatggaaaaggaacacacatatgtcatatcacctctcaacatttcactgaaggagattttcccctaaatagaaagatatggagaaagagtactgagaataatgggctggataagtgggacaatccttgcccttactgaccttcctgaagtgtcgctgaaataggtggacttagaactgaatggaatctactctaagttatttagcaaacctcttc

SEQ ID NO: 124356 - DNA, 766 bp, Homo sapiens
acgggcagtgtggatggcatgcagtgggatggtgaaggatggggccagaggaaggaaggacatgcccgcccagctgtgtttgggatgctgcctccctggagaggggtcatgaagcctagcaggcagtggagcccaggtaatggtggaccttgaggggaacgccagtgggaaacttagacccatgaactccagactgtacattgaggccatcagtttcaaatgtttactttttggtatttgctattccaagctgaacacagggaggtgggtgagttggaagcttgtttgtgcttggaagcttgtttgtgctggatgtactttagcaggacttccccggactacagggggcttctgagccactgggctccccagagtgatgagagacctgctgtgtagactactcctgaaagactttcatgaaggcacaaaagcaacaggtttgctgagtggtgctgcccgtgccccataaggagaacggtgtatactgtttccacacgatgcagcaagccaagctccaggctgcacacttggggtctttaaaggatgcctcattagagtaaaatgggacttacttttttttttataactcaattttattctgagcccctgttatgctaggtggcagaaatgtcatctcaggcaatgttgggggcctgcccctttcctcagggcttgctatcgaggaagtcatcgagggcttgcgatcaaggcctggggtcccacctgtcctcacagcttgctgctgggacacctgctcctccgtgcc

SEQ ID NO: 124357 - DNA, 470 bp, Homo sapiens
gtggtcacacggtttgctggtgtctcttcatccatccttttcatttctaatcatccattacactccattcaagtgtccctgtgggatgtggctttttctgttgtaattagcctgcaacgccttactcccccttctctcccccagtttatcacttaggcaaattctgtacagtgtttgatttgcggggcagtaattgaccattttctttcaaggagtgcttccttttgaagatggaacatcagcttcagctttttctgtgtagacattggctcagacttgctatgagctcatggtgttcggtggcctgggttggggaggccagtctggtgtgagggttttaatgcatacccactctggcatccagaggtgccagtcaggagaggaacagctagagaactgtagagagacggatggtctattaatacctccaaatcttcaaggaacacaaatgagaagttaagataaaagca

SEQ ID NO: 124358 - DNA, 402 bp, Homo sapiens
caacaataggggagtctctaagctgaccagtcaggcatcagcttggcgactgggctgtctgtgtacaacgtcatagtgtgaaaatccgtggctttttcagaaagcaagctatttttttctcttattacagctactaaattttgagttattctcacctttattcattttttaaaatgtgggcctgcaaaagtatatctagtactataacaatatcttttttcctctaaatttttattttttaatttttgtgggtacatagtaggtttatatatttattgggagtataacaaccccttaatagggagaaacaacatttgaggggagggaaaatatgtatacaataaacagagtggggtcacatgataacattctaggcattttgtcagaggtggacctaaaatt

SEQ ID NO: 124359 - DNA, 450 bp, Homo sapiens
gctgaggtaccatctctgtcattgtaactacgccaaaggcagatggatgagagaagggacctgcccttaggctgaaagatttgttatgttggtagctggtggtgttgtctggaacttatgaattgtattttccttgtagctttttcagaaagcaagctatttttttctcttattacagctactaaattttgagttattctcacctttattcattttttaaaatgtgggcctgcaaaagtatatctagtactataacaatatcttttttcctctaaatttttattttttaatttttgtgggtacatagtaggtttatatatttattgggagtataacaaccccttaatagggagaaacaacatttgaggggagggaaaatatgtatacaataaacagagtggggtcacatgataacattctaggcattttgtcagaggtggacctaaaatt

SEQ ID NO: 124360 - DNA, 290 bp, Homo sapiens
ctgggctaggcgcgccacccgtgcaagtccccggggagcggcggtgcaccctccgtcccgcgcgctcgcagccattgtagggtgggcgctcgccaggcagggtgccgacacgccctctccgcgctgcgacgggcggccgggggaggagagggtgcgctgtgcgcaccggagggagaggctccggcccagtgccgcctgcccgccagcagaccagcaggctcctctttgcggcgggtgccccacgcgcctctcgggcgcgcgctcccagccccgcccgcgtgcggcggccg

SEQ ID NO: 124361 - DNA, 405 bp, Homo sapiens
gttgggcaggatggtcttgatctcctgacctcatgatccacctgcctcggcctcccaaagtgctggggttacaggcgtgagtcaccgcacccagccagcttaaggatttttgaaagaagcctctgactctcttagccttccttgcccaccccctgtgcattgtcctacactcccgaagagttacaatctattttacaacccttacagtaaaagagtgcatatgctgtcagaaaatgggattggaagttttattctgtagggatattttaggtttctgcggacactaatgctctttttccttcctaaaaatagtgcagggtttgaggtcttatagcacctacataaattctaccagggatctaagggaacagcttcaaactcagcacctgagaccccgtctccaca

SEQ ID NO: 124362 - DNA, 433 bp, Homo sapiens
acctgtggattcccagactcttctaaaccagtgactgaggggttcatctttggcccatcttggacctctaagacactctccagcctatagctatattcatttggattggtcagttcccaagccaaactagttgttaatattttttatatcacctttatttaactcaaaggatttatattttgatggtgtcatttaagacacagtgtgacaaacttaggggtaaagtgagctaaaatgataggataattgagcttccattcctatgcaagaattgatgactttagtttcatagaaaagctggaaaatacttaaattttcctccagaaagccattttttttctgggaagaaacatatactcttataacgaacattaatgaacattatttaggaaattcacatcagagaaaaatttttattaaaaaaacagctgtt

SEQ ID NO: 124363 - DNA, 251 bp, Homo sapiens
cagctttcaggatgagaactaaagagccctaaaggtctctcatgtaggaagagggtggtgtgtagtggcagagagggaagcttcatcagtgagagccaagtgctaaaagcagctgcgtgtgacatttccgtcagcagtccttcctccctcattgtgtatgagacacacatcagatgctctggtttatgatttcagcttcagagtacataccctttgagatccaagctcacatatctcttccggtggcatgg

SEQ ID NO: 124364 - DNA, 485 bp, Homo sapiens
gttcgccaggatagtctccatctcttgacctcgtgatctgcctgcctcagcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttatttatttatttattttgagacagtttctcccttgttgcccaggctggagtgcaatggggcaatatcagctcaccgcaacctctgcttcccaggagaatcacttgaacctgggaggcggaggttgcagttagctgagcattgtgccactgcactccagcctgggcaacagggcaggactccatctcaaataaatcaagtgtgaaggatgaaagctgctatggcaaacatccttagcctgcaatcctgtggaatacttcccaaattcacatttaaaataccc

SEQ ID NO: 124365 - DNA, 257 bp, Homo sapiens
aagaaatcagtattttgagcaagctccccagatgttgatgatgcacattcaagtttgagatctattagatagacagaaaggagcccatgggagcttttgctgaagggagtgatgtgataatagcagtatctttggaagctcaatagggtgggacagtgtaggatgtagaaactagagtaaggaaaccagttaggtgactgttaaagtagttcagatatgaacttcacaaattcagattttctttctggctggtaccc

SEQ ID NO: 124366 - DNA, 280 bp, Homo sapiens
cagctcgtatatggtctcagctcaacgatggtcctcagctcaacgatggtcctcagctcaacgatggtcctcagctcaacgatggtcctcagctcaaccatggcccctgcagctgttgtgagagatggtttctagacctttcaccatcctgcttgcttctgctggaagggcctccatttgtcaagctgagattctgtgagaatccagccaacttctgtcctaacttacttcacacagaggcagcttttgaagatagatgtgagggtagctgagccggctg

SEQ ID NO: 124367 - DNA, 517 bp, Homo sapiens
tgcaggttgtcagtaagcagtgccttggtagcaggctgaagggcggccatgagcactcgaatggggcccatttgcccagttcacagatggggagacaggacaggtgggccagagtcacacagttaatcagagccactggaagactttctagcatgagggtcccggccaagctgccctcaccatgaattatgctgcagggtggggggcatctccccagagtccccagcagcaccccatcacacccagcccaagccagcagcaagctgcttgtgatgaggatactgccctggcccctcctaagaccccaccatgtggccattaaggatcatgtctaataggagcactgaatgactctgaagcctcctcgtgacttagtccaaaagagaagaaaagaaaattataaggtgaccagaaagaaacatactagaatgatgaccaggatgacctctgggtgggaggactacagggcagttttatttttcttccttcacttttctgacttccagacttctgcagc

SEQ ID NO: 124368 - DNA, 521 bp, Homo sapiens
gattactctgggtacctcatttaagtgaagtcatgcagtattggtctttttgtacttgttttatttcacttcacattgtgtcttcaagtttcacccatgttgtagcatgtgtcagaatttcttccctttttagactaaataatattctattgtttatacgaacattcaggttacttctatcttttggctattgtgaattatgctgctgtgaacatgggtgtacaagtatctctttgaggccctgctttcaattctcttgggtatattcccagaagtggaattgctggatcatatggtaattctattttgaattttttgaggaactgatatattgctttccatagagactgcaccattttacattcccatcaacagtttgcaggagttactatttctccatatcccccctaacacttgctattttctgttaaaaatggatatcttaataatcaagcaaaaataacaggcagatttgaaaaagaactgaatacagcttttagaaataaaaactataattataa

SEQ ID NO: 124369 - DNA, 172 bp, Homo sapiens
gaggctggggtaattctgtccagcccctctgtggatggagtaggagtccctttgcgtcccctacttcacctgacacctgccaggagagtctccatgcctatcttctttcctcttcttggattttacagtaggcaagtgccaggtgtgtaggctaggaagagtagggagctcg

SEQ ID NO: 124370 - DNA, 126 bp, Homo sapiens
aaaaattgcactaaaataattagaaggaggcttgtagtggtttaacttgaagaaggctgcttgttaaacatgaacagcagcacgactgccatgtacagtgggacaggtggtgcactgcacaactcc

SEQ ID NO: 124371 - DNA, 348 bp, Homo sapiens
cttcctctccaacacccttctgaatatatatcatttgttctttcttttcaaactacatttctcatcattatgaaaattacaaaagttaaagcatgctatgaaaactttccaaatagctcattaaatgactctagtaatctaccctccattttctttttacctcacttgcatgcccatttggccccacaaatttgaatatactcaattgcatatttaaactggctattccattatcacccctagattataataatctttcttgaagttaatgtataactttacaacatggcaagatgctgaatgactacaggtgaatagcttcatatacatgcatatgaatttaacatg

SEQ ID NO: 124372 - DNA, 216 bp, Homo sapiens
ccttctcctctactctcactcacaagggccggctcagcccccttttggggttttggttgtaaggacagagtggctgggggagtggcagctccacgcaagaggaccccacatccatttctggcctagtgctgccacccctcactgctgactccagtacaacctcctccccacacagataatcgtatctcaaagcacaagtttccaatcacacagcaa

SEQ ID NO: 124373 - DNA, 687 bp, Homo sapiens
cttcggaggatccaccttatgttctgacccaccggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctactctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctcgttctggggctgtgaagtagctgagatggtccatgtcctcaaggagctttacagcatagttggggagtaagacaaatgcacattaatctccttagagtttgctaagtgctatgacaagggtttttgctgggtgctgtgggtaaactgtaggaagaaaaattagctctgcccaggacttcgggggatgtttcttggaggagacaacatccaaagttgaatcatgtagagtgagtcgagttagcctggttaaagaagggtggggaagaacc

SEQ ID NO: 124374 - DNA, 353 bp, Homo sapiens
aacttggtggagaaatggctgattcgaggtctggacaggaaataagcaagtgatctggaacatgtcaaaccaaatactaaagaggctatcaaagttattaggatcatttcaaaagaacttgagtcaccttgaagaagctcctgatggccagagatggaacaaattgcacattaataagggtaaacattgtaatggagctgatctattgtttcataaggatacttaaagaaatactaacttatcactgttggataatattagtaacttaactcatcacttgcaatctggtaagtaaagagtgagaaagaagtattttatgccacttaaaaaatattaaaaatgggatacccagg

SEQ ID NO: 124375 - DNA, 200 bp, Homo sapiens
cagctcctgcctccgacgggctgtccaggcccaaaacttcctcaagtcgcctcttcaggcacagctcctgcctaacactggcctctttaggcacagctcatgcctctcagtggcctctccaggcccagctcccgcatcccggtggcttctccagactgagaactttctcaagtctgccatttcagcccaaactcctgcct

SEQ ID NO: 124376 - DNA, 656 bp, Homo sapiens
ctttaaatgtaccttaaaaatcatcatttcaagctgtagttcttgtagcattgtgcacaagatgctttatatgtctttatagattctttgtgtatgttcagcaccttgagataaaagattaggtcccctattgagtatttccacacctctctgtactttccttattattatacttatcataccttatgattactttgtttagttatctttcctgctaaactgaattccgtgagaaacaacattatgtatccatttttgccattgttgtttcagcacctagcaaaggacctggcaccatagggagccctcaatccatgtttctcaatttcagagtaataaatgctatgaaaataatataactgggtaatataataagagtaattgggaaatttccttagattggagctcagggaaggccccttctaatacctgaatgacaaaaatgagctatctgttcaaatacacctggagtgtttctgctgagagtgttttaggaagagcaaagacactcgagtaggaacaagttgagcacgtttaagggttcatgcctggctgggaggaaagaagtaatagcagaggagttttagggagaaaagggctaaataatgaacggttttgtaagtcagagagagtttgaattttattttaattgcatt

SEQ ID NO: 124377 - DNA, 317 bp, Homo sapiens
gattataggagcacaccactgcgcccagctgaggtgcccacatttctatctccacctcactcttttcagactttggtcttgtatatacaatacatttccatgtatatgtcttataaacatctctaatgtaacacattgtcagtgtaacacttgatttcccccaccaaactatttcttccctcttttacttgctgactcctctgttcacccaggtgctcaaaccagacaacccggctcccacccactgaacgtggagaagtggggcaagtgccaagagtcacctttgatccctctctgtctgttagtcacttttcacc

SEQ ID NO: 124378 - DNA, 278 bp, Homo sapiens
aaaatttccacttgtgtccttgttttacacctctcctactatcatcacgtttccctgcagacctcttaaataaggtctgagacatgtagtcctttccgttgtattctcattattcaagcaccccactgatgtggtggtaatgcgtgaagggaggggaagcattctatgatcttatgattaggtttcagtcttagtgagcctgtgcccctgggctgcgaccttcacaggtgcttctcagttgttgattttcagtttgctaaggttttttgttgtgagac

SEQ ID NO: 124379 - DNA, 628 bp, Homo sapiens
gtggtgtaactaggaaggtgatgtgatgggtaatgctctttttcccagcctgttctactagtgggagaatacaatcagtttataatgcataataaccaggtgtcttttgggtattcctaaatattcaaccttttggagttacacctcctataattttcaaatagaatgctttgaatgacgatcccagtcttcctccagtatctccatggattatcaagagtgtacctccagccatctctgcttcaatggtttgcttctgctgaattctcaatttctatttcagtctcctcatctatgacagacagtgatccttcccaggtagcactttgcctctggttgggtgttggcataccctctaggtgccataaagtagagctatgtatccacctttactgaaggtttccacacttcaggagaaaattagaatacagcaatgctcagcactactgtaaacctatattttgaatatgactatttccaaaatctaaggcaaaaacattagatgctttgcagctttatccagcttcctagcctctctgctgtatgtcaaggtccaccttctctcatttgtaggagagagcacctttcataaaagtttcatagggccaatttcccccttactttaaga

SEQ ID NO: 124380 - DNA, 587 bp, Homo sapiens
agggcttccaggcccctccaagcctggggaaggacgtggcatccaagctgagccagagggaactgctgctgtcctcccttcatttctgtggaccttggaggctttggctttgtggcagggcctccccaggcagctctgggacctaggagtttgcttctgatagggtcagctttcccatttcccttcaatgcttgggaaccttctcccttagcttcacacttgccgtttcaagccctgctgggaccttgtggcttggctggaatccaggactgtattttcatggagaagaacctgcagattcttccatcctcagctggccatggcccacagctctgcatctgcatctgagcttctcaagactcctggagcatgaggggaatggggcggggccactgctctgtgctgacgggctccgtctcggagattcttgtcctgttttttttctgttgtttttttttggctggtgctggggacaagcctgtgcctgccaaagctcccaggccaagtttgggggctggtgtttggggttgggtttggggttcaggatgctgcagtctgtgcaataataaacccgcatctgctcacgg

SEQ ID NO: 124381 - DNA, 657 bp, Homo sapiens
ccagagaggcaaccatcaggaaccgctgcatgtcagatggtcagccggagggccagacagagctgaggaaggggctggaggagcctcacacttgtgggagacccactgctccagggaccaggccagcagaggtggacgtcctctctccagcctccgacaagggaggactccagtcgtttctattggatccagcccacgcagaagccagagctgagttgagcaatgaaactgatacttcctttgcagagaggagcttctatttaaattatgaagaaaaagactcagaagaccaagtcctccctccacccctggaggagagaaaagggcgcctggatgcccctcccggaggtgagcccaggccgacgctgaattccttagacctgagggtttctgctgctgcttccagcaggagcaaggacgaagcccacatgacttccccaaaggaaggggcagggacccccaagaaccatggaggacctggtgacctgaagggatctcccgcaggacagacgtttgctgaaggctgggaagatgcccagtggggagtggaaggagagtttccccacctgacagccagcgcagcccgagaggaagggacccccgtgagtggagatttgctgggaaaggctgaggaaagtcccacagaggaactgaaga

SEQ ID NO: 124382 - DNA, 338 bp, Homo sapiens
tatatggacaaatatctctggaagaaaacacaaagaagacactggttaccccgggcgaagcgaactgaaggctaagatgagagtgagaagacttaataccctataactttaggaaccttttgaattttaaaccatgcaaatgtagtccccataagtaccaccaacataaaaaataacaacccaaaaatgaaccttaaattcaatctatttgcagatgtaagcatatatgttagtacaaactgcaccatgttgtaagctccctgctattttgcagacctttgtcgaagtgaaacatttcacaggggttcaggccatgagaagtatcctgcctaaccacc

SEQ ID NO: 124383 - DNA, 661 bp, Homo sapiens
gaactttgaaactattcaactgatagctctctagtttggttcttgccagacctggtggagtgtcacactatgcataagcatgtgtgggaccagggaacagagcatgaaggggaccagtttgcattttcttcagcatagcttcattcactttgaaattgtatctcagaactttcatctacctccgcattcttgaatgccagtttgtccctccagcttctcaattcagctagatagctacttggaattctgctctatgctctgtagtttggaatgtgcctctggggcaatcctggttctcttgttctctttcttactggggtcaaaggctcttgctgcctgttcaatgtctgaaaaaatgtgtttaatacattttgttcagttttctagttgttaaaagcaagagggcagattcactctttgttcctccctcatgggcagaagttatttattcatttatttacttagagtaatatttttaaatgtatgaaataaaatgtatagaaaaaattgttttgaaataattgtaataacattttcataactacaaaatggttttatatatgtttaatgcattcaataataaaacctagtatgggggcctaataatacctctaattctctttgaagtctttacctgactccagattaggaactgctacct

SEQ ID NO: 124384 - DNA, 114 bp, Homo sapiens
cacagtctcgtcctgtgctggaggcagagtgcacccagggatcttatgcccctattgcaggggtgaggggcccaggacagcatgagccgggagaatggccaagggctagtggca

SEQ ID NO: 124385 - DNA, 347 bp, Homo sapiens
ggacagggtatatggcctcagcagaccccattggggatgtccagaataaattcagggggacaatctgcaggaagttccttcagatcaacactgaaggttaagtgactaggatctggggcaggtctgctccaccgccttttggatgctgcatcgctctgcctcagggccagtcaacggggaactactgatgctcagggcaagacagtttttttctgtggccagtgctgctgtcctggtgcagtacccctgacctctacccactagcagcaccactacccacctcctaggctgtgacaaccaagaacgtttccagatgttgccaaatgtcctctgaggggtcaatggtc

SEQ ID NO: 124386 - DNA, 154 bp, Homo sapiens
ttgcttggctcttggtagtgggaagtgcaggggtttcggctttaggtgtggctagatcgagggctcatgcagtattttcatctcatctctcagttctgtttttctctggggttggcgtcaggcagcctctgcacagccaaagaaacggtccatg

SEQ ID NO: 124387 - DNA, 447 bp, Homo sapiens
tgggtagaaaagaaagaaatctctttgagataagaaattagaatgcaaagggtagatcttaagcaatctgagaattgtacatgtacataaagctgcaccctctcacaagagaaaggttattttatcttctgaaaaagcatagaaatgcatcttttatgggaagataatgatgctaccatttaataagagcctacccttaaaggcagcattgaaactgtattttgtctttagaagacatagactggtgcatcctccgctttagttagacaacagcatgataaggaaaaaactgtcttctaaagccatctttagggactggctgtgctctgtggcatagaaaaggtaaagttgaattagccaaaaatccttagggaaacaactggtaataaggttttcagtggacagattttgtcattactaaataggcagtgaggtgagaagtacaga

SEQ ID NO: 124388 - DNA, 229 bp, Homo sapiens
tttgcacatggcatccttctatctgtaacatcctccctgcgtcttcgctcccctgggcaaagataactcctactaaagcctcagatgtgacctcctacaaaatcccagagttgtccagctgcttgaagtattgagcctttgagctttgggagaagttaaaccattgtgctcctaagacggtaagaagcgtcagaaaaccaggctctgaacctctgctgtcttttttttt

SEQ ID NO: 124389 - DNA, 740 bp, Homo sapiens
aactcctggcctcaagtgatctgcccagcttggcctcccaaaagtgctgggattacaggcgtgaaccactgcgcctgacctgtagaaaggttttaaactataatttcaatgtctttaatagttatagggctattcaagttatccttttcttcttgagtgagctttggtaattggtgtctttcaagaaatatgtccgtttcatctaagttgttgaatttagtgccataatcttgcttatagttttcccttattatccttttaatgtctgtaaaatctgtattgatttcatctctttaattcctaatattgttaagttgtgtcttcattttttttctgtccagtctagctagaagtttgtcaatttcatacaccatcccacaaaagcagctttgggctcactgattttctctattgtttttctgttttctgtttcattgatttcagattttacccttattagtccttctcctctcttctgcttaatttgtatttaattttctcttaattttcttgtttcttaagtagttgaatttattaattcaaggcattttctttttcctaatataggtgttctgtgcggcatctcaccaattctgatgtgggtgtgtgtttttattttcatttagttcaaaagactaatatcccttttcatttctcctttattccatagcttatttagaagtgtgttatttggtctccaaatatttggggatttgtcaagcatctttctgttattaatg

SEQ ID NO: 124390 - DNA, 291 bp, Homo sapiens
ggtatctccctatgttgcccaggctggtctcaaactcctgagcttgagtgatcctcccgcctcagatcactgtttttacatgagtaatatgctttttaaaaataagcctcatacacgtatgcttctagtacaacataggttgtacaataagattatgtcctctcccatagcattggcattaagcgcttaacttctggagtcatgcaaatttttttctttacttagtggctgtgtgaccttggataatttatccatctgtacctgggatgcccctatgggtaatgtagggaa

SEQ ID NO: 124391 - DNA, 325 bp, Homo sapiens
ctctggggtgacccctaagttgtcatctttactcttgatttctgtaatcttttctaagaatttaggtgttacatcacttcaaactcagtatgcctgaaagttccagaatcttgcagtcttcttgtcttctggccttgaatcttggcattattttttagttattcttctttatctgctatttagacttcaactcctatggattattttctctaaaatgtgtttaatacctattctttatttgttattttgactggtacttccacctgagcctatttttatttatttatttttgagacagggtcttgctctgtcactccagctggag

SEQ ID NO: 124392 - DNA, 410 bp, Homo sapiens
acagtcagtgaaggagatatgacacaaatacaaatcattctaggcccagggaatagcaaatgccaagtctctgaggttggagcatgcctgcggtatttacatttgaagaagcttgtcattggagttgagtaaaggactgggtaatataggatgaagtcagaaaggtaatgatggcactggtgatgggctggttgtgctgccaggtcaagcaaggtcttatagaccattttaaggacttcagcttttagactaagtgatacgtggtatagaaagacattggatgagttggaacagaatagtgacatgattggacttttaaagagtcagtctggcaactgttgagagtaggctaaaggagaacaagggcagaagcagtgaaaccacctaggagactgttgcagtaattcagg

SEQ ID NO: 124393 - DNA, 277 bp, Homo sapiens
cttggggcattggaaccatgcctgtggctttgtcctctacctccttgggatcaggcacctgttgtgctaggagagctgaagtgttcccaggctgtggggaaagcactccagcagggccactggcaagactgtcaggccaatcagtggaggctgtgctgtgtgaacacagttgcagaatcagccaggcaagagccttgtagggattgtggacaggaagacatgcagaacagatgtgtccagagagccttgggggaatgggtgcctatggccacatttt

SEQ ID NO: 124394 - DNA, 552 bp, Homo sapiens
gtagctcgcatttccaaacaaagttcttttcaatttctagggaaaacataaaaaaatggagcctcaaaactttccaagagcccagtggaagtgataaaaattcaaagcaaaaagtccaaatgttagtataaaaagattctagaaagcacggggatacttgtaagagtagagttggactctgtgttcccacccatactctaaccaaaaagagtcctaaaaaaaaagaatagcttgacaaagttaaaaagaaatttgagttctctccattacagctgctatgcaaaccaatagacctgcagagtaactgtcttagcaattcagtaactccaaagtttaatatagatggtagttgctttcaacaactgcagatataaattgtgtgtgatggtacacaccaatagtcccagatactcaggaggctgaggcgggaagatcacttgagcccaggagtttcgaggccaacctgggtacctatctcttaaaaaaaaaaaaaaaaaaaaaaaaaaaaaaaaccctgaaaaaaataatttttaaaattcattttccaattaa

SEQ ID NO: 124395 - DNA, 365 bp, Homo sapiens
gttatattttatacttcggaagatacaagaagggatttggaaaacttttgttctgtatttaactttgactaatgaggataaacttcctgatgacataaaacagtaaatacttattgatgatataaaacaataaaaacatgtgattctttaattacagttattggcacagagtagtttaagtgacattagtcattgtcgttgttataaccagtattagtatcgctagtatttgtagtagtagcattgatgcatttatacatcatttcttcaccagtggagtaaattaggcagatacatagatgtcaaataagttataggtctctctcagctttattccaagtgtcacaactctgtgacatacatat

SEQ ID NO: 124396 - DNA, 230 bp, Homo sapiens
cctctctaatgtcaggatatgtttacagccagcatgatttccatatacattcctccttcacttcccactggtaatgaaagcgtacctttcctccctccttgaactaggcaattcttactctgctataaagaaatacttgaggccaggagcactggctcaggcctgtaatcccagcactttgggaggccgaggcaggtggatcacgaggtcaagagatcgagaccatcctg

SEQ ID NO: 124397 - DNA, 389 bp, Homo sapiens
cagcttctagcatcctctgtcacttacttatggatcatgtggattgtctgccccttcctcttcgaatgcaagctccccaggggcaagacttggttggtttttctcactgccacattcctggaatgttcaaggcataccaataggtatgtgttgaatgattgaatgggtgggtgcatgaatgaattaatgaatgaacttgtggcactcaaatacttctgccatttgccagctggggtttgccagggtagcattttttatacgaaaaaaaggagggctgggtgtggtggttcacacctgtaatcccagagctttgagaggctgaagtgggaggatcgcttgaggtcagagttcaagaccagccaaggcaatctagtgagacccccatctct

SEQ ID NO: 124398 - DNA, 480 bp, Homo sapiens
cttagaagctgcctcagaatccaggtccctctaatattgtcttcttcccccaaccccgcttcgtgcccaagcacaagaagggattctctgggattttctgggattttcttatttcaccatgaaatcttatttccaaaatgaacaagattgccttcttcctctccctgaagtccccctgtctctttcagaaaagaagactgaggaatgcaactagaatggatttttcacaagagaatgcctgcttttctggctcattcgaattccaaagacaatcatttacaagttaatttctgtccatttcttctccttaagaatcatttgctgtctctgagaagcattgtccacattccccattctcccctctcccctgtgaaaaaggatataagcttctgtacctcattgggttattgggtaatcattctcctgagaatcacctgtgctatgcatgttaaaataaaattgtgcaagccttctctgcta

SEQ ID NO: 124399 - DNA, 580 bp, Homo sapiens
  misc_feature (357)..(357): n is a, c, g, or t
taggtggtggtagatctggatgtgatgtgttagtctgagtctcaggttaagtccctgggatggatgtgtcgagatgagattgtgtgtatgaagtgactttgggtgtagtagggcatgtctgtgcatcgtggggttatacgcagtgtatagctcagacacttctagcgtgctctcagactaagacgttggtgattatgaaactaagaaaacctagtttttcagagaccagatctttgtatgtctggaaagttatattgtatgatggagacactgtccatgatatttatgtgggacaggcctggtgtgtcatggtgataatgttcagtttgtctcccaaaatatacgtgacatgtccgnataacactatacaactgttgttgattcctgtgttggcttgcccctaagttcagagcccaggcctggcctctgacacttagggcaacgaaaataacacattttccaagcctcaatgttttcactgacatatacacatttacaatcttaaggtgaactcagccataagggaaaataggagcagtgcctttttccttttttgtaaactgtgtcagaaatccaagcg

SEQ ID NO: 124400 - DNA, 867 bp, Homo sapiens
gaaaacaatggctccacgagaccctcaagtgccagagctcatgagtgacagtgggaagttgaactaaccttttaaccaccctagtccacacctgtcaggctgacgggctttcagtggtgatgtgttgggagctctgtgccgcagatctctgtgtgctcctgagactctgcccgcctgtctctaccctgctgtgcccactaggaggaggctgacctttatgttctacaccagtgggtgcccttggtctccagcttccagtgggccagtctggcgagagaccctagctggagatgaggggaggtagccttggcctctctccttgcccttcctcgctgctgctaccccaggattcttgcccatcccttactggttttccttaaccccaccctcacccttgaaaacagactctttaaaactctcctcactcaccctcattgagtgtgtcatctgctccagctaggatattggctaataccgcatgtttcagaaagaaaaattcgcagttctatttatttttttactgtggattgaagggagaggcaaccaggtatatggatgaaggagtagggcctggctgtcaccactggtgttcacaaaaggctcccgtttaagtcctcttatattccaaatgaggggttataggtcgagtcagggcgttgctctaacagaagcaaaaccaaaaatacacggccgtagatacaaccctgttctggtacttcctaattttgtgtgtacatgtgtgcacctggagcttcaagaaatgaaaatggaaatggcctgagtgtttctcagccctaggatgaggctgtttctgtgatttagggctggaggttatgaagacttggtttacaatatgcacagtacaga

SEQ ID NO: 124401 - DNA, 205 bp, Homo sapiens
tgctgggattacacgtgtgagccaccgtgcccggccgcgttatcttaagctttacagcaaccctaggaaggaggttattattatattcactttacaaatgaagtgactgaggcacagagaaattaagttactatttcaaggtcatatagtaagtggcagagattaacttgaactcagatatgtccaactctaagctgttacatta

SEQ ID NO: 124402 - DNA, 435 bp, Homo sapiens
attttcagatttatccatgttgtatatatcagtagtttgttccttttattgctaagtagtattccattatatagatataccacaagtattttataaccatatgctattattttgcttgagcaaatgtctggaagtggaatggctaagtcatgtgataggtgtatgttcaactttttgaaaactgccaaactgttttccaaactggttgtgccattgtacatcctacaagtagtgcataaactatcctgttaactccatatccttgttaacacttcgtgtggtcactttctaattttagccattctaatagtttgcagtgttactttgtggttttgatttacatttaattaataatgatgttgagcattgtttcatgtgcttatttgtcatccgtatatattctttggtgcagtatatattcaactctttttatcc

SEQ ID NO: 124403 - DNA, 788 bp, Homo sapiens
atccccaggattctaaacccctggaaagagttttaggcacaagattaagaggtggatggaactggaggtcatatcttaaatgaaacaagccaagcaaagaaagtcaaatatcacatattctcactcctaagtagggactaaaaaatgtgtacacatggatgtagagaatggaatgattgacagcaatatagacacacagatgacccaacatggaaaataatatattgtaaaagtcattcagttgtggggaaatgtgcagagaggattctatttggacttgttataaataagcaagattgtatcaacaatctagagagcctctgaagtgtaactaccctttcagcatttcagaagaccatacactattcccgttgatgagactatacaggatgaacaaaacagaaaaaaattgtgtcctcatggagcagactgcataaattttattcagaaaagatatgctacagaaggtgacagtgttggagtggagtgactgaaattatacatgtagccacagggataaattgatttttgaataaaattctgaatgagaagttatatgaagcaggcctggcacggtggctcatgcctgtaatcccagcactttgggaggctgaggaggacgcatcacctgaagtcaggaatttgagaccagcctgaccaacatggagaaaccccatctcaactaaaaatacaaaattagcctggtgtggtggcgcatccctgtaatcccagctactcacgaggctgagccaggagaatcacttgaacccaggacacggcagttttgg

SEQ ID NO: 124404 - DNA, 242 bp, Homo sapiens
tatttaatgtaactttgctttctttaaaccataaccactatttctctgcatctagtgccttcctcacgctctttgatgtttgcctccctttcagtcacatttcagaacacttcctaatgagagtcattttctaattggagcacttgatatctcgaagtactaaggcagagattcttcccatgtcttcagccactttccagacttctaggttagaaaggtggtgcgtgtagcactgggaacag

SEQ ID NO: 124405 - DNA, 335 bp, Homo sapiens
agaaaatccatgagataatagaaatactatttctattcccatttacaatttggtaaactgaaagaaacaaggatatgaagttacctgcccaaagtaggatgcttataatggttccaaaaatagtgctacatattggagatataaccatggtaagtggggtccagtaaaggaggtgaccagggatcctgccctaactgagttccaccacatgcagggacacagatgagtaaacaggcaactgcaacacagtgtgggaagagccaaggtagggttctgtgtaatatgcaagcatggggaggcagccttttactatcccttgtgatcttgaaatgatt

SEQ ID NO: 124406 - DNA, 465 bp, Homo sapiens
tctcttcaaaatgagttatagtccaggattgcgagactgcaggtcaagcccccagtgcagcagtgctgactgaggcagctgcgctgccagtcctgccttgtctttcaactgccgtcagatgaaacagcgagtaaacagctcatcagatgctccactcttcatagaatgcaacttctaagaatactccaggtgacagaaatcccgcttccacactgcagcctccctccaggccagttctggaacacctcaagaaagcatgaacctgagcgtactactgcgcaggactggcttccctatgaaatcctcaacactccgcaaccccacagctatcaactttgtcctgcggtggctgtcaaagcaccccaccacatctgaatctaatctctttaggaaaacaaagcaaaaggccctgcaccaacatatttgaaccatgtttgtagaatgagttgctaggttccatccccc

SEQ ID NO: 124407 - DNA, 340 bp, Homo sapiens
tcagactcttagatcctggttcaaagaacatcccccagcctccttccagctgagctatttttatgtgaaaaaaaaaaatacctgcctggaagccatgccaaccttgagcacactggaaaaatgggtgccaagcctgacccaaaggcagaaccacgcttggcagccatctcactctgcaaaacaggcaggaccctacaccaaccccagctccaggatctcaggggcaccctgatcccaaaaggaagctggagggaagcagtcaagtccagcacctacaaatagccagtcttaacttagtgcccggcgctgcttggtagaggtccatcagtcctgtctgctg

SEQ ID NO: 124408 - DNA, 247 bp, Homo sapiens
taattttagttaccataggtcttttgcatttccatatgtgtttcagaattttgttcctccaataattgactcctgggattttgatgaggattgcattgaatctacagatcaatatgtgatgaattcacagtttaatattgagtcttctgatccacatcctgtattattctatttatttaggacttttacattttttcttataaatgctttatagtttttagcatgcagttctaacaaatcttttctt

SEQ ID NO: 124409 - DNA, 131 bp, Homo sapiens
ggatttggcagtgatatgagatgtgccaagaaatagattttatgattgatcaaaaacagattctcatatttgtctctccgttgaggaattccccatgtataggagcatgttaaaacatctgaagactcagt

SEQ ID NO: 124410 - DNA, 266 bp, Homo sapiens
caggctgccctcttacagggatgcctccccatcctactcgggctaacatctcgtcaggccacctccatgtgtgcatggtctgatggggctcttgactccctataccaggctgtgcccccacccccatcctgctaatgtttgggcagtagaagggatctcagttttgtttttgttgtcgttgctgttttttgaaacggattcttgctctgtcacccaggcttgagtgcagtggctcaatctcggctcactgcaacctccgcctcctg

SEQ ID NO: 124411 - DNA, 361 bp, Homo sapiens
tgcagtgagccgagatcacaccactgcactccagcctggtgatagagcgagactctatctcaaaaatacaaacaaacaaaaaatgatgcaatggaaagctaagtagccattaaaaataataagatgaatatttgatgaaccaaaggatgctatgagttattgtcaggtatccaaaagttacaaattagtgaatgcagcaattctataaaaatacacctactggccaggtgcagtggctcatgcctgtaattccagcactttgggaggccaagacgggtggatcacctgaggccaggagtttgaggtcagcctggccaacatggtgaaaacaagtctctactgaaaatacaaaaattgtcca

SEQ ID NO: 124412 - DNA, 739 bp, Homo sapiens
gattgctgtggtgtgggagcagaggggggaaaaaagctgttggagagttttttccaaaacaataggagattatttagatttataaaaatagaatcaaagtagattaactgagcacattgtgaaatatagagtagagctgtgtgtaaggagtatatcttaatgtcaagctgacaccaaattgaatgtttgctggaacgttcaaaaatctaagcttcccaaatctgtgaaaacactcaggttagtaaacagtcttatgcaaacagcaagacaatgctcaaagccatttaaggaaaaagaacagtaactgaattctcttatggaaatgtgagatgttgttttagtaagtactgatggtgttatactttttgtttattcgtttgctggtatttcagttcctaaaattccttcaaatatgctgcaaaatacaaaccaagaacttggtggattttccatttgttttcctgtgggaaatgatggaattaaaaaccttgaggattagaccttgagagttaccttccagtgtttatgccaccattatacaaaattctggaggacaaaacccttcccacttaaaaaccagttagtttcagaaaatcacctcatgttaggagactgcatcattatagtatgtgtgttagctttaggtatagatctaaaatatttttaatattttaaaaacttaagcctttcttcattaatttggcctaatacaagttagaataactttaaaaatgagtac

SEQ ID NO: 124413 - DNA, 113 bp, Homo sapiens
ttcccacagagtactgttcataccactggtaaagcaagaatacaacctccttaataaggctgtgttattgggtgtcaggccacctgggtttgatgccctgaaccactcacctg

SEQ ID NO: 124414 - DNA, 602 bp, Homo sapiens
tcacgaagtcaggagatcaagaccatcctggctaatgcggtgaaacccatctctactaaaaatacaaaaaattagccaggcgtggtggcgggcgcctgtagtcccagctacttgggaggctgaggcaggagaatcgcttgaacccaggaggcagaggttgcagtgagccgagattgcgccactgcactccagcctgggtgacagagtgagaccctgtctcaaaaaataaataaataaataaaataaaagtaactcagaagggagattgtttttaaagtaggagatcctgaattctgtatttaaatactgatatgacaggagcttgaacctgggaggcagagcttgcagtgagccaagatcgctccactgcactccagcctgggtgacagagcgagactccacctcaaaaaaaaaaaaaaggattagaattaatggatagatacgacagggagtcctactttaaattgaagagaaggcttttctaaggtagtaagagacttttatgaaataaaggcagccagccatgcaaaaatctgggggataactattctgagcaggaaaacaaactggaatgacccagagaacgtaaagtgtttgcacaa

SEQ ID NO: 124415 - DNA, 357 bp, Homo sapiens
gaaagcttctctttatgctcttgcttgagccataaaacttgatacctggggccaaatgcctttatccccaagaagggtgaagaagatgaaaaggcagcagctctaggcggaagccacacaaatgactgggcagaaaatgcgggcggtggagaaagttacattgcacgattcatgcctctttgaccttatattctactctgaaattaatgttactgtttgcataggatcactggcctttcgaaacctgaattagccattcagaaaacactaggtttaaccaataccatcaatttgattgttgttgttatacttatttatttttgaggcggggtcttgctctgttgcccaggctgaagt

SEQ ID NO: 124416 - DNA, 771 bp, Homo sapiens
gaggttttcctgctccattctcagcacaaggagccttagggcttagagattttcaactggatgaaaatgcagatgcttgtgtttgtttattctaaagcttttttttgcaccttcatttctaattcttcattgataagttgcccacatactgcatttaaaattaatttctttttttgtgtttttgagacagagtttctccctccagcctgggcaacaagagtgaaactccttcttaaaaaaaaaaagaaaagaaaagacttagaataaatttgactttgtaatatgaaaaaaatttgcatgatgtaaataatgacaaaatacaaatatttgcaactcataggtaaagaggtgtaataataaagaacttctaggaattgaaaagaaaaaagttcaaggcccaatgaaaaatatgcgaaagatagcataattcattgaaaaggaaatataacccttcaatatgtgaaagaattaacaatatttatttgatttttaagggtcttactatgtcagccaggctggagtgcagtggtgcgatctcagctcactacagccttgacctcccgggctcaagcagtcctcccaactcagcctcctgagtagctgggagtataggcacacaccaccatgcttagctaatgtttaaattttttgtagaaacctatgttgtccaggctggtcttgaactcctggcctcaagcaatcctcccacctcagcctctcaaattgctgggattataggtgtgaggccctgcacctggtgaacactttatt

SEQ ID NO: 124417 - DNA, 282 bp, Homo sapiens
tattacatattgttttaagcccctttctgatagagacctagaccagaagggggcttaaaacaatatggaagaagtaattttttgttgttgttgttctgtgggttttttgggttgttgttagtctctctctatagtgaaaggcagagaacaagaatactttgtagatttgtctcacatttggtagaaggcagaaactctatgttatgtaaagttagtagaatacaagtgaggtaggcttaagtaaggtaaggcacataataattgctgagatggggaaatgac

SEQ ID NO: 124418 - DNA, 215 bp, Homo sapiens
gactcccaccttcagagtaagcagtaggtctgatagggcctaaaaatttaaaatttctaataagttcccagatgatgtgaatgatgctggtccatagaccatactttgggaatcattcattaaacttattgttttttgttttgagatgcagttgcactctgttgcctacgctggagtccagtggcacaatctcagctcactgtaacctccacata

SEQ ID NO: 124419 - DNA, 615 bp, Homo sapiens
aatcagctcatttaaccgttgaggttggaaagcgtgttactgtcccatttttacaaatgagaaagcaaaggtccagggcctttaagtaacttgccaaagatcacgccgtcaggaagcgacagaccccagatccaatagcagcacgaagcctgagccactgaatgaatggtggaaattacggttccatcttggcccaaacgtgggatgtccccagctggaccccggcccctgtgagatcccgggctcaacccccagcctcctgggactgttttcccctttaaacagtcatgggtgcctcaaacagactttgggtcagagcctgatgacttcctgggatggacaggggcccatggagatgggtgcctaggagccctgaagcaaagctctgcaacccatcccccttcaccagagtgagtagcaggaaccgggaggcaggggtgaggaactcagagtttcggttaaggccaattcaggcagcactcactggaagcagctcagagcaccaagagggcaggagcaaaagacccttgtcctggctcgtcacctccctcctcctcctcaccttccacttgccctctccttaccaccggcttctgaagactcaaagagccgact

SEQ ID NO: 124420 - DNA, 240 bp, Homo sapiens
ctgcctcagcctcctgagtagttgggacaacaggcatgcactaccatgcctggctaattttttactttttgtagagacagggttttgccatgttgcccaagctggtctcaaactcctgggctcaagagatccacccacctaggcctcccaaagtgctgcgtctacaggcgcaagccactgcactgagcccaggttacttcttaaaacgtggccaggtgcggcagctcacacccataatcc

SEQ ID NO: 124421 - DNA, 703 bp, Homo sapiens
ggggttgtcagcatttcggattttggccctcctgataggcgtgtggtggtatctcattgttgttttaatttgaaattcccaaatgctatattatgttggacgtctttacatatgcttgcttaccaaccatattttttctttggtgagttgtctgttcagactttttgctcattcttaaaggtgatttatattcttattgttgagttttaattagtttttgtatattctagataatagttctctatcagacatttcttttacaaatactttctcacagtctgtggcttattgtctgattctcttggcattatctttcacagagcagaagttttaaattttaatgaagcccagcttatcaattatttctttcatgggttgtgcctttgatgttgtatctaaaagatcatcaccataccctacgtcatttatttttttccatgttatcttctaggggttttataactttgtgttttacatttaggtctatgattgattttgagttaatttttgtaaagggtgtaaagtctgtctagattttttattattattattttgcaaaaggatgtcctgttgttccagcactattttttgaaaagtctgtgctttctccattgacttaccttcattcctttgtcaaagatcagttgactatatcctgtggccctgtttctgggctcactagtttgttctgttaatctctttg

SEQ ID NO: 124422 - DNA, 234 bp, Homo sapiens
attttgaagtttgttggctttcttggacctgtgggtgacatggtttggcgatgtccccacccaaatctagtttctctgaggggaatctgcatgactcaggcatgtcctgaccaaagaccgccaaccttatcctggagttcctctttgatttatcgggcagtggtcatggctcttccctacatgttgaagtttcggggatactctcctctgagtccgaccctccagaggcagctg

SEQ ID NO: 124423 - DNA, 807 bp, Homo sapiens
aggcaaactgcccaacagctctaagctatttccttcgtattctgaaaaataagccttaatgggacccatatagggcaactctgagagtaaaataaaggaatatgtgttagagtgtagcatagtcacccacgggaagggcttagatgttagctgctactgctcttattagctgaatgatttggaataaactgttagcctctctcatgttttttctcttgagcttcgaagttttcttgttaatactaaggagatattcaaactagtcatggggttttggaatgacgaagggagatgatgaatctaaagaatttagtgtaatatttcttcatgctcagtaaatggtagtttctgctgctgttatttttattaccatctctttggaatgggagtaggtgctcctttgtggtcagaggctgtgagagctccacagcgccagtttgcccatctgtacactggggtctgttgaaggcagtcccctctgtgatatctctggctgtcagagctcagatgatagatggtatttttgtactcttagttctcatcattttcatgatttcgatcaccatttgagtatgatgatgctaacactttgttgaacgtagaatccgttaattacttccttcctgaacctttggcattaaaaaaaatctattctgctacctctctgctcatttatggttattcaaatttattatcaagagcctggtacagtggcttgtgcctataattgtagctacttgggaggctgaggtaggaggattgcttgaggccaggagtttgagaccagcctgggcaagatagtgagac

SEQ ID NO: 124424 - DNA, 132 bp, Homo sapiens
ggaggtctacagtgacctgtgcagcagcaaatttggcagcagaaagcagaggactccaggcactgctcatgcctacaggctgctgggtgaacaccctcgccaaagaaggagactgcagaaatcctccttgat

SEQ ID NO: 124425 - DNA, 448 bp, Homo sapiens
ctccatctcgccctcccataagttcaccttccagatcattctatgtttacccacatatgccaggaccagctcacagcacaggcccaacatgggacacacctccccccaacacatccacattctcccgaagcccaactcaagcgcacgtcctggaagcagaggcatccctggccatgtcacagtttcttccacaaacctttggatctatcttttgtattttaagtcttggatttcccataagagatgtcaaccatactccctccataccttccagattcacaggcaagagaagccactaggcttcctgcaaagaaatttctcaagatctgagtagggaccaggctctgtcttaaatttctccaagtgagatccacatgcgtggcccttgcacgtactgctatcatctcaaaggccacctggagtgaccagcaaggactgtattcatggg

SEQ ID NO: 124426 - DNA, 407 bp, Homo sapiens
ggccgtggactcaagggaggagagcaaggcccgtagtggctgtccatcttgactgaacaccagccccaacccatgaggagatacctggtttgcatcttcacgcttcttaggaaacagtgatgttaatttggaacacatgtctttgtgtggaatgaagaactgtaatttcacattgaagccccagtcccttccctctcccattcctgcagttcacggaggtgatgtcaccccatgcgtggtggagacttaggccttccttctttctctttctttcgaaagaaagagaaagaaggaaggacagattaaatctccaaagtaggagaacctattatatagcaaacaaacttgtataattaatctctaggagcacgggttctaataagcccaggtaccacaaagatagagaa

SEQ ID NO: 124427 - DNA, 286 bp, Homo sapiens
gtcaagggaacattcaaagtcagccagaattcattagatgccagaggagaaacagctacagatttctaaacaggcatctccaacccaggccagaaagagccgagcacagcctagagctgctggagactcaaagagaaaccattcttctatccctttcagcgggcgcatcttgccgaacttctggacccagctcctgccgtaagcgtgactactcccacgtgtacataatccctgtggaattacaaaaattaggctaaagagaaaaaaaaaaaacctggttgtgggt

SEQ ID NO: 124428 - DNA, 538 bp, Homo sapiens
gaaggttgaattacagccaggttgtatggaaatacaggctgagtgtcttaccttaggtatccaaaagcctgtaatctactcaaaagaaacattagtgagttggaattcaaataatccttttctattgttattttttgttacacacaaggcacatctgaaagcacaagagctcagtgttctagttgtgttataataatgaggtcacaagtcctgtactacgatgaggtaggagtgtgtgaaataccatggtggttaaaagcatgggctttagggtggagccaagatgctgaatacgaacagctccagtctacagctgccagcgtgagcgacgcagaagacaggtgatttttacatttcccactgaggtaccaggttcatctcactggggagtgtcagaaagtgggtgcaggacagtgggcgcagcgcaccgagcgtgagccaaagcagggcgaggcatcacctcacccgggaagcgcaaggggtcagggaataccctttcctagtcaaagaaagggggtgacagacagcacctggaaaa

SEQ ID NO: 124429 - DNA, 390 bp, Homo sapiens
cacagtcacaggtacgacaccagcccaggtgtgctctgctgcctacatgcaggggtgagtgcaagtggagaggtgtggttcacctgtggggtattggaggaaggagcgcaggaggtatgagtgtagacaagcagggatttgagagggagcctgatgtcccagaaggtaagaagtggggaagcaccgtaggctcagtaggctcagcagatggggcggccagtgaggtcaaccagtcaggaaaccagagggtgggcggcagaaactgggttgtataacagagaaaggtggggtcaaggggacaggtggcgctgaggccccggagggctgcatcggtgggcaatgtgaggtccatggctaggatgagagcccgggaggctctgtctgcctgcg

SEQ ID NO: 124430 - DNA, 608 bp, Homo sapiens
tcgtggttagatctagaggatcccgacgctctctctgttggggagggactagggcaaacaggtcaacatctcagagggaagggaggacatggaacgctgtctgacctgcccgcagccaggggaggtgggatccagaatggcaggctatactgggtggaggaatgccacacacatagccttggaggcccaaacggggcagtgtgcttgggaagttaggcccagtttgatagagctgcatggagcgcagggcaagtggcaggggatgagactggaaaagtggatgaaataggatttatgtaacataagaaagtgtaattggctcaaatgtctgattacttatgtgttatttttgtaaagctggtgacccaaccctacattggttttgtataatttaacatctgtgcactttgaagtgacatacattgaagaaccttcagagtgtcagaaaccatgacctggaaagcacatctatcctaatttgggggtggtcttgatctctatgaagtatccaaactgatactgattggactcatttgaggatatcaagtaacatcagacttcactgagaggtgtgccaccgctgtaaccaagggactgctactactttc

SEQ ID NO: 124431 - DNA, 263 bp, Homo sapiens
aaatagcatcctacctgaatgcctagtgctgactggaaaatatggagggagtgttggcattggaaattacagctttgtaactattagggtaaaaactagtctaggcaagaatcattaatggatgcacagtcttaaattgtctcctcagagatggtcttagaaacgaaaaaaatagtaactgtacaaggcagaaatcaggcactaccaaatgtgatatccctcacacaacccccaaataaaacattcagctaccaaaaaggagg

SEQ ID NO: 124432 - DNA, 320 bp, Homo sapiens
acaaaatctacctcttttcagagcagccagcacactgttcacacccaaaacaaatgttctgtttcctggtgagtgtgtcgtcactgaaatgctcagtgactctgcaaggcccacctcacactcattggttatacaaggaattaaaggatgctcacagccaagtctcctccccagaactggtgcaagcacctgggaagggcccagttctgtcaaggtgccatgcatgatggactcccagagacactgggatgaatctaaccaggctggagactgagggctcccaggagagagccaacatccacatcgtctcctaaggttca

SEQ ID NO: 124433 - DNA, 426 bp, Homo sapiens
tgctctgtgtctgtttattcaacaaatatttatcttaactgactctaatcacattgtctcctgtttgtcctgcagtgaagcccttttacatctgcttatctcttttgatccaagggaaggagacttaaccctgacttccagagaaggaaatagtctcagaaaggttaagtcatttatctgaagttgcccttttaatactgagtactggactctctcagtatccgcgtactctgctgccccctaccgtgaacatagcaataggttttaaatcacaaaaacacacagcagaacactacacaacactggaaagactacgacactataaatagtgcttacatttgttcatttagcaaatattcagctggacgtggtggctcacgcctgtaatcccagcactttgggaggccgaggcaggtggatcacttg

SEQ ID NO: 124434 - DNA, 242 bp, Homo sapiens
aaacagatctcatgtttgttaccatcctttattatttttcttctaaacatgtaatctaacattacatagtcatgaacagcaaattatattatctactcatacttgcggaggtaaaaggtgagggaaattcatgtgtttagacttgggtctttactgagttgtctcctgtcctaaggatgatgattgctaaggaatcggattctaaaatgtattttgatatactgtccatgttcagatcggtt

SEQ ID NO: 124435 - DNA, 193 bp, Homo sapiens
gctgggataacaggcgtgagccatcatgcccagccttaaaaatcctattcttagtaaacatttaggagcaaatgtaacaggagtataatttaccttgaccaagtataattactcttaacccaagagtactgctcctgctttttacgcaaagacaatctcacataggtcgataaggggacaatttgaggctagt

SEQ ID NO: 124436 - DNA, 264 bp, Homo sapiens
gaaaaaaagtatagcttgacagctgtagttttcaagaaaagtagaaaagagcatatttttctggaaatgaagatttttttttttgagacggagtctcactctgttgcccaggctggagtgcagtggcgctgtctcggctcctgcaacctctgcctcccaggttcaagcgattctcctgtctcagcctcccgagtagctgggattagaggcgcccgccaccaggcccagctaatttttgtatttttagtggagacggggttttac

SEQ ID NO: 124437 - DNA, 344 bp, Homo sapiens
attgagtatgattttttttttcctaactgcatatatcttatcatagtacttttgagtaccactagtaacagtgttaggagcattaggggatgccctgcacttccctttagcatgggatacatcaaggccttggagcccttttagcacctttggcaaattagaacaagacaccccttcctcagggctgtcatagcccttaccactgcacctgcagctaagagtttttgtgttagtcacaatgcacacaattgcacatggcaggccagcatcaaattctgttaccatactcaacttagtgtctttttccccactagaacaagcaaattctatcaagccaaagattg

SEQ ID NO: 124438 - DNA, 811 bp, Homo sapiens
ggatgtgggaatgttaggaaagccaggctgtgcatgcttggacaaactgtaagccaggacctctcaaacactagcccatgaggtggtgcccatgtgcttggatctgggcatggggatggggagtgggatgggtgaaggtggcactgattgatttaagtggggcccaggcaatgacattagtattgtttccaaaggtcttcactatactctctaaatgactttattcttgcccagagcttcaattacctgccaatgattcacaaattaaattctccagttctcttctgagatcaaactcataaacacaactgcctacacagtgtctcaagacttctcaaactcaacgtatcaaagtgaactgatttttcccttccccaaactgctcctcgcccccagggttccttgtctcaaggaatggtaacattgagccaggtgcacgagtactcatctctgatactttcctctcctttaccaccaccatctcaaatttcctgtgaatttttatctcctaaatctctggaatccagccatttcaggctaactccactgcttccatgggaatccaagcccccattatctctcacctggaccactcatctccatgtatcctcacatgctttattattataattctgttccacacactgaggcaagaatgaccatttcaaaaccaaaactaagccactcctggctgggcacggtggctcatgcctgtaatcccaacactttgggaggcagaggtgggaggattgctggagcccgtgagttaaagaccagcctgggtaacatagcaagaccccttctttagaaa

SEQ ID NO: 124439 - DNA, 222 bp, Homo sapiens
gaggccctggaggattcgccacttaaggctgaagtcgtagcaagtgctgccacgttggggaagatagcggcagagataaccactactggggaagtgtaaatggaaatttcaaatttagattaagcctgagtggcgtgaaaacaaacccagcatgttcaggtgcagtgtccagatgttttcaaaatgccctgattgtgagagctgagaagggagatgtggaaa

SEQ ID NO: 124440 - DNA, 295 bp, Homo sapiens
ggccaactgatggttaacaatggtacagccaagctaaacaagtacagctgggaccaatggcaaaaccttgtctctataaaaaatgaaaaacaaaaagaaggtggtgtagcttattcgacagttccatttttacggtcacagaaagatccagttgggttaggcagcttgactgtgtatatgggtgagaaggtaagactctcttcaggaaagagcttgtatggaagaattcattcctccttgtgggggcaaggagatggggagagctcactgtagtaagaggattgcatatattata

SEQ ID NO: 124441 - DNA, 438 bp, Homo sapiens
gtggtgggctgtggctcccgggttgctaagctggttccttttcctcatttataaaagggtgaggaaattccttataggggtatcttgggcattgcttgggagagtaaaggttaaaggcttcgaaaagcttctgagttctcatgtgcccagcctctgctgatttctttgggagtgtagtctggtgagtcagagcccctgcctgtagggagcctgctggctggcagaggatgcaactgggctaggtgccaggacacgcacacatgtgccggcagcacaggttagatgccacggcctcagtggaggaacccactgtccccatcaaagagaacaggggatcaggaggagccaccatctgacatgggccctggcgggggatggtgggattgtgccaaataaagacagaggagagcctatatcaggtgtaaggatagtggagca

SEQ ID NO: 124442 - DNA, 646 bp, Homo sapiens
taggtcaagttgaggaatttatagtttcctacacaatttttcctttatttaagttgtcaatgtaaaaaattttattatgaaaaagttcaaacatacacaaaagtagtttaatgaacccccatatctcattaccttgtttctgcaattagattttgtcatatatcctttatctgagctttttatttttcttgtgctgaagtatctttaaataaatcttgagattttactcctttatattttggtatgcatctctaaaaataataacattttctttcataatcacatatcattatcacatctaacaaaattagaaatatttcctaggtataatctaatgcacagcatattaacatttctccggaagtctcaaaaatggctgttggcaatgtgttaaaatcagaatccaaataaaattcacacatttggttgttgtgtctcctgtctcttttaatctagagcaatcctgtctttcttttttctcccatccaattatacggcagaaattgaaccatttgtcctgtagaatctttcacattctggtatgtccttttgtttccttttggtgtcatttaccttgttctctgtccctcatatttactataattaaagttagctctaaagtcttaaatagattcagattctcctt

SEQ ID NO: 124443 - DNA, 282 bp, Homo sapiens
cataaatgggaaaaccgacaccccctgagaaaggagccctctgaggtcacacaacaaagcttggatttgtccctgaatcttctaactttccacaacaccagctctgtgagccccctaagttccattgtttcagcagtccagaggacctcccagcaaaaaagatcagggtctcaaatgtcaattgccactctctagagcttctgctaacacaattctggagaggagctctgaggggaggagcacagggcacaccttgacacagccactgacaagtagagactt

SEQ ID NO: 124444 - DNA, 807 bp, Homo sapiens
ggatctctttcttcatagtgtttctacatggtctctccagcatggtagcttcctactagctagacttcttacatggtagctcaggactcctgaggtgcatgttcccagagagagaggcaagtgaaagctgtgttaccataagatcacttccaccatacttcaatagttgaagcaactacaaaggcccactcataaggcaaggttatgtaaactccagttcttaatgggggagtggcagtattctggaaagtctgtgtgactagaaataatgctgtagcagtttttggaaaatacaatctgtgctctctgtgtgttgtcatatatccagaatgttttgaaacatgaaaataaaaaactaaaatgctgggtaaatatcaatagaggtcagcaaatctttgcaaggtttgtaatgtcactttataattcatttaccttatatttgcattggattgttatatgtcattggatggtcataacatctgctgaccaatgaaagactgaaagtaaaattttaatgctaataggaaagaattaattaaggaaggctatgagagggaagattcattttataggtggttaatacattaatatttttatgtcacaatgattttttttctttatgcattgtcatgactgcagttacttggataaataatatttggagaaagaggatttcctaatttttatatatggatagatcagatctataaagtaaatgcagaattcagaatcaagaaaagatttcccagtgacaaggtgaaacaagtaacagctgggaatactgtcaaagtaaatctgaaaaaaaaa

SEQ ID NO: 124445 - DNA, 602 bp, Homo sapiens
tgattacaggcgtgagccactgcaccgtctttttttgtaatttcaataaagacgaggtttcaccatgttggccaggatggtctcaaactcttggcctcaagtgatcgacccaccttgggctcccaaagtgctgggattacgggcgtgagccaccgtgcctgactgtgatcatttacttaaatatttgactttaggtaatgaagaattaaagtggatgaaaatattgcaatgctatcaggatttattgagaattgctaaagctgagtggctagactcttagttctaaagaaacctaatagtgacttggtatatttttaactgaaatgtaagcttgaaaatagcacattaaagtcaaattatgtggcttaagacatcctctcaacagcaacacaaattctagttcctgtctttccattctctttcctgtttgtctgaaaacctcaaatacctcttgttctaattctacgctattcctttaattcctctttgatacattcttgcttaattttatattctaatgtgcttttccctctcagacacgataaccaactattcaagatgccatctaatgcactatgccattaagtattgtggtcagtgat

SEQ ID NO: 124446 - DNA, 151 bp, Homo sapiens
accaggcactcatttattacaactcacattttcagaagtagcaaataacctaactgttaggaatctggaatacaacacgcaatgggagccaatgaagaacacggccggagctccgccctgaagtgcacgccctgagaacagggcttcagtg

SEQ ID NO: 124447 - DNA, 494 bp, Homo sapiens
cagtgagtaggacatgtcggttccaggatacattcagtggttttctggtctgaatctttaagtagttaaatagcacacaaaaggatatatgcttcccttttccccttgtgtctgacgttctcataatattaaaatgtcactaaattattgatagtaatagaaatacatatttcttaataataagaaagaggatagaaaggattggtcctcctctttgaagataaaacttaactatattaacatgctaatagcttacccatgaaactgttttaacaaacaaaagacaagtggacaaaggtcactgaatgcattaatgacctagaataacagtagaacaaagtacaaagccacccctcacatgagctccatctttgtccatgcccaaatattaggacatttgaagagaaaatgctattttgggaatatatttatgttaataaaagtactcccactgaagcaaaaaggacaataaaaataactgatataagaaagta

SEQ ID NO: 124448 - DNA, 347 bp, Homo sapiens
tcctgggttcaagctatcctctcacctcagctgcccaaatagctgggactacaggcgcacaccaccacgccaggctaattttttatattttgtaggaatggggtctcaccgtgttgtccaggctggtcttgaattcctgggctcaagcaatcctcccgtctcagcctctcaaagtgctaggactacaggcgttgccactatctctggccaattcctcttaaatcagtgaagtaggactccttagccccattttacagacgacgagcatggtgctcaaggaggtcaggtgagttgccaaggctacgtagctaggaagtgtctgtccccaaacattgcttgttccgctg

SEQ ID NO: 124449 - DNA, 341 bp, Homo sapiens
tagcgtcgtagttcaatgtatgtcccacaaggtggcgcccacacttaggaagcttctccgggctgaaggaaaagctctctgtgccctctgtgcagccacaagtggaggctctacccagaagcagcggctttacacctaatactcctgtgactgacccacatccgaatacccagggagattaggtggttcatcacctgagagctttgtttttacttcagacagctgcttaaggttctaatgggttcctgtcactaaaagtgcaaggagattaatgtgtctaggttgtcaaaatcaacttgatagacatttcttcatagctaatatttcctttcttatctgtt

SEQ ID NO: 124450 - DNA, 336 bp, Homo sapiens
gttttagttgcctcccttctgttcttatgctgttaattaataatggaaccagtggccaggcatgatggctcatccctgtaatcccaggactttggaggctgaggcaggagtatcgcttgagcccaggagtttgagacaagcctggacagcatagtgagaccctgtctctacaaaaataaaaaaaaaattagccaggcatggtggtgggcacctataatttcagctacttgggaggccgaggtgggaggatcattggagcccacaaggttgaggctgcagtgagatgtgattgtgcctctgcactgcagctcgggtgacaaagccagactctgtctc

SEQ ID NO: 124451 - DNA, 530 bp, Homo sapiens
ttgagattatcagctagaaacacagtaccaaataaaagcacctcagcctggactaagccatcaagaaggcattaaaaacctcttcctaaaacaaaaatgagacaccgctatataactattagaatggttaaaatccaaaacactgataacacccagtcctggaaaggatgcaaagcagaaggagctcttgttcattgcagctgggaatgcaaaatgctacagacactctggaagaaagtttggcagtttcttacaaagctaaacatagtcttatatacaatccagcagtcatactcctagatatttacccaactgatttaaaaatgtatgtccccacaaaaacatgcacacaaatgtttatagcagctttattcctaatcgccgaaaaccaaatgtctttcagtgggtgaacagatatggtacatccgtacgatggaataatattcagtgattaaaagagaagtgagccatcaagccacacagaggcatggatgaatcctagatgcagactcctaggtgaaagaatccag

SEQ ID NO: 124452 - DNA, 247 bp, Homo sapiens
ggcacagcctcaacagccacaggccggcaatcaaagtcaccactcagtcaaggtccccaggagcaggggagactggaccccatctccttccaactgctacagcccaggaggacttggaggtaaggtgagggcatccaggctgggggctctgagtctcagcagccactcctgcctcacgctgggtgcccccatcaattctgtttgaacatcacccagagtgattttgtctgaagaaacagggctgcca

SEQ ID NO: 124453 - DNA, 265 bp, Homo sapiens
gttgccctcttggaagtcgccgccagctctgccaggctcgacatcacctgtccacgtcctgattctcccatctctccctctccttctggcatcatcctgagaggcttcacagaccctaaggactaaattgaccctaaggactaaatcccgtaacctattgagttttgctttattttctatcaatagactatcgccatgaccataaactcaaccatccttctaatcctcctaagactgttcttctacctcgccctctctccacttc

SEQ ID NO: 124454 - DNA, 286 bp, Homo sapiens
tatatgaagacttcataatatagcattttgactttagcctattttttctttttgttaaatctgtacaaatttgtggggtacactgaaatttggctacaagtatataatgtatagtgttaccaagtcattatcttgggtgtccatcacccaggtgcaatacatttttgttaagtatagtcaccctactctgctgtcaaacattgaatttattccttctatcttactttatgtttgtaccttttaacccacttcttttcatcctcgcctgcccccctacacacttacc

SEQ ID NO: 124455 - DNA, 549 bp, Homo sapiens
tactaaactggttaaaactcttcagacttattaacgtcttcagaataaaagtcccaactcctaacacatcacctcaagatagtcccaatctgtgttccaacaataccaacctacatacaggacctccaccccacaaccagatagtcgtttgcctccatcccctctgttcttgttgttccttctgcttgtaaccgccgtcccacatctttcttggctaattccaactaatctatttatattgttcaggtgtcacctcctctatgttcctatgtcccatctacccaggactggtcagttgctctcatgtcatcttatgcaggactccatcgtttaatcaacaaaattgtaattatgtgtccatacagggtgtttatccatactttactacactgtaagctgtttaaagagtagaaatcatgtttttatatacataaacaagctctgatgtttactgaaactaatcaaatgcagaatgaattatgaatcattccatctgtttttaaacttctctaactatatagccaaggactctaagaccaaaattttaag

SEQ ID NO: 124456 - DNA, 311 bp, Homo sapiens
tggaagagtctttaatcagttactgtgagtttagcattgtgttttataaattccagctgggccacattatctgctcttcttctctccttggttgcaacctgctgctggagaaaatcagggcaaagcagtgattaaatccactatagacttactgtgaagcctcgtagttcctgcactcgctcttgcctctgcctaccccagcccttgaagctactgatgatggctcctttggtagactggctcacccatttcctaagccagccccaggaaaggcagaacaagtactaatactaataccctttactctcccc

SEQ ID NO: 124457 - DNA, 241 bp, Homo sapiens
taccttatgcctggggatggagtcccattcaagcacaaatgaacattcacaggactcacctctgctcctcgggcccctcctgaatccccaatcaaaggttctctcccaaaggaagcaaacgtgaaggcagagagcactcgcacaaggctttgagctgggaatgattgacttcgagtttgtttttcccaagtcagaagatcagagagagttaggacagacagagcagactccccccacatcg

SEQ ID NO: 124458 - DNA, 303 bp, Homo sapiens
gagaccctgtgtagaatctgcaccataaattagacttgtactttaattttctgaatgagaagagtatgcagtgggaccactgacataaatgagagttgagaacaaaagatcatcatagcagatgaaggtggaagtaaagtgaactttagaaagcaatgaaaatatctcttgacattcgagtttattctgaaaaacttgtgaccccttgcaaaagtaaggggatcttcagatgtcctgtcccaggacctccatcttgcctggccccctccctgtctcctgcctcctgccttgctctccagcacc

SEQ ID NO: 124459 - DNA, 353 bp, Homo sapiens
aagtagatatgttattgccctaggaaaggatctctgttgaaacaggacagcagcctagggcccacatttaattaggatcaaccagtttaaggaaatgcttcccccaaaaagcccctgatggtgtggggaaggggaatggtgagttgggaacaggtagtgcctacatgaccagattttactcaagtgcatctcatgattctgtgggttttctagcatttttggaaaactagcataggttgcagggttttttcttcttttagactgatgttaatttattttgcaggggaaggacagcaaatggcgtcagaagatttttgtccttttgttatctcttagtatatcaataaattttt

SEQ ID NO: 124460 - DNA, 187 bp, Homo sapiens
cctctctggtgcccagatgtctgtgctaagttacctcttgatcttaacccctttctcttccccctacccttaacattacagatggtcctttagaacactagttcactgtcttctcaattgcctggctttccagataaacctgcctttcctcccaccaactcttgcttcttaagtctggctttcaagt

SEQ ID NO: 124461 - DNA, 592 bp, Homo sapiens
gcagctggggagtcgggagtcgtgtggagcgccgccatcctccctgggagcgagcctccacgtggcctgaaatgcagatggacgccagtgacgggctgctctcagcacaccacacggtcccctcacagggtctcccgcagcctggcgggggcgcagggagcaggatttactcctcctgttatgtagttgaaggcaatggagatgagggaggaccgggccttcccacgatcttaccctgcaccatcaagacattctgtacccagaaaggctgccccaatggcccctccgcgtgacccctgggatgccagtctcagctccttttcaccaagaactacgtgcctggtgtgaactgctgctctttcctggagtaaatcaggcatttatcccagtctttatccacaaggaagcatcacacagcccgagggtggcccatgtttagccagaaggaaaagcccacctgatacacaggacaaagagacgcttacctggtcctcaacacacatgaaccaggccagcagggaacgccaagaggtctcagcacagacaggatgcaggcacttgcaaggcacaacggggcgaggaggagagacag

SEQ ID NO: 124462 - DNA, 368 bp, Homo sapiens
gtcagatttgtgcatccctgcactgggacaaaatgcctccaggacccacttcgcgtgctacttccgcttggcgggggtgctgggcctgtgttttcctttgcctgggcattctcctcatgtttcccacctggagttccgcttttccaactgccccaggtagtcagggtcagggaccttggacttgtctcttactgctgaccagtctgtgctttatgggcagagatgagacccaggcccgtgtctgccagctgaccacctttcagccagccttgttctcctgtcttcctatctttatcatttggcaagtcctcagcttctgtcagtgtcttagggcagataggagggcatttccttgcacaaacccggaa

SEQ ID NO: 124463 - DNA, 447 bp, Homo sapiens
gtaccaggcagaatatatcagcaaattcccaaaacagaaaccaagcaggtcacatctgctgatcccaatgcaatacattaaaacacaaaaataaaaggatcattaaaaataaaaaacagatggatatgtttatggcattaattgtggtaatggttttgtgggtgtatacttatctccaaaattcatcaacttgtatatattaaatatgtacagctttttgtatgtcagtcataactcagtaaagtggtttaaaataaacaataacaaaaatgaagttaatttttgcccaaaaaaggtaataaaaataaagttttcaaattattcaggaatgaatgaccagtgacagcactgcatatcaaaacctgtgggatgcagacccagtacttatatgaaagcttaataaaatctaaactaaatacaaatttttctaagaaaatgtaaatgatc

SEQ ID NO: 124464 - DNA, 504 bp, Homo sapiens
ttggctcaagcaaccttcctgccttatccttccaagtagcttggaccacaggcatgtgccactacacctggcttttttttttcttgagacagaagcgagactccatctcaaaaaaaaaaaaaaaaagaaaaagaaattgaaataatttactactataaattaaaagagaaggtaatatatttatagcagtaatcactgaaaggtattttattaattcagcatttttaataaaataggcctggtagaaggttacctaaatataattatttaactaaatgcaacagcaatttttttttgaatttttttaaattgatgaatgacatttgtacatatttatggggtacatgtgatactttgttaaatacatagactgtgtaatgataaagtcagggtatttagggaatccctcaccttgagtatttatcatttctatgtattgggaacatattaatacatgttctcttctagcaattttgaaatatgcaataaattgttgttaaatat

SEQ ID NO: 124465 - DNA, 277 bp, Homo sapiens
tgatgtttttgtgcttgaggcattaagtgctctcagttacctggaaaaataatggctctccaaaatgattcaaagcttttcctttataatttttaagattcctggccaatgtgctttaaatgaactttctgacttattaataaaactcaatgaccgggtgcagtggctcttgcctgtaatcccagcactttgggacaccaaggagggtggatcacctgaggtcaggagttcaagaccagcctggctaacatagtgaaaccccgtctctactaaaaat

SEQ ID NO: 124466 - DNA, 241 bp, Homo sapiens
agaaatggaaatctatgtaggtcagtactcaaaggaggagcagctttttgtctccatagaggatggaataaaaagtatcttattcctaatactgaagcaaggctgaatggtgcctattcaaaaacaccaaatgtcctgggctagagtcaggaaagtaaacccctcccccgtgctgtccctactcccccaacatacacattttaaacagtaggtggaagccaaagtcaatcagatcaaagtt

SEQ ID NO: 124467 - DNA, 748 bp, Homo sapiens
atatgaagctattgataataataataataatggtaataataacagtagtaacttatatttatggggcatataccatatgtcaggccttgttttaaaaagtattaactaattcagttcttcaagacaagtttataagtacttagagctggtaaaagatgtcaaaaggtaattctcttaaagagctattatcatttctcatgatgccaaacatagtaatttagttacgcagtctcaatatctacttcagttcttctttaatcagcgaattatttataatttttaaaacttaaatacacttattttcgtaattaagttttttaaaatccctgagtaaattggttttgggaatagctagtattaaaatgctacttttaggagcatgtcctgtagaatacgtctgtgcaagtagaaagataattatatttaagttagtacaactttaaagaatttttttgaaggttgttgagtacagtggtgtgtaccctgtagtcccagctatttaggagactgaggtaggaggaacgcttggacccaggagttggagagcaacctgagcaccatagtgagactccatctctaaaaaataaaaataaatttaaaaaatgtttttaaaagccaaaggatagtttttattttaattaattgcttttgatcaattaaaataactcagaaacagagaattctcattgatggtttcaaaaaagatagaggtggcagggtatggtggctcacgcctgtaatcccagca

SEQ ID NO: 124468 - DNA, 427 bp, Homo sapiens
ctctgccttcgtcgatcttacatttattggagaaatggataataaagcaagataaattagtaaaacaaatagtgtgtcaaatagtgataagtgttgaggaaaaaaacaaagcaaggatagaaagtgttggtagggagttgaaattaacagggaacgtgagacaataatgcttctgctaaaagctgcattcctgcgatgtgtttctttgtcagagaaacactataaacagacagagaagtaatagtgaaagcacaacactacaatcctgggtatcacctatgggtctacataaaaatccattaaaaattccctgaaaggttaccacattcacagaaagcataaaatccaaatctcgagttttgaggggcaggatatggattctctggatagcagtgactcaggtaaacaaagtgagcatgacatggaa

SEQ ID NO: 124469 - DNA, 362 bp, Homo sapiens
aaggatgcgaagtcatgggtccccatgcagtcccgagccaggcgagctcagactcagcagggaagctacccagggcatgggggacctgaggtctagggtgaaagcttccccatcttgtgtgacttcgggactcctgcccacttgaggcatcagtttccctatctggccactgagagtgaagagggggtctggccttttgcccactcttagtaggtgatgtgggccgcttcgtgaccctgcccagggacgagggtgcaaacttgctttgcatctgattttcctagcagcagctagacctggtagacatgaggtaggcagcacagagccagtcacactaggagccaggatatctgctccctgcc

SEQ ID NO: 124470 - DNA, 366 bp, Homo sapiens
aactataaatcctgagaatccaatttcttgttctgataaatcaacaaacagaaaaaggttttgcttaaggttgtgtttttcattctatacaattttttaaaaactcaaaatcaaataaaattatactactacatacactgctactcctataggtttgccctgctttaaacaaaggaaatggacaagtatggcaggcagcagaaggggcctacagtggcagagcaggagaagatggtggaagtcctgtggcgcatattcagtcagactgctaattcctatgctctgcatgggcatcaacatcacactgataagagccctttgctttgtgttttggatacattcctatttacagaaatgttgtaatgg

SEQ ID NO: 124471 - DNA, 402 bp, Homo sapiens
aggccctcagccgggaagaaggtgaggctaagctgccttccatgagtgtttgccttaatctcacctgatacactccacagatcactggcttaagtcctaactcaaaatcagcctttccccccaccccaccaacacaggagatatttttatagaaagcaatgaatttttttctttaaagaacttaattttaaaatgtctacccccatgtttggtctttcaagagtgcattgcgtgtggcatgagatgtacatagcttcatgtttgtttctaatgaaggtggggatggaaaaccaaatttgtcaggtggggatttcaccccagccttatgactcagttttagatttaacttgattcatttaaggttggagtttatttctggctggcaaaatatggcttcctggc

SEQ ID NO: 124472 - DNA, 488 bp, Homo sapiens
ctggcaatgaagggggcaggggagtgactactaagtatggggtttctttttggggtgatgaaaatgttctggaattagaagtagtaatggctgcacaaccttgtgactttactaaaaaccactgaatcgtgcattttaaaggggcaaactttataatatgtgacttttagttcgattttttaaaagtaagccagattgtgttcatagttcagtcaaaactctgcagtggttctccacccacaatcaccatggcttccagtcctctgcactgtgtcccctctcacttctcagatgtctcttctcctgctcttccccttgctcaccccaccccagccaccccggctgttgaacttgctcttcttccaggacactccttctttagggccatatatgcccaccccctggtgcttaaatattacctcacaaaatggtcttgagcagcctcattaaaatcgcacaccatccccaactctctaccctctttctta

SEQ ID NO: 124473 - DNA, 568 bp, Homo sapiens
gcgaattcactagtgattgtgagctgagatcgcacctggcctgtttctaaaatttctaccaccaagtctatgaaaaatcatcaccaggaatgagggcatcaggatacatccccttgggaggctgaactatatcagagtgggtattcctcaaactgcttttgtgcatatcactcaagcttggccctgtctcttcatagacgccctcctctgcctccacatacttatttaagcagacactacaggctatacttggtgccagctccctgcagcccgtggccactgtggcccttggcctcagagcttcagaaaacaccccctctccctgagtgccaggctgaactgaaggttcccaccacctcacactcaaggaccctcctcaccggctcactcagtctctttgggctgcaccgaggctctttctgagatggctgaaggaaaagtgtcccttttattagctggcagacagccttccagtttggtggcccaattttcctttttcttttcctttttttttttaaagacagagtctctctctgtcgcccaggctcaagtgcagtggtgggatctc

SEQ ID NO: 124474 - DNA, 444 bp, Homo sapiens
gatgtatacgtacaagaagagtttctctaggtgtacttgctgggtcactgggaatgtgcatgttcatctttaccaggtaatgtcaaacctttctcttattagcaggggaggagagttccacagcctgaaaaacacttagcattgagcaatgtgctagttaaagaagaggctaagctgttataataaagagaaccccccaaacagtgactttaaactagagagatttttttctttctcgggtaacagactggagatgtccaatccaggccagcaggacatctttgccccattattaagtttccttccatcttgtggttctgccattacctagataaatgaacttgtctactctttgaaaccagattttaagtatttcagtgtttcagcttgtaggaaggaaaatcagccttaaggagcacatgtccacggttttcaaacccagcc

SEQ ID NO: 124475 - DNA, 219 bp, Homo sapiens
tgtcaaatctttcaggaatcagtttaaatataacctctcctgaccatcctatctcaagtcgatttcccctattattgtcttggcactgtttgattccttcatagtaattgcaataatgaaaacaaaatttatttatttgttttaaactaacgtctctgtttgaagcaggcagctacgaggtatgttttagccaacactgtatatcctgcacttactagg

SEQ ID NO: 124476 - DNA, 209 bp, Homo sapiens
gaatttagcagcaatgtttctagacacctgcactgactaaacgattccagtcatcatctctttggtttctcctagatgataggaatgatagtgagtggtgaatccttttacagaaaccagacttttacctgactttttctaaactgggtcatcggctcccaagtggacggccacagtggtatcatgccacagtgataaaggagtcaagg

SEQ ID NO: 124477 - DNA, 254 bp, Homo sapiens
tccagagcatattgcatcgcagctgcagaggaaacacaggctctagaacaagcaaccacagcacaacgtggtacctgccaggcggccacatcaacaggtggttgtgagagaatagaaagggaaggagtggctgcattgtgtgtagtctgtgtgccagctcaaaacatccacttcctgttggccaccgatgccccaaggcttctcagcaggggagaaataaaatcatccttgtcttttaataaagtaatccccag

SEQ ID NO: 124478 - DNA, 804 bp, Homo sapiens
gtactcaaagtgtggcccatggatcaacagcatctcatctcctgggagtttgttagaaattcagactctcccttggcctcaccttagacctaggaaatcagccactgtatgttaacaaggtcccctgtgattcttactcacattaagttcagaggagcctctgtctacaaaatacttttacgtgcatcatctcccccgccaatgtagtgcaaacataggaaaaagtgacatcaaccttaccacatgcaggaatcatttcccctgaggtgaagagaataatgataatggtagcaactactgctctttaagtctacactgtgcgccaggcactctacctaagtattcacctcatccttaccacacctcgtgagggaggtaatactagctccactttacagttgaggagaatgaagttcaagagggtaagtaacttgcttaagatcacacagccaggaaatgccagagccagattaaatccttgaccgccaagctcctgctctttgcaagtgtttgagaacatcttggaatgagaaagggattacaaaggtggatttcagctgtggctgcattttggcgttacctggggagcattacaaaacactgatgcccactctcagagattcggatttaattggtctgggatctagatctgacattgggattttaaaaatctttctcagcaatcccagtgtctaccccaaggttgagaatttctggtttatggactggctaacctttagtttgcccctgttaatgggatttccatcgggaacagttcatctgcctcccttcacttattatatg

SEQ ID NO: 124479 - DNA, 502 bp, Homo sapiens
gacctcttttctgttgaccttgctaagtattcctgtgcccatgcacactgttttactttctaaggctttataatatttttaatatcggtatggtattcttttcttatttctttttatatcattgttatggccattctttcctgtttatttttccataggaacttcagaattagctttctaatttgtatttttgacatcatataagtttatagataaatatagaaagaattattctcttgatattgactttctattcaagaagaagatagacctttgcagttgttcctatctcctcctctgtccctcagtagtatttaacattcttctttatgtagatttgttttttttttttttttttttgaaatggggtttcactctgtttcccaggctaaagtgcagtggcacaatcttggctcactgaaacctctggctcccaggttcaagcgattcttgtgccttagcctccccagtaactgggactacaggtgtctgccaccacacc

SEQ ID NO: 124480 - DNA, 454 bp, Homo sapiens
taactcatcccagagatttaggtccagcagagccaggcccacacagttattgaatcagacacgagaagacggaatcgacatggcaatcagcatttagacaggctactaagtgctgccatcaatcaccttctcttcccagaaaagtacagatgtctccctggatttcttactaataaccagaaatacagctgtccaggccctgcacatattttgtatcacttgataaaaatagctaatagcattctatctgtgactcctggtttatctcataaactaaatggatggaaaagagaaaggaatgctacttgaaatcccatctcagcggcacatgaattccaggtagcggctccctggttacaggacagaagtaagtgaagtagcacacacaagagaaatatcggaaaacagaaaataacttctagaggaataatttgttgcacaaaatgcaaacaaa

SEQ ID NO: 124481 - DNA, 1016 bp, Homo sapiens
gtgagccactgcacccggcctaattttttaatattttgtagagacagggtctcactctgttgcttaggttggttcaaactcctgggctcaagtgatccttttgccttggcctcccaaagtgctggatctgtttttttgtgtgtttttttttaattatgcagttccaagttatcctttcactctcctatatttcataacacatatttgaagacctagctattccatatcaaattctttttatcttccaaacctgtcatgatctttctttcctctgcacctttgctaaaactatttccttctgtatctgatgaaatcttatacattcctctattcttggcttttgcattatctcctctatgaagcattttcttaatccttctgagaatgagatgcttactcccttcccttatttaatactctgtgcctctattatagcacttagcacagttcacttgtattataatgaggatctgtttcccccactaagtggtaaactccctaaggttagcaagaactatgcatttaacacagtgccagtaaagcaagaactcaataaatgtttgctgaattgaaattttcattataaatgtcattaaacaaactgtttttatcctttttaacattccctctgagataggttaatgttataattcctttttcattagtttaaaaaaggacagagcagattttgtagtgattacagaatggaaacgtaagaaaatgtaaggtcttcaagcagtatcctgaaataataattagtataaactccaaaatctttaccagtcattaaaacaactagtatgtacctagtcaaatataacttttccagggtcacataactaataatttttggaaccaaaatttgagcataagttgttctttctctaaagcccatactttccttctgttttatactgcccttgctcatttctatcctaaggcaataactatcttattatagaagagttttctatatggaaacatgcatagatcatcattcatgtgtcctttttgtt

SEQ ID NO: 124482 - DNA, 257 bp, Homo sapiens
ttcatgcacaggatggcgtggcgcgtacctctgctgggtccttcccacaagggtggagggctgatgctgctcacgtgaactcccttccatctgtgactggctcttgagcgtggaccttccactcactgccacttcacattacaaaggttctcaccttcaatgtgccccgggcaagtaggattcctctactgactggctgcccactatgtgccaggccccagggagataggggaaccagccaggtagcccccagtctt

SEQ ID NO: 124483 - DNA, 449 bp, Homo sapiens
acagtgacacacaatttaaagaacatataataattgccttcacttatttaatctccataactagtactctgtggcaggtattatcattcccactttaaagacaaagaattaaggctcaaagatccttagatgacattttatagatcaaaagctactaagacactggaatcagggtgtgagcaaagttattaaatcagagcacttaaacttgagggtcagacacatcttgatgagtaaccttgctgctccccagcagtgtgactctggccaagctgtatcacaggtttgagtgttagttccttcatctagttaatacacagcttcttttgaggcttaaatgagaggacacctagttcagagaatcagcagcatgttataaaggagagtgcatttccttgtgtctcctctgctgtttcctctatgcaagagtgccttaaagagcagcagca

SEQ ID NO: 124484 - DNA, 710 bp, Homo sapiens
gggtaagtgtctcgcagcagttccaccactacgggggcctgatttatggctagctctgggagactgtcctccacccagacccctgccaggttgagaaacaattccttatacattgcctcattttcctgctggcaaaatgcatctttacaaattttgcacctctcatagagtctccattcctctgttgtggggatggtaagggtcattatcatgtcttctttgacctaggtttagagtcatttccccttctcaagtaaaggagatttgtgcttgcaatttctggagcaattatcttcctaacagaggaccagacaatttggcaaatataaaaaatcatgttggacttgctgtcctccaatcacacatcttttagatttgaagtaaggcctctttctattattcctgtagctccaattatattgaaataatttttagacagtgaaccaattgcttgagttactactgagtgctctgcaccagtatcaaccataaagtccattttctggccccctacctccattgagaccataggctcctccgggcctaatgaaatggagcctggtctatctcagtcctcataataatcattgattcctgccagtccaattaaatccatgtctgacttctgaaccccttgaccagtggcggtgggttctggccagccgttttttccctgattgttgcctctttccttttctctttctgggcat

SEQ ID NO: 124485 - DNA, 441 bp, Homo sapiens
atttggtgtggaccggagcacaggtgaggcaaggcaggcctcgcagctgaaactttatatccagagcagccagggccactgctggctgcggagtgaggacgcatatccccactgtccttagatgggtggcccctggaacctgggagaatgagggggcatgctgacagtctcattgtggctggaccacctgtacatacacccacaagaccctcacccctaaatcctccccctacacatatgcacacttaagttaccgtatgggtgttgtcgagcattttccctggggtctgtggctccctggaccgacatgccccaaagctgaactcagccttttcaagcttgcggccctgctgcccaattcccctacaccctgccttgtgggttctcgcggggtgggggccttagggcaaggctcttgtaaataaagtataagaaacagtt

SEQ ID NO: 124486 - DNA, 511 bp, Homo sapiens
atttggtgtggaccggagcacaggtgaggcaaggcaggcctcgcagctgaaactttatatccagagcagccagggccactgctggctgcggagtgaggacgcatatccccactgtccttagatgggtggcccctggaacctgggagaatgagggggcatgctgacagtctcattgtggctggaccacctgtacatacacccacaagaccctcacccctaaatcctccccctacacatatgcacacttaagttaccgtatgggtgttgtccagggtccacagttcttaacccccagccagcagtgctcagctaaccttctggagcaagcagtggggttggtgtgggggaagccaggaaccagtgaaaagatgaccgacatgccccaaagctgaactcagccttttcaagcttgcggccctgctgcccaattcccctacaccctgccttgtgggttctcgcggggtgggggccttagggcaaggctcttgtaaataaagtataagaaacagtt

SEQ ID NO: 124487 - DNA, 470 bp, Homo sapiens
tttttgtattttagtagagacggggtttcaccatgttggccaggctggcctcgaactcctgagctcaggcaatctgccccactcaacctctcaaagtgctaggactgcaggcatgaaccaccgcacccggccttagttatttatttataggcattttggttataccttccactttaccgccaatgctgcagtaagcacccgtgtccaaatatatttgtgtacacgtgtgagatgtttgcccactcgcggcagggaaattgctgagcctgatggacttcctccccttggcgttagcttgccgccacttacatctgcgctccattcctactataaaggtgactttccacttttgtcctctcctgaaactacgccgcctccagcaggaccggggccacctcctcgcctccccgacaccacagggccttttttttaccacatgcgtgtccgttgccctaagtccccgtcccact

SEQ ID NO: 124488 - DNA, 432 bp, Homo sapiens
tcgttggcactgcagagtgatgagggcaggattgctgggcatgtgggcatgtgtgccttccctcgctgtggcacttattagatctgtgtgttagagccagcatggatggaagcaagttgactccccagttgtacccgttagggattgtaacagaatggcttcataatcccaggagattattggtatagaggattatagcaggatgtggaaagtggcctggggccactgtgaaagtcaatgtagagtgctgggtgtgtttaggacagactgcttggtttggagggcccacctacttgccccatctgctagcatagtttgtgttcccatccacaccaagcctctggtgagaagggagaggcagctgcacccctacttcggcaagtgagcacaaggaaagtcgtgctggagaggagtagagcgacaggcttcatg

SEQ ID NO: 124489 - DNA, 1459 bp, Homo sapiens
agcgtggggaacgaaaaccaccacagcgtcagaaaggagcgggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccaggagctacaccgagaaaagttacttgtccaggctgaaaacagattctttctggaatacctgactaacaaaactgaagagtacacagagcaacctgagaaggtatggaacagctatttacaaaaaagtggagagattgaacgaagaagacaagaatcagcctccagatatgcagaacaaatttcagtgcttaaaacagcgctcttgcaaaaggaaaatatccaatccagtttgaagcggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggagggctactgggaaagagaaaaagaagagagcttaatatgaaggcccaggccttgaagttggcagcaaagcggtttatttttgaatactcctgtggcatcaacagagagaaccagcagttcaagaaggaattactgcagctaattgagcaagcccagaaactaacggctactcaaagccacttagaaaacaggaagcagcagctgcagcaggaacagtggtatctggagtccttaatccgggcgaggcagagactgcaaggaagtcataatcagtgcctaaataggatgttccaaagaccacacccagtcttccccaaggcaccaaatcaaggattaatccaaagtaacttctaaaataacactgattaaataagaactggagcaagtactcttaagtgctacattaacctggttagaaaggctgttggattccagattgctattgtaaaatctccatcatgatgtgttggagtgaaggattagatggttttatccaacagtcctactagatatttggtaaccagcttcccttaactagctttttctttaaatactcgttaataagctattccacaaacctccagttaacctaacacatgaccctaacctagccatttaccatacatcaaactagctaaaggaaaccaacctaaggaagtgaaaacagttgtgatttatttcatctagctaaattgtatttctttatagagaaagtacctttaaggatagcattccaaatagactttgaatagcgttctgctcatttatcctcattccttttgaccaacttagcagacaaaagcagtttttata

SEQ ID NO: 124490 - DNA, 622 bp, Homo sapiens
taaaggcaaattttacagggaagcaaggaaattaatggaaacaataaatgcatgtgaccttacaaaagggaaacacgagtggaggttgccgttcttggttctgccacttgctgctgggctgtggctgtgattctgacttgcccctctgtaattcatttcatacctccttacctcaggccagccctcagctggctaggctttttggtttgtttgcttgtttgtttgtttagtagagacagggtttcaccatgttggccagaccggtctcgggctcctggcctcaagtgatctgcctcctcggcctccctcaagtgattcccccgtcttggcctcccaaagtgctgggattacaggtgtgggccactgcacctggtctcaagctaggctttttgttttggtttgtttttgcagagggtaagggcgatctgatcttcattcctggaggattgagttctgggtcctgcctggttggaaatgtagtcgtctttcattaacactcccactggatatggcaatataaagaggtgtccagtgtgttcttctgggtttcatgcattcatcttcctgccctcattgcacagcagcaactttatttccccttgaaaattgtggtgaattgtcc

SEQ ID NO: 124491 - DNA, 698 bp, Homo sapiens
gatggaactggaagcactttgtttttagaatttggaatagtcatggacaaaagcagagtgcagcagttgagcaggtaactttggaggcagaatgtgctggaatcttgctttggccagggctactctctgaactctaattctccacctctaaactgatgacaatatttgttcagtaagtatttcttgaatgcctattatgtgcttgtgattcttagtattagttgaaattatcttaagaagaactctgctagcccagtctccaattttacagaagagggagagccccagagagagaaggtgacttcagttagatcaccagctaggaactgtgcagatgtgaataaaacctagtacgtctgactctccatccagggaccttcccactgtacgtcaacagccatttatctctttgactgactgattgtggagagagagagagagagaaagaaaggaagccagctacccagtctgagcaggccttgtgaaaagatcatttttggccttgagaatatatgcagcaaaattgtgttacagggtgcaagagctcaggttggattgtctgctctccatacaattattgtataatcatcaaacatcctcctgagcacctgctgcaacgagacctaatccagaagaaagtggaaaggcatggggaggacccaacatgacactgccctcaagcatcttccaaatgcctg

SEQ ID NO: 124492 - DNA, 243 bp, Homo sapiens
tgaaagagatgtcagagatgggtgatttggttagtcttttgctttgttttcttctttaaaatacactacagtttctggagctagaaatttgctgagcagatggtacaaattctgcaacatggtatttgtgggagattgagtagatcagcgtcccgcgacacaggccaatagtgcattttcgacagcatcataaatgagagtttgtattcccattagtgtctcatgacaggcagcaccttggcg

SEQ ID NO: 124493 - DNA, 380 bp, Homo sapiens
tcctctgagtatagctgtaactctatctcatagattttgggatacatattactgtttcattaaggtttaaaaattactactaagattatgcatttttcacgtatcagtactattggccattagtatttcttcctttatgaatttcctcttctcattcttatgccattttcctatttagatattcattattttcttattgatttatctgttgtgtacattgcaaatacataaccacttttcttttacattgtgttttacttttcagtagaaaagttttacgtatttcttatgtagtcagatatatcaatattatcactttgggttcccctgtctgataacattcttagatagctctttttccttccaagactacataaatt

SEQ ID NO: 124494 - DNA, 426 bp, Homo sapiens
tagtgttctaatgtgtcacacacagcaagggctgggaaacctccctccctggccagcctctccccgcccttcccgtactcccaacccccacattaacagccagagatttcctatccaacacttgagtccaagtccagacagccaagaaaacagagggccaagatttcaatcaggatttctccccagactgtgagccgggggagcctgtaaaactcaacagagccaacatgcctccaccggaaagctgggactgctagggttatttacgtaaaaggtaacatcagtattaattaggtgagaagaggaaaggcacagaaactaaattacagggcccaaaccaacatgagaaaaatacttgctatagcctggaatctttcactcaagttttatttggtgtgagacttgtaaattatagctttgatcctt

SEQ ID NO: 124495 - DNA, 533 bp, Homo sapiens
agggcaatgaacaccacttttttatttcagtagtttgagcccattatattgtaagaactttgggggcacctcttacagtatcaggcttgtagtaaattataactaagtagctaatggctaaatgaattaatagatattataattcaccttgctttagcaaaagagattatggaggagctattctaatatttagaacaaaataattataatcatgttttccttgtctaaacttccttagttgctgactcaatggcttaattgctgatagtctatcagtgatataatattacagaaactgaatacagaaattttttaattcacttggatacaattctgagaggataaagtgaggtgagcccatatcaggatagaaaacaatgtggtaaagatgattgtctcttaataattcatgaggtgagataaaaaattttaggtaaagaatggaataagctatgtagttgtatttctttgattaaaaaattcacatatattaagctgtcttcttttagctacttgaaaggatgtcatgtaag

SEQ ID NO: 124496 - DNA, 333 bp, Homo sapiens
aggctggctggagcggtgttgtgattctacctcactgtatcttcaaactcctgggcacaagggatcttcccatctcagcctcttgagtagcttgggactacagacacccgctaccgagcccagcaacacttagttttaaaggttaaacctttggcagcttacttaatttaacttggagaagttgtaacttgtaaaatggacgtaaccatagtgcttctctcccgggttattgtgtacgttacatatgctaataatgtatgcacttcacataccagcttgcacacaagaaatgctccagaagtggccctgtcactgttaattcttatgatcaga

SEQ ID NO: 124497 - DNA, 148 bp, Homo sapiens
ttaatcctccctatgttcatccaattagaattttaactcaatcgggcctatagaagctggaaatctaggatagcacaaaagtataatcatctgcatactgaagataataagcacgagtaagccatcttttgtttccaatttcaaaaca

SEQ ID NO: 124498 - DNA, 365 bp, Homo sapiens
gtttatatttccttcctcttctccacatgcatgatcataagtaccataaagcaagaacaatacccggcacagagcaggtgttccatatttaatgttaaatgaatgtaccccttttctcgttatctatagactaataaaaaactacctcaaaacttagtagcttaaaacaaccaccaagtcattacatctcatgcttttgtggattaggaaagcaggcaaggagtggctgggtgattcttctgtttcacatattatcaagagagggcatttagtgatatttagcctctggatggatttgtctggagagtccaagaaggcttcacctatatgtccagcaccttggtggggacgactggaaggataag

SEQ ID NO: 124499 - DNA, 249 bp, Homo sapiens
ccttagcctccccagtagctgagactacaggcacatgacaccatgcctggctaattttttattttttgcagagatggggttttaccatgttgcccaggttggtcatgaactcctggactcaagtgatgctcctgccttggcctcccaaagtgctgtaattacaggcatgagccacggtgcctggcctgaagatattcatcaaggcctttggagtagaaatgggtctgcttttcttgtcacaagctaaca

SEQ ID NO: 124500 - DNA, 398 bp, Homo sapiens
tcccaggagagggcacaggaggaacaaagggctcgggaaggtgaagaatggcaagtctgcctgtgaaacacaacaggccctgctatgttaagcagtgtgctcagctatcatgaggagccagtgaaagacttttcagcgtggagagactcggtcagatcgagagttcagaaaacacactgtagagcatggaacaggtgagagaatgagaacagtgggccaagtaggaaaagatttcttaagattagtatggcccatgcactaaagacaaattcacagctgctcattaaacacaagtacatgcaagatgaaatgagccagaaaaataaacaaaccagaaaaataaacaaacacaagtacacaccactgtatttgcattacacacatctacacacttatgc

SEQ ID NO: 124501 - DNA, 474 bp, Homo sapiens
tcagtaatgttcatgagtaaacatcaaaatgtattattatctttaagaattaccaaaaggaatttcaattaaaatcaattatataggctggtcttgaactcctgacctcaggtgatccgcgcatctccgcctcccaatcgctcatttaatcctcacaactaatctatgaggacagtgctctgtcattccattttacagctgaggaagccaaggcacagaaaggtgaagtcgttgcctgagatctcacagcaggttttagcgcccgtgtgcttcgtctgctgcacctctactaccccagctctcaacgtgggttctctgaccagcaggaacagcgcttaggaacctacacaaaatgcagattatcagggctcaaggagaccacgctgaatgggaactctggaagtggggtacagcaacctgtgttgaagaagccctccatccacggtgaggtcagcaacctccgaccctgcaaac

SEQ ID NO: 124502 - DNA, 353 bp, Homo sapiens
acactaccctggactttccatagcacattcacatctgtccccaaatccagtctctggtaataacttttattgatcacttactctattccaggccctgttctaagtgctttaattttcacaaaaatactaggtgaatataagataatagagtcagattttcaaatctgtgtatgtgtgtgtgtgtgtgtgtgtgtgtagatagcttgctgttcttctttgccacattaggatgcatagttgtccagatttaacatatgagggctctaaaaaggacatacatgcatcacttccatgaaagaagctattttctgcattttatattcagataatttttcagctaacactgacatttt

SEQ ID NO: 124503 - DNA, 300 bp, Homo sapiens
ctggtcttcatctgtgaagtacagaaaagcagtgactagaagggctttacatttttttgtccttaagtgcacaaatttctagctatgttactataactccaagaaatatggaagcacagaatgttagaactgggagaagaattaggtatttcatagttaatcttcttccttcaggaagttgaagattatcaagattatgaaataagcaaatttacacagccagctagtggcaacccaggacctgaactcgggtcttctatatctgctattgtactgttacatgtaggtctttgtatatgg

SEQ ID NO: 124504 - DNA, 250 bp, Homo sapiens
aaggatatttttgttgtacatagaaatccaggttggcgtttttttttttccttgcagcatgttaaagatgttatttgatggactctggcttatactgtttctgtggatactgcagtcattctttgttcccttgcatgtaatttatcttttttttctgtattttgcattttctttttcaaaaatttttattttatttcactttatttagagatggggtctcaccatgttgcctaggctggatttgaacttc

SEQ ID NO: 124505 - DNA, 407 bp, Homo sapiens
cttttttatgttcaccaaatgcttttgaataagatgtatcttaaagtctttcagaattttccttttctccagctgaacttagccactttcctacctgtgttaccatgagcaaattagcttcagtttcctcatctgtaaaaggagggttaacaacagtgtctgtgtcggggttgttgggagggcaggtgtggcagtgtgtgcctgtcagtaagaacagtgtcctttccctccctggggcctgtcacacctcctgcctatgttcacccacccatccacccatctacctaattcacttggttagtgtctgcctcaaggggtacaaatttggttttcttccaagggcacagatttctactaagacagacacagaaacataaggaagaagctgtttgctcctctggagagtc

SEQ ID NO: 124506 - DNA, 391 bp, Homo sapiens
tttccggctttgtgcatcccagtctcacttggcaacaggaacagtaccaataccaccaattttgtagacatactggagaggcagacggtcgaggtcctggcagtccactggggaggactttggcttcttctgtgacggagacggggaactctgcagggttttggacagagaagtgacaggatctgacttaggttgaacaggatccccagcgtgatccccctggattgagggcagacactaggggctgagggggaaggaaggagatctccaggaaggcctttgcagtgttcacagcgagaggtgatgctggctgggaccacggggcaggcagtgggggtgctgagcaatggtcagattctggatctgttttgaaggtagagtcgacaggatt

SEQ ID NO: 124507 - DNA, 723 bp, Homo sapiens
gccagtgatgttcataaaatgattccaaggcaccgcagagctctcgaatctctcccaactatcaaagggttatgcttggtttacgtttcaatattagttacactttgctctgagctacttgcaggcatttgtaaccccaggttctggaacctgtaagatgcagccacaaatgtttgctagatgaacattcgaaaaaattattttaacaattttcgaatattttggcacttgtttggaaatgtatggagtggaaagaagtagggtatttgcattctaatccaggtccaggcaccaagggtttggctaatcttagataactgattttttttgtgggcctcactttcctcatttgttaagagagagcattaggctagatgatctcagagggacttttcagtgaggattctatgattatagattgtaaattaaataaaatgtccagttaattgggttatcctacatttttaaaactatgtccgatcacaaagagagtagattataaaagaaaccatcaaccttttcatagcttcaaaggtattggtttaatttggatttactgtgagttctcatgagtttcaatacaatgcagtttacagtataatagaattcatattacaaatataagtgcattgaaatcaatgttggacaattaaacaagaacaagaacaaaaagactttttatcctctagagctgtgcttgctgttcactatggtagtaaaatg

SEQ ID NO: 124508 - DNA, 433 bp, Homo sapiens
aattcatcagtcagttctttggagtgtatatagacacagccttcatgaaaacgttgtaaggacatctcatgatgtgtttccataaatctgctcaatttataatctcttgcgtgtgagtttgcgcctctttccatgtatgtttccagtctgcacacatggatggcgctgcacacatagatgtgtggtggcctcattagccagtagctactctgagaccctggacatgcccgcctgcattgggatattgctatcgtattgaactgcttgctagaaaatggtcttggaatctcacaagggacatctattcctgatggagtgtgcagttttaataatgacttaagtcaatacaatgttgacagggtagaaatgacttatcaaagacacatacctcttaagtgcccgttctgtgcaggcacccagcaagggctgaatt

SEQ ID NO: 124509 - DNA, 251 bp, Homo sapiens
acacgagacggtacgggtctgtgaccttatgggagttcaactctcagcatacaattctttaatataaaacagatatgactgatgtgtaatcccatcaccatgagagaaatgtgtggcaggtaacctgctggtcacaaaagaatgggagacccatagtgtaaacctagacccaatccatagcttaaagccatgccctgcctagatctactgaacctcagctgacccatggacccatgagtgtgagagtacat

SEQ ID NO: 124510 - DNA, 206 bp, Homo sapiens
ccatgcccaccagtgcacctttagtagacaggcttccagcacctcagtaccccatgtgggaatgtctactgagtcaagttcacacagcctaatcttgtgcatgtttgtttgttttgatctccaggtcctctcagtttctcaaatcacttttagtggctgagtgaaggaaacaactatgcagtttcaaaataaagctatatccatta

SEQ ID NO: 124511 - DNA, 488 bp, Homo sapiens
tacagggtacttgcagctgtgatagggagacagaggagcaagcactaggcaattcatgctggaggctggccaggtgtgctcctcccctcccaccaggggcagagaggatggaaattatgtgattgccaagggcagctgagaaaaggagtcatgcctggggttttgctttgttgtgagctgagttgggggaataaagatctgagaggagcggaggaaggctgactatgagtggtgaagacggtgaaggccagcagcagccttccacacctattccattgtcatctgatggacagccaagacaagcacttttcctggctcttacttatgatattgtcttcactatttggagcagttgtgtgacaggaggcctaccaggagcagacaaagcctgatgcaccttgcactgccctttgcctccataccccccagcggaggagaggatttgagccttatgtattattatacttactgtaattcccaagaaagaa

SEQ ID NO: 124512 - DNA, 650 bp, Homo sapiens
ggtttatgtttatgactgagtattcaagagaacaattgagatcacatccccacattcaatcgtcactaagctggtatgcttcagataacatataagagaaggctactgctgttttgaaaagaacaggggagaaataagcatgtgaaaaaaatgctttatgaggcacaaagggaagacctaaaattcagaatcaaacacaaatttctctgtttttgtactgcaaccacaggtatatctacaataatttaaagcccatgacactctgagggtaaccacagtaacaaaaacaacaaaaaatctaaatgcagccaaatccctaatataactcaaactcccatacttaaagcctggcagaggaaaagacatgcccagtgtaagtttaaaaatctacttatttcagtctctactgtactacacaagatgtccagttttcaaatgacaataaaaaaccaaaacacaaagcatgcaagaaggcaagaaaaccacattcagaagtaaaagagcaatcatcaaaaccagactcagaaatgacacaagtgttggcaatagctgacagagaattaaaaagagcagtgattaatatgctaaaagctctaaagtaaaaggtggagagcatgcaaaatgagatgagtaacttcagtagagaaatg

SEQ ID NO: 124513 - DNA, 272 bp, Homo sapiens
gcatgaggaggtgttatgtaaaaaaaaagaaaaaaaattgtctggaagatttttaacagcgattgttgaagattattttataagtttgggaactgttgagttaaaggagtgattcctacggtggcttcacattagcatcacctgggaaacttttgacagctcctgcccaggcaatgctgagtccctcttaggggcaggactcaggaataaatcatttgtaaaactccccaggtaattctaatgtgtggccaggttgaaaggcactaggttag

SEQ ID NO: 124514 - DNA, 388 bp, Homo sapiens
tataataaataatacatttatttcaacactacacatacacataccacatatcactttgtggttcttttacttctttgaactggctaatatatctgccagatttccttactaacaatgagttaaatatttaacatgtgcttattttttaaaaatcaatagctttacacatatttcaaaatttgttattatgcaactatatttctagaggtaggaggacaaagcatttattttattttacaatttggtagctctattttaaatgattaaacgtgtatacctctatttgtattcttgtgccagaccataccaatgtttggaacaagttcaaatgattgccaatttgtgttaaactctatagtaggctctgggatcagcatattgtaccgca

SEQ ID NO: 124515 - DNA, 711 bp, Homo sapiens
agcttcaaaacctctcattaagttgatgaataatggattttctttctccctctaaatcataatggcactcatagttctttgtttttagctagatgaatacctttatttgggggaaaaagagtccataattgagtgaattttggttttgtttttccaaaaggatattgaacaacaaagctatccatgcttgtagcaggtcaggtgggcctgatcctaaccatagtttagctgcttgaaaacatatccattaatgttcctacctctctctttgtgacattgtctgcttttgcatggcacaatgggaagattggatagaaagaagacagggcaagaagagaggaagaaacggcccaaggggaacaaaagaattgggccaaaataaatcattcctactcatcactccataaagttttgctaacgctgtgactaggcttgccagacatagcgccaaaagagtggaacttttccactgatggcaaaggataaaagggatttgagtaggtactagagcacctactcatgcctagtactatttctttatagacagtaactcattcatttaatcaccttaaaaaaaccttttgaggtagaatctaaattgacctcaagtgtatttttttattttttatttctaacaaattgaattctactttctaattcaactcaaaaaatagtttatagtaatagtacccactgtatgccaggctctgg

SEQ ID NO: 124516 - DNA, 455 bp, Homo sapiens
ttccagggtaccacattgcatttattaatagttgtcatgtatctttagtcttctgccgtccatggttacttctcagcctgtttttctgagaaaaattttctggaaattttgaagaatactgttcacatattctaaatatgtctgtttttctcattagattgagattacaggtttttggaaaccacagcagtacaattcacttcacatcctatcgggggtacacatcactggtgatattaacattgatcacttggttaagtctgccaggtttctccactgcaaagttactttttccctttccatactctgttctttaggagtcacttaatctagcccacattcaaaaaggagaagattaagctccaccctatgaaagggggaatatctacatatatttggaaatctttaaggaaattctctcttctccctgtggaagactttttaaactctttggt

SEQ ID NO: 124517 - DNA, 164 bp, Homo sapiens
agatatcttaggcagaggggatcgtaagtgcacatgccccgaggtgaggggagtgggcctgttgagagagtagcaaggagtccactagggctggagtagatgaatggaggggagggtggtaggagatgagtcgagtcaggtggcacaggacctcgtaggctgtg

SEQ ID NO: 124518 - DNA, 401 bp, Homo sapiens
ttgctttaaccattcctcatttacagaatcctctgatttagccccatcccaaccaccttcctcttgcaatggctccagttttttaagtccttcttaaaacaaagctttctaaaatgagcacaacactccagatatctctgatgaagataaaggcaactgaaaccattaattttcctgatctgggtacaatccttctgtaacatagcctcgataccatgttagctttattagtcacataccaaaacatccagctcttttccactcacagtactgagaagccctatttcccccttcaatatctaccaaccaatttttttaaaaacctcaatgcaggacttcacatgtattcgtattaaattctgcccagtttctgacatacacagactaatgataatctttgg

SEQ ID NO: 124519 - DNA, 429 bp, Homo sapiens
gttgtgtattccaagcgcctagcacagtgcctgagcaaatgaacaaagcaatgagtgagtggttctttttctaggatccctcttattctaacattctgtgactcttccagttttaggaattgctggaggaaggtcaggggttaggatggtcaagtgctctcctgctcagatttgaagctgctccaagaaggcacattcagactcggtattctggaaatctctgttttctggcatggaaacagctgcagcagagtagagttttggggccatgccagacttgggggtgtccatttatcaaactggtgccaatctccttcccaggtgaacacatcccagctatatggtcctcagccagtggggtgggggacaggatgggggacttcctgctactctccagtgagatcattccctggaccagtgcggcgtcat

SEQ ID NO: 124520 - DNA, 330 bp, Homo sapiens
gttctttgcctttattattcttactatttttttagagatggggtcttgctatgtcgctcaggctgaccttgaactcctgggctccagccatcctgccaacttcacctctggagtagctaggtctacaggtgtacagcaccatgcccagctcctttgccagtttttgaatggggttgttgtttctctgttgttgcattggaggagttctgtatatattttggatataagttactataagatatattgtatataaaaattctctcccattttgtacgttgttttttcactttctttttagtgtcctttgaagcataaaagttgttaattttg

SEQ ID NO: 124521 - DNA, 495 bp, Homo sapiens
tgcggatcataagtgataccataagtgtcacagcctgatatcttgaaaactctttaaccggttctcattcattcatttatgcaccctttagatttattcatccattaatagtatattgctgttctctgtgtgccaaggactgttctggaatcttagacatacgaagatttcttacatccccacagttgagtgagaatgacagaaatcatgacaccagctggcaggtgctgcagtgaaggtgtatgcagaggatttttgagaacttagaagggaagagtcatttagtagaagagagtacatctgagcttcccatttctgggactctctatgtccagcatggtaatggagtcttacattcatctcctttttcacctgccagttttcactgattcttatgtctcagtataaattccactttggaaaatactttcatgactcctttaagcaaacctgatttattctttaaatttttattatgtcctcactacatgccat

SEQ ID NO: 124522 - DNA, 571 bp, Homo sapiens
tgcatcaacgcgtcgggagctctccatattgtcgacctgcaggcggcgcgaattcactagtgattgtgagctgagattgcaccactacactccaacctgggccacagagcgagactctgtcaaaaaacaaaaacaaaaacccagccacacaccccagcatttttacaaaagggaaaaagggatgcattcaagataatacaatgacattcctatgttttctctgagccagagagcagagaaacattgtggctaaggtggctttctttctgatcaaggtttctgtgaatgggcagtgtccacacatgaattctgcctaaaggctctgtgggagccaggctgcgagctgattgcagcagcagaaggcagcaggtaggagatgacattttagaattgttcaaacagaccccaggcctagaagatatgccagacacggtgttaggagagaaagaacaaagcgacaccagaaacaatcgtttaaaaatttaaaagaccatttccctttatcaactccacagctggctaccattccagtaaatttctaaaacatgaaactggccccagcagggcagag

SEQ ID NO: 124523 - DNA, 565 bp, Homo sapiens
ccatgtgccaagtacagttctaacactgaggatataatatagaattaataacaggcttttttagaataagtataggatttcaagtggtagtaagtattcagaaagacaacatggagtcataggatagagttccaaggtagggttggggtgggtgatgtttttagatcggtggctggtgtaagaacctgaataaagaatattctagtctaaatgagcttgggataaggccagtatgtctgaagggagcacagctggtggtcaagggcggtggttgttagaaacatattgggaaattccggcaagaaccagattggggtaaggtcttaacggtgcaaggagaggagtttgaatttatttatttatttattttttgagatggagtttcactcttgtagcccaggctggagtgcaatggcgcgatctcggctcacagcaatctccgcctcccggttcaagccattctcctgcctcagcctctggagtagctgggattacaggcatgcgccaccacgtccacctaattttgtatttttagtagagacggggtttctccatgttggtcagg

SEQ ID NO: 124524 - DNA, 480 bp, Homo sapiens
ccatgtgccaagtacagttctaacactgaggatataatatagaattaataacaggcttttttagaataagtataggatttcaagtggtagtaagtattcagaaagacaacatggagtcataggatagagttccaaggtagggttggggtgggtgatgtttttagatcggtggctggtgtaagaacctgaataaagaatattctagtctaaatgagcttgggataaggccagtatgtctgaagggagcacagctggtggtcaagggcggtggttgttagaaacatattgggaaattccggcaagaaccagattggggtaaggtcttaacggtgcaaggagaggagtttgaatttatttatttatttattttttgagatggagtttcactcttgtagcccaggctggagaattgcttgaacctgggaggccgagattgcaccactgcactccagtcttggcgacagaggagactctgtctca

SEQ ID NO: 124525 - DNA, 474 bp, Homo sapiens
ttttttttaactcttaaggcccttttatggctgtttcttagcgaaacctcacaacatgcctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgcttcagaaaagactcagaaattaaatccagtccagtgggtttgatatttacccaaatttccagcctggggagattgatgcacccaagagaagaaccc

SEQ ID NO: 124526 - DNA, 380 bp, Homo sapiens
tgactttttcctccatggagaaaaaggaaagtatcatctcactggggaagcaagcttgggctggaaatgggtcatggtctcccaaatctaagatctggcagaaggttggttttgtatgctttggacttgggccaagtgatatgtttacttaggctccagaagggcctggttctaaggcagccacactgataaatgaatgccttgtatcaagtgtggagaggcttcattatatttaaatccacttaagagaacagctatagaagaatgactgtttaggactgtggctctgttttcttgtttgtcatttagatatttctgccaattataataaatgtggaggaaaaaaaaagccagcaaattgctatagtctctttaaaacc

SEQ ID NO: 124527 - DNA, 1604 bp, Homo sapiens
ctctaccaaaaaccataaatgagacatattagaaacattttctataatttttataatacctgtttcttcaaattttcaacaatgcttagagaagtcggtttcctgggatgagctaagtcctaaaaactatcttaaccagcaggttctttgtgatttttaaaaattatcctttttattatcctaacatgtgacaaaactccccattaattattttttttaaatagttaatcttgctatttgttacatatgtcttcaagagaattatataaaatattttttatgtatatttatatagctgtacctataggtatatatgtatataggtaaggcccagaacttaatgaccagtgtaggattaatgagaacagtgaaactgggctcaggaaatagcaatacgccaacacttcttaattttacctcatttttgtctatttgtctagaacactcaggatatagtatctataggcaaatatttatgtgtttatccttgcaatttgagaaactaaatttaaagctggttaaaaaagagagaagataattgtattcagtataaatgagacttacaccaaattttgtacctccaataaatttgttatagatttaatcagtagattaatttttagaattcctttagaaagttgagtgtttagtgtcacttagggggaagttatttaagttattgttttacttcatttagtaggactcatgatgacatattttaaaattatttttattattttttgagacagggtctcactcttgtcacccaggctggagggcaatggcacaatcaaagcacactgcagccttgacttcctgagctcaggtgatgcttccacatcagcttcctaagtagctggaactacaggtgtacgccagcacacccaactagtttctgtatttttagtagagacaggatttcgccatgttgcccaggctggtcttgaactcctgggcccaagagagccacccaccttggcctcccaaagtgctgggattataggtgtgagccaccacgcctggcctatgacactttattgatttcatatttgaagttccaagaaacaaagaaggaaacaattcacagaaagtagaggttaaggtgaataatatttatgtaggaatttactacaagtttaagcctccttgccaaagtgccacaaaaaagaaagttattgaattttttagtgcatatagaatatgaattaaattgataaatgtcagattacgaaggaccttcaagatcatttagcccaactgcttcttattatggatgagaggctgagatctagacagatgaagtagcttctcaggtcctatgagaatatagctcaggaccctagactcttattctgtgaaatttacaatgcacatgacacctcccaagactgattgttgaaagtccatcaatgtaatgattttattagttctttctaccaaaaaaaattaatagttttaagtcggtttaggaaaacttccttaatatatctagttctctatgttgaaagcactttgaaagtaggattgaataaatgaaatttccttttatataaattacatccatgaattaactcaaatcaagtcagcaagtatttattggatgc

SEQ ID NO: 124528 - DNA, 372 bp, Homo sapiens
ggatacactcagaactgcaggaacacattggtgaaatataatcattgctctgattgccttcatatttacaattaaagttgtcagtgctttcagctaattcctgtttatgccttccaggttcaacatgattttccttgatggcgactgcccaatctctcgaacaggtgaggtcttcaggacttttggttttggggctattgctggtttcattttctttgtcgactgtggaacactagaaatcacaatgtcgggtttaggtgcaataggaggtggggctggcttattatttgccacaacaaacttgggcttgggggccactggtggcttctttatctctaggctgcagaagtcatgattccccggtgcagctcg

SEQ ID NO: 124529 - DNA, 376 bp, Homo sapiens
  misc_feature (368)..(368): n is a, c, g, or t
ggatacactcagaactgcaggaacacattggtgaaatataatcattgctctgattgccttcatatttacaattaaagttgtcagtgctttcagctaattcctgtttatgccttccaggttcaacatgattttccttgatggcgactgcccaatctctcgaacaggtgaggtcttcaggacttttggttttggggctattgctggtttcattttctttgtcgactgtggaacactagaaatcacaatgtcgggtttaggtgcaataggaggtggggctggcttattatttgccacaacaaacttgggcttgggggccactggtggcttctttatctctatgctatgtctggtccgagctgcagctcgcncctgagtt

SEQ ID NO: 124530 - DNA, 200 bp, Homo sapiens
aacaggaaaatggttaaaaaaaactacaggtaatctacccaatggatcattatgcagccacaaaaattccacttagcacagtttataacacgaaaaacccacctgttatgttgttaaatgaaatggcagagtacaaagacataatatgaaaaaagtgactacaaaattcaaaaacatgcattaatttaaaaaaatctatg

SEQ ID NO: 124531 - DNA, 458 bp, Homo sapiens
gcctcaacctcccatgtccaagtgatcctcccatctcagcctcccgagtagctgggactacaggtacacaccaccacactcagctaatttttgttgttgttgttgtacagatggggtctccccagcccaggctggtctgaaactcctggtcccaagcaatcctcccacttcaacctcccaaagtgctgggattataggcatgagccactgtgcgcagctggggccttactttatgtaccctgtagataggatagacagacaacaaatatgcaaaacaaatgaacagacagtgtaatttcatcaagtgtttagtgattaaactaaaacagactgatgtgacagcgagtcagggggtgctactgtggataattttcacgactgacaggaggaggtgatgtttgaagtgggacctacattaagagaagcaggaagccctgcaaggatttgggtgccgtgct

SEQ ID NO: 124532 - DNA, 622 bp, Homo sapiens
cagtataagacattgcttatttctacaatgctgacctcttttgcctagcatggctgaattagctaaacatcatatcctaaggaaaatagtgatattcagaatctacatcacttgaatgaagagctatattcaaccatttcatgaacaattatttagtgattcccaactttgggttaagctccatttggggacatgcacagggttcacagacatgtcaattttcttcctgagaaaattgagaaaagagagaaaatatgactaaagaataatgctttaattgtgaaggcaatcgcacatacattaaacaattagataacaaactattacagggtaaagagctgaactatccactcgaccacagagctcattagagtagattctacctttatttctgaataatgataatattacatggttactgcaaagtgcaaataaacctaatgaacatctacacacacacaaactgccctgcatattgcagtgtaaggcaggcaactcaacaaatagaagctgaataaatgaatgaatgaagaatggtcatatggaaggaattcccatttttctcctcccgaatataacttggtagaatttgaacaactccatgtttctgtttaagtcactg

SEQ ID NO: 124533 - DNA, 838 bp, Homo sapiens
cactgggggtaggcaatgaacccagttgtctttttctgccacttttggggaaaaaaattcttaccagcaaactgtctagaagtgttgaccacttaaatgaaacccacacgattcttattttcttctagaatctaaagtttacagttcttttgtaattttccaaaaagtctttgacagatatatttgaggtgaagcagaactgacaacacacacatacatttgttataagaaactgggaaatatttgacctaaaacccccaatgcattggcatagtattacctacaaggtagatgttcaataatagtgatattcagaatctacatcacttgaatgaagagctatattcaaccatttcatgaacaattatttagtgattcccaactttgggttaagctccatttggggacatgcacagggttcacagacatgtcaattttcttcctgagaaaattgagaaaagagagaaaatatgactaaagaataatgctttaattgtgaaggcaatcgcacatacattaaacaattagataacaaactattacagggtaaagagctgaactatccactcgaccacagagctcattagagtagattctacctttatttctgaataatgataatattacatggttactgcaaagtgcaaataaacctaatgaacatctacacacacacaaactgccctgcatattgcagtgtaaggcaggcaactcaacaaatagaagctgaataaatgaatgaatgaagaatggtcatatggaaggaattcccatttttctcctcccgaatataacttggtagaatttgaacaactccatgtttctgtttaagtcactg

SEQ ID NO: 124534 - DNA, 277 bp, Homo sapiens
gtggtggagccagcagaccacttatcagaccttgctgcgatgagcaaatcccaattacaaaccatccagaccacacgggggaggtcgtgggaagcataagcaaaatttacctacacccccatgtatcataaacatcataaggcggtttgtggcagaattaaccagcaaacaaccccagggtctctctgccccgtataaacccctcattttttaagctcagggctgcctcctctgtctgtaatggagcagccggcaggttgaataaaggtttgcctga

SEQ ID NO: 124535 - DNA, 265 bp, Homo sapiens
gctcttgttaatgcttgataagaacaaaatatttgatgattgaatgaatttagtgtttgtgtgtatatactccatgttaaaaaaaattttctcttctctgaacttttactctccactcagccctgagtctgaatattttcattattttctgggaggtgggaacagtttgcaggaaggaataaggaaaagtttccaatcattctgtgtgtatgagattgaaaaggcgcatgttttgtgtaattatagatacgtcacatgctcacaa

SEQ ID NO: 124536 - DNA, 224 bp, Homo sapiens
agggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgag

SEQ ID NO: 124537 - DNA, 1036 bp, Homo sapiens
gagtgtcgtatgcctgcgagtcgttccatcctgaggcaatgagaagtgctctcctagggtccatttatcaagtgcttctactggcatttgatggaaaggaatttagaagtcatagtttgatacacttcgagcacggccacgttctcctttgcacgtcctgagtatgtatgtatgtgtgtgtatatatcaaccccatgtacatgcttttcagcagttatgtgctgtcaaaagccccacagatgaaacaacaagatacagctgtgcttcgtaatgtaatgagtaaaccgccacagcaattgtgtcaggatcacaattctttaaggcactgcttcctaaaatgattgccggttcatttgcatcagatagggaagatgtgctagataaattcagaatgtcgaggaacagtttgatgttgactgtggcatgatgagggatctttctaaatgatgatactgttagctcgtggctaagacgagactggtctaaacacaacagagacggcagtttcctgttgcagtgagtcatgagaggaaatggataaaatgaacataaattaactgcatttcgttttctaagagttggagagggaagggaaggaggcagtggatggccagtgtgcctgaaaactggaattagatcggtgaactgagaggattggtttctgccctacgttgggtgaagaggggcagtcctcattgctaacagccgcaggttggtgtaattaactaacttccgtaggcaatgcccggtgtacatcttgaaaacccatcagatggggtatttctcactgacatcagcttttaaagggaggagggctcatagttgtatcacagctgcagtacttttctttaaggcaagaaacagtttaaatcagagaaaatttcacaggattctagatcgactacttttttcatctagttctattattttgaccgtatggccgttttttgtttgtttaatggcgtgaattaaagtgtgacatttctgtccatcttttcacgtacaaaatcagcattcgttaattcaggttatgaaa

SEQ ID NO: 124538 - DNA, 164 bp, Homo sapiens
gttttgtgaacagaaacagagaagtcaggaaatcgagggcctttattaagagcttcctccaggccaggtccctgctggggtgtgtgtgggcttaatctcatgtttcagggtaactgttcagtaggaggtggaaactgaggctggacttcggaagaggggaatca

SEQ ID NO: 124539 - DNA, 309 bp, Homo sapiens
tttctactttaaaaagctaagataagaagagcaaatgaaaaccaaagtagtagaaagaaataataaaaagtaaaaatgaacaaaagttaaagtgaatagtgaaaatcgataaaaccgaaacttcactatttgaacagacaatgaaaacaagtaaatctctacccagtctaattaagaaaaagaaaaattattataccaatatcaggaatgagaaaaaagaaatcaccattgatccttaaaacaacaaaagaaaatattaatagaactttggtcaattaaacaattaagaaaacacaatttaccaaaact

SEQ ID NO: 124540 - DNA, 602 bp, Homo sapiens
aattcgccttactactactaacaaattatgcaccgtaagagagaagcaggtgataattggcttgcaacaaatgaaaaggaactggacccttctcacaaaatactgattttcacataatttaatgacttgatgttctgagtatctgcattaaaatgtgatttaaaaaaaaatttaaggtatctgacacctcacatggtcctctaacataggtacaaaaacatattccaaaaggatgtatttaaaatttggctttcaatcctatgataaaagtaaaattctactaggaagaataaaaatatagtactctttgacaaagctacacctatgtgtctaaaagatttatagtgaaaaggtcattcaaagttagataaccagaaaatggctaacacgaacaaagtcacaggttatgttagcagggctgagagattctttattagtaaccaggttaaagactggtatattgactttttaattttgaccccaaagcaggtggcttatccgtgctcttatcacgtataaagaccatctctctggcctgggaatctgagcagcatttggcggctagcctcccaactccatgcacacgcacctctgtgcagctg

SEQ ID NO: 124541 - DNA, 626 bp, Homo sapiens
tatatattacaaatacctattagagatatgtattagtaaatgtcatatacatatttatatatatatacatgtaaatatataggtatttgtgtgtatatgacactatatgaatacaaatcacaggcatatacttacacacagatacggagtcacccaaggattccctataaggccatggacaaaaagcatgtgtctcccatggtggactgaattgtgtcacccccaaaagatacactgaagtcctaaccctggtacctgtgaatatgaccttatttttgaaataaaaatatatttgcagatgtaattatgatgtaggtggagatgagattattctggagtagggtgggccctcaatccaatacggctggtgtccttataagaagaggggagaggaacagagacagacactgtcatccacaaggagaccaccatgtgaagacacagatgcatagggaagggccacgtgaagatgacagcagtgacgggagtggggcagctacaagccaaggaatgtggaggagtgccggccaccaccagaagctgagaagaggcaaggaaggacccttccccacagcctttaggaggaacatggccctgccgaaaccttgatatcacacctctagcct

SEQ ID NO: 124542 - DNA, 333 bp, Homo sapiens
caaagggctgagtcattcatgcagcaccacatggaagtaagtggagggccctggagctcctgatgcctgccattttcagggaggaagttagaggcctgccgggaacaagtttggacgctggcttattacctttcctgttctaaccagtcaggcagttaaattaattgagtgtctatcatgtggaaagtatgcaccggatgctgttgggaggggatgcctgtcttccttgttgaaaagctcatagaccatcaggaagttaggacacacaccagaaaagtcagaacatagaattgacgtttcattactgagtgtatttttatggacacttccttc

SEQ ID NO: 124543 - DNA, 288 bp, Homo sapiens
agcctattgaaggtaaacaaatcgttgggtatttctgaccttcaacaggattgcaaggaaagcattaagaggcgatggttaagccaatgctcaggattttgaattctcagattgaagactttccgaatacgggcgtgagtccatgagaaagtttcctaatctctccttacacttaccaccagggagccagacccaattattcttggccaaagaacaggagccttaatattaatagtagatgagacctggtaggtgtcttagaaacttaaaatgtggccaagtggaata

SEQ ID NO: 124544 - DNA, 429 bp, Homo sapiens
ctgtgtcctaatctgttcttatgaaaaccccagccagacttggttagagcctaccctcatgacctcgtttcaccttagtggtctccttaaaggtcctgtctccatgcatagtcacatcctggagtactgggggttaggacttcagcatatgaatttagacaattcagtccataacaggggtgcggggccaagggcggccttgtggctggctcagccttctgtttccatgctgctcttaggatcatggaactggaagggacatgaggaatgttccagcccaaacccacccacctgcacaaagggggaaaccaaggtttagggaaggaaaagcagctgtccagggccaaggagaggatgtggcagagcccgaacctgagccctagtccccagactgtggacggtgcagatcctagtatttggaacagagac

SEQ ID NO: 124545 - DNA, 202 bp, Homo sapiens
actcacggtaagtatgaaaacaccaacaaagaattccgttaaatcgggagggaggaagggaaggtcgggtagagacacttttaaacacatgcagaacttgatgaggtagtcttgaaaacgcaagccttctgggaagaaggagaaaaagaatgaaagggtaccctctgttggccgggcgcggtggctcacgcctgtaatccta

SEQ ID NO: 124546 - DNA, 712 bp, Homo sapiens
atcaaaaagatatgacaattacatatgtatatgcacctaactacagaataccaaaatatgtcaaacaaaaactgacataaatgaaggtagaaatggaaactgtaataataatagttgaagacttcaatactctgctttcagtaatggatagaatgactaagcagaagatcaacaaggaaatagaagacttaaataatactataaaccaaatgcacctaacagacatctatattaacactctactcaacaacagcagaagcagaatacacattcttcccaaatgcctatggaacgttctctaagacagaccatatgctagcccataaaacaaacctcaataaatttaaaaggacagaaataatacaaaatatgttttctggtcgcaatggaatgcaaatagaaatcaataacacaaggaaagttggaaaactcacaaatatatggaaattaaacaacacactcctcaataaccaatgggtcaaagaagaaatgaaaatggaagttagaaaatactttgagatgaatagacatgaagataacatgaaaacttgtagggtacagcaaaagcagtgattagaggaaaatttatagctataaatgcctatatttaacaagaagaaagatctcaaatcaatacattaaaaaactggaaaaagaagagcaaactaaacaaaacaagcagaggaaggaaataataagtattagagtggaa

SEQ ID NO: 124547 - DNA, 561 bp, Homo sapiens
aacccctagcccctggaaaccacccttctactcaaaagaacaatctagccttgcctgggatgaagtgcaagaaacactcctgtggatacaatctctaccccagccttcacttcctgtttctgcacttcagagcctctcctgtggggcatttctcctttctcctataagttccactcttccatcttctcgtttatttgagctgttaagctcaacattaggtgttcacatatgggtcagggtggtgagcatgtttttgcagtagaaatgagaaaacagctgggcaccggtggctcacgcctgtaatcccagcattttgggaggccgaggcaggcggatcacaaggtcaggagatcaagaccatcctggctaacacggtgaaaccccatctctacttaaaaaaaaaaaaaaaaaattagccgggcgtggtggcgggcgcctgtagtcccagctactcgggagtctgaggcagcagaatggcgtgaacccaggaggcggagcttgcagtgagccgagatcgcgccactgcactccagcctgggcgactgagcaaaactccgtctc

SEQ ID NO: 124548 - DNA, 228 bp, Homo sapiens
agagatcagagtgttcatgatgaagtgagaatagacaggagtgatactacgagatttctttggaaggaggcttagcagaagccggaacaccaaagaccatataagggctaagacattcagtgcattcttgctgatagtgttgagtgctcttgactttccttaatcctaaagatcattgttagaaatattaaatatgtgtctagcacatcaattactatgacccagatc

SEQ ID NO: 124549 - DNA, 436 bp, Homo sapiens
gtaatgttggcagctgacagtgctcagctgagaccctcttcgggattgcctgtggctgaggagaactaggatgcccaaggtaggagcagtagcaacccatatccaaagacaggttgatgctgggacatgaaggcctggacctttcacccggcttggatccactttgaacgcccagccccgttgcagagcatcctcctggatcagtcaggcttttgtttgcagctgcatcagaattcagcctctccctctgccctgttttactgcctgtattccctcacaggtgttgccccagagcactctgaataaacttcctgcctgtgaatctctaccagagagtcagcttcctgcacccagtgctctataaggtttctaggcaacaggaaatgccctaaaggccagaattcctctcgcgggtatagcagagagtaaacagagt

SEQ ID NO: 124550 - DNA, 511 bp, Homo sapiens
aatttaggaaggcagtgctctatctggtgagcaaaaagaaacaaatctccatggtatgcctttcattaaatttttgtctgattttcagctttttctttgtggtataaaattataacaacatatagaaaagagtggagctaaagttgaacacttggccatctcctgtaataatacacagtacaaggtaggagttacttattggctgactgctctgttctttagtgcttgtggtattgcctccaaaattaatgaaacagacgccaacataggagtcccaagatcagttagcaagctgcactacttagccctatgactgtcatcaaataacttaccctctctgaatatagatttttctcatctattataaaatgaaattggaaggaaaattgaacaaattgcacagtatattctttaaggttctttccagctttaaaatgtaattatataatacagtaatacagtgattatttttcttcttaaaccttgttgaaaaatcttaggcctaatgtac

SEQ ID NO: 124551 - DNA, 486 bp, Homo sapiens
ggtggggttattagaggatcttcaagccagagaacgccaatcttgggagacacaggcaggagaacagactagtactatttccactggaaagggaggttcagagtagcttgggagtccaagattctcagtttcagttgagtctgaccaaatatccccatcccaaatctcagggtcacactttttctcattcagtgctttcaaatgagactaggtgtctgtggaattcaacttaagttgtaattctgcaactggcacatttaaatctgatgttagcaaggtgaactccatggctataaaacataaaactttttactggggctaccacggaagttctctggttctctcatggtaaatgtgagctgacagtttagtgatctgaacttgccgtttttattctataagtgctccagtatattcagaagaagccacagcttagcacagtctttgtactcatcatttctgccaaactcaaatgtagccaccatt

SEQ ID NO: 124552 - DNA, 456 bp, Homo sapiens
acgggggaagaatagtgcctgttcccatcaatcagactggaaaatctaatgattcaagaagcactgagtagggcacacagaatggtcttgtgtcagcagtgggtaataaccgacctgagactgagcccttatcaggttctgcctaataaatcttaaaagcaagaccctacaggattaaacggtttcccactagcttaactgtgtctcaaaacaaagctcactatttacagaaatagaagaatatctagcatccaacactgtaaaattctcaatgtctgtaatccaatcaaacattatcaggcgtgcaaagaacctgaaaaatactacctagagtggaaacataaatgaatcagttgaaaccacccacagataacatagatgttaggatagcaaacaaagacattgaaacagttatgaaaaggctgggcacggtggctcatgcctataatcccctat

SEQ ID NO: 124553 - DNA, 552 bp, Homo sapiens
attgggagactgcctttgcctagtagcagctgttattattttagagagagagttaacaaccacctgaccatcacttgatggtcacctgacattcctggttttggcaggggctctcttgccctgtttatgtccaactagctacctacagtaacaaaaccacacagggccaacgggggagttaccagggtcagtcaggaggcagtaggagtggggaaaaacataggcaagatagttttcatggtaaggaaagggtaaggtgaagtaggcaagctaagcaggtttaggattgaatagtttgaataattttggtgggctctgggctataggggtggcccctagttttccagtatctggtcctcaaatgatttagagcaggggtaacattggcttggtgtatgagaattagataaaggaggtggttgcagttatggctggtttgcatatgaaaggcatgctctcggggaagttgtctgttacctctaggaattagcttactatgggagggggagcccttccctgcattcacaatgccccaagatgtcgaagcgtcat

SEQ ID NO: 124554 - DNA, 148 bp, Homo sapiens
ggggttggttggacttgggggacgggcacaggggtggctggattatggtcaggccagcaggaccttctggccagggctttgcttccgtattattaagtatcatgttttaccaaagaagcactgatacagaccccccactcccccactt

SEQ ID NO: 124555 - DNA, 134 bp, Homo sapiens
gcatgtaattttctaccatactggccaatgctaggcaataatcaacgttaacatatttttgccatgctgacagacacaaatagtatattttaatttcatttacctgatcactagggaggccaacacagactata

SEQ ID NO: 124556 - DNA, 391 bp, Homo sapiens
caaccccttaggatccctttccttgtagattcttaaggtttatatctctaatttggcaatatctttgcagggttttcttggggggtgggtcacgctttgtgatttaacctctggattacatagaccttgaaaattaaacactgcctttaaaaaaaaatctcagtcatagttaaaaggaaatagttggcacttatatcattgatatggtttggcagtgtccccacccaaatctcatcttgagttgtagttcccataatccccacatcatgggaaggacctggtgggaggtaactgaatcatgggggcaggtttccccatgctgctgttcttgtggtagtaagttctcatgagacctgatggtgttataaggggcttttcccccttttgctaa

SEQ ID NO: 124557 - DNA, 219 bp, Homo sapiens
taaagcacaaaaatcaaaaccaggaaactgaaattctgtaatgtatgtatgtagttctatgtcattttatcacatgtgcagatttcttttaccaccatgatcaaaatacctaactgttccctttcaacaaaaatccttttattctacccatttatcattacctccacctccttttcagcatccctcatccttggcagctactaatttgttgtccctatc

SEQ ID NO: 124558 - DNA, 532 bp, Homo sapiens
ctgcctcagcctcctgagtagctgggattacaggcatgcaccaccacccccagctaattcttatatttttagtagagacggggtttcaccgtgttggccaggttggtctcgaactcctgacctcaagtgatctgcccaccctggcctcctaaagtgctgggattacaggtgtgagccaccatgcccagctagttttgaattgtttaaggccacccaaacatttaccttatgaagttataggatttggaataaatgttacaggagtaattctactttctcatcctgttcctcacctggaatgtcacataagtctaaacggagaaaaggacccgaagataaaggaacagctagaacaggaagtgcgagcataagaattcaaacccagggagctggcacaatgagtgccccgtgcccaggacaatggaggccacttgtgtctgcttggagccccaggcaagccatccacatttccatggcacaggggtgcagtcgatgagctgcattagtccttcgctgggctgtgtttctatta

SEQ ID NO: 124559 - DNA, 147 bp, Homo sapiens
ttgtcagaaaggaagaaaaatttttggtttcaggaaatagagagggttttaagagtcaagttgatatgtagtcaattttttttctttctttttttattaacctttcctatggtgctgagataaatactcaatttgatgtggagataa

SEQ ID NO: 124560 - DNA, 750 bp, Homo sapiens
atattttcttctccattgcacttttcttctgacttcttagatgaggacaggacttaaaaaaaattgtatttttattttctgctgtttccccaaaatatttttcttgttttgtttcttaaagaccatgtcttgttctgtcacccaggctggagttcagttgctcagtcatagctcactgtggcctcaaactcctgggctcaaaccatcctcttgcttcagcttcctgagtagctgggactgtgagcacatgccaccatgtttggttatttatttatttatttatttattttttgggtagagacagggtcttgctttattacccaggctagtcttgaactctcaccttgacttcccaaactgttgggattgcaggcatgaacgccgcacctggcctgttgatttggggtggagcgttctgaaattgaggcagtaattaatagcctaccaaccaaaaaaagcccaggaccagacagattcacaactgcattccaccaaagttacaaagaggagctggtaccattccttctgaaactattccaaataatagaaaaagagggactcctccctagtccattttatgaggccagcatcatcctgatactaaaacctggcagagacacaacaaaaaaagaaaatttcaggccaatatccctgatgaacattgatgcgaaaatcctcaataaaatactggcaaactgaatccagcagcacattaaaaagcttatccaccacaatcaagttggcttcatc

SEQ ID NO: 124561 - DNA, 3936 bp, Homo sapiens
agcggcggggggcgggaggctgcggcttcgggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124562 - DNA, 2483 bp, Homo sapiens
agcacgaggctcacccagacagaagagaccacggtaaagatcagctgacggcctctgtgggaacaaagacagggaaaggggaaatgagttcaccagaaaccaacaggcagcacaggaggtggtaaacccgaaaaagaaaatgaagaaaaagaaatacgtgaattctggcacagacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124563 - DNA, 3922 bp, Homo sapiens
agcggcggggggcgggaggctgcggcttcgggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtctttggatggaaagtttgagaaccactggtctggaagcctccggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124564 - DNA, 2718 bp, Homo sapiens
tcagcgggccatccccgagccagggccctgggctcctccctgacgtgcagggctggctcccacacccaaagccctcagaccctcaacaagcagtcttcttccctcccctccaccctgccggggcctgagatccagggagcaccacactcccacctccccgctcctccacccctggtaaatccacagtgcagctccatgctgagcttatgccccttctgcagtggccaagaagaaggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124565 - DNA, 2908 bp, Homo sapiens
acagagtttcccaaagactggattttgctggctgcatctcctgtggtgtcatttaatgtgttcctctgtcccttgtatttcctgtaactaactagacagctctggagcctcaatcagaatcaggttcaattttttggtaagacaacttcatgggtggtattctattctttctttaggagatgcataatgtctatttgactctcttttttgtcaaatgagttttcgtcctgaatctcactccaaatttgagtcagcaatccaatgagacccaacctcacccagcctacacaggtgggcccagggggtagggtttgtggaggaaataagtgaccatagccacatgcccacacagaacacaatcatcttcaaagagctttcctactgcataactcttctgatgctcattaatcctgtaaggggggcatagctggcattactatctcagctctccagaactagaaagagatgaatgacttcaccaaggccacacacctggcaagcagcagagccagggtggtagccaatgtctagcactgtcccccctcccacagccctgcctccctccaggtgactcccctgctgttctccctcttctaggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124566 - DNA, 2586 bp, Homo sapiens
agcacgaggctcacccagacagaagagaccacggtaaagatcagctgacggcctctgtgggaacaaagacagggaaaggggaaatgagttcaccagaaaccaacaggcagcacaggaggtggtaaacccgaaaaagaaaatgaagaaaaagaaatacgtgaattctggcacagtcaccctgctttcctttgctgtggagtcagagtgcaccttccttgactacatcaaaggaggggtatcagtttcctcctctgtacacaaagagaacggaataggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124567 - DNA, 2228 bp, Homo sapiens
agcggcggggggcgggaggctgcggcttcgggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtctttggatggaaagtttgagaaccactggtctggaagcctccggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgatgctgcccctccatgtctgaagctgcctgcccacagctggccctggcttccttgttcctgacaagacgcagaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgtaagcaaggagtgtgcggtggg

SEQ ID NO: 124568 - DNA, 855 bp, Homo sapiens
agcacgaggctcacccagacagaagagaccacggtaaagatcagctgacggcctctgtgggaacaaagacagggaaaggggaaatgagttcaccagaaaccaacaggcagcacaggaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccaggtgaagcccaggccttgcctgccccatgg

SEQ ID NO: 124569 - DNA, 3466 bp, Homo sapiens
gatcatggtgaggatcagtggggaaggcgctttacctcgaagaaacttctggtgctacacgtgtgtgtgttgtggtctgtgcctttgcagcgggggaaactgaggccctaagagacggtgtctcaacatgtggtatttggacggctgccatcagagacataatagggggatctctggcggccacttggataaacatggcctctggagccctgcttcagacctacacagccagacttggaacagagcccaaggaactgccattttataccccggggcaggggtgagccccagaagtgcgaggcccattgttcacggggtgaagccacccgtccaaagccaaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124570 - DNA, 2545 bp, Homo sapiens
agcacgaggctcacccagacagaagagaccacggtaaagatcagctgacggcctctgtgggaacaaagacagggaaaggggaaatgagttcaccagaaaccaacaggcagcacaggaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124571 - DNA, 2780 bp, Homo sapiens
tcagcgggccatccccgagccagggccctgggctcctccctgacgtgcagggctggctcccacacccaaagccctcagaccctcaacaagcagtcttcttccctcccctccaccctgccggggcctgagatccagggagcaccacactcccacctccccgctcctccacccctggtaaatccacagtgcagctccatgctgagcttatgccccttctgcagtggccaagaagaaggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaa

SEQ ID NO: 124572 - DNA, 2434 bp, Homo sapiens
agcggcggggggcgggaggctgcggcttcgggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtctttggatggaaagtttgagaaccactggtctggaagcctccggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtatgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccatcaaggtggaggtgtatgactgggatcgggacggcagccatgacttcattggggagttcaccaccagttaccgggagctggcccgtgggcagagccaattcaacatctataaagtaataaacccgaaaaaaaaaaa

SEQ ID NO: 124573 - DNA, 1432 bp, Homo sapiens
  misc_feature (1411)..(1411): n is a, c, g, or t
agcggcggggggcgggaggctgcggcttcgggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacggaaaagctgttactctgaagcgggctctgggatgaggaatccaaggcttctcacagtggagcctgatgatgtcttcagggaccagccagggctggccgtgtggtgagggtgacctctcttgtccctatttctcaggaagtaccaggggcagggcccttgcctgtataaacgattcttacctttccccacactggggaacactggtcaccattctttggtgtccatatttctctggacggccaccctcacactttgcatttaaataaactaatttaactggacattaagacaaaaaaaaaaaatgtagggcgaccgcaagattattcccactaatcaaactcaccgaaaagtntggcagggtttgatcaaaaaa

SEQ ID NO: 124574 - DNA, 103 bp, Homo sapiens
tgctgggattacaggcatgagccaccgtgcccggccagagaagggttttcaacaggaagcaagtgcagagattgagattctttgaagctattgcttggagtta

SEQ ID NO: 124575 - DNA, 638 bp, Homo sapiens
cacatatatatttccacagggggaaaggatcaaaaaggaagagcatcaaggtgtcatctattatgctatattttatttacttataaaatgaaaatgattgggaaattcacgtaagatagcagtggtggttgcaacatagctttgggacattcagaaatccttacataaaatgaaaagactaacttgatagcaaaattaaaatcacatggataccatttattagactggtgcaaaagtaattatggtttttgccaattaaataaaacaaaactcagtcaaaatgtcatcctcattaacctcaaagcagaaatgagagagagcacaccaccaatggtcaatctacacactatcagcatgtgtgcagaagaaacagagggaagcaatgcagcaagttaaagccatgaaaacaacagaacccacaggatttattgaaaatcaatgtgaaaacagcagagaactgtgaacatttatgcccacactaataatgggtggatgcaagggctctgttataaggctaaaggaaataaagtctctgaaacctgctgaactcttgaagcttaaaatctgccaagttttcttaccattcaggatgaggggattccacatacaagagtaactgctgaccctgtggaaaagta

SEQ ID NO: 124576 - DNA, 592 bp, Homo sapiens
cgggtctctatcatgttgtatctatctatctctatcactgaaatgattcgtgagagtgctcctctaaaatcaatgtggggtggctgcatacttgtggggtacattgacatatccttacgtcgtgagtgaaaactaacttgatagcaaaattaaaatcacatggataccatttattagactggtgcaaaagtaattatggtttttgccaattaaataaaacaaaactcagtcaaaatgtcatcctcattaacctcaaagcagaaatgagagagagcacaccaccaatggtcaatctacacactatcagcatgtgtgcagaagaaacagagggaagcaatgcagcaagttaaagccatgaaaacaacagaacccacaggatttattgaaaatcaatgtgaaaacagcagagaactgtgaacatttatgcccacactaataatgggtggatgcaagggctctgttataaggctaaaggaaataaagtctctgaaacctgctgaactcttgaagcttaaaatctgccaagttttcttaccattcaggatgaggggattccacatacaagagtaactgctgaccctgtggaaaagta

SEQ ID NO: 124577 - DNA, 458 bp, Homo sapiens
gcttcgataggcccctgtgtctgttgttctcctctttgtgtccatgagttctcaccacttagctcccacttataagtgaaaacatgcagtatttgattttctgttcctgcattagtttgctaaggataatggccttatctcaaccttttctaagcctacttttatgttcaggctggcctatctcctaggataatcatctcctaagttccattcccatcaagaaaagcagcactacacgaatgcaaccctaataaagccaagatacatattgttcagtccccatataggtcatattttaaaaaggacagtctgaggggaaaataagtctcaaagaaattcatgtgtgaagtgaaataggccaaacacaaaaggacaaaaatattgtctgtgtccactcatatgaggtacctagaataatcaaattcatacaggcagaaagtaaaataatggttacgggg

SEQ ID NO: 124578 - DNA, 599 bp, Homo sapiens
gaggaaggggacagaaggggaggggcccagtaagatctctaactgcagagttatcaattcattctttgtattactaggtaccctttaaacaacccagttttaaacctccattctcaatgatacttactctttcataataaatgcctatcctgacactgtactttattagcttagcatattcatatgcaattaattgattcagcaatttcacatgctttaaattgtatgctctactagtctctgccaatagcacctgaccacatggcaggggcagcctcctgctcatcctagcaggcattcagcattcagtggttaaaggagttgtctctccaccaacataagagctggccccgcctggctcctgacgctccacagtcacaccagagagcaagctccccggcaggaagggacattccttcctccctcatgatggaactccaactccctcaaggacagttcacactcatctcctctgtgaggctgagatttaatgggttccagccaggcatggtggctcacgcctgtaatcccagcactttgggaggcagaggcaggtggatcacttgaggtcaggagtttgagactggcctggccaacgt

SEQ ID NO: 124579 - DNA, 567 bp, Homo sapiens
gaaggaaggaaggaaataaaatattttccattgattacccatgctttttattttgaattaatagtgttcgatgcgttattaaaaaatagaatttaaaataaattgtagaaaatatggagagaaatatttatgtttcaaatttcccaagagtagggctttggtgcattataatcccctgatagctggcatgatccactttgttggttacttttacagggtccttctactctcttccttagtctccaggcttttaataatcacacagaatattcttttcactacagaacatacctacctacattttggctgtttctcaagctgacttatttcccagacatattcatcctttaagtacgcaaaaatgactttcataatatttccattgataggcaatacacaaatatgtttaaatgaaggaataatttattgcattgtactttaaaatccacattccttgctatacataatctgaaaccactataaaagtacacttttttaatgcaacagcaggcatacattttttccagtttgatgtaggcaggacctcagataatgtcacagtaaaga

SEQ ID NO: 124580 - DNA, 350 bp, Homo sapiens
ataggccatcatcctgtttgtgaataaagacagttttactgcagtttgcacaccttgtatttctggatctccactccagattgagtggaagtggtgaaagcaaacatctctttgccatgctctctctcggggggaacatatcagcctttctttgttacgtgtgatgtcacttgtagtttttgcatggctgcatttgaccagtttgtagaagtttctatctatgcaagtgattttgtgggtgttcttagttttgttcatatggtgtattgcatcagttagtgttccagtattgaaccacccttgcattcctgggagaaacctcacttggtcattttgtattacagtgttta

SEQ ID NO: 124581 - DNA, 400 bp, Homo sapiens
actaaactgctccaggatctcaatctaaaagtactttcttttcatttaaaaagaagtgttgctattttcttcttatgtaagcaataaatgttcattatggaaatattagaagatgcagataagcaaaaagaagacattaaaatcacccataattctatcacccaggaataactactgctggtgttttgacttaccaccttctgggttatctaacagtgtgctgtgtttatatgtgcatgcctgtgacacatgtgtatatcctgcatacgtacagcttttacaaactgtacacatctgtcctcttcacttaaaaacacatcttggccaggtgcggtggctcacacctataatcctagcactttgggaggccgaggcgggcggattacctgagttcaggagt

SEQ ID NO: 124582 - DNA, 365 bp, Homo sapiens
aagttaatcatagaagtcaaactttgcttattgttatgagtctctagggagtacttcaactcatttgcatctgtttcctcatcttcaaaatgggacagtgtaattctggacctgggacatagtaaggattcaatgggtggcagctgtgacaagagcaacaacaaaaatattgtgcgtctttcttttttttaataatggcacaaaaaggcaaaaccatagatacagtaaacggatgtgtggttgccagtgtttggcggggagagggttcaataagtgagcacagggggttttttagggtgaagaaatgtgggtatatgactgtgcattggttgatatccattaaacttaatagcacaaaaagtgaa

SEQ ID NO: 124583 - DNA, 391 bp, Homo sapiens
gaacagctaggggcttggcagacacataactaaggctagcacaatgttctaactatgtcagtaatgtggccctatgaggtgttactgtcagtcaaactacatgaaagatatccagaattcaatcagatatccttttaatagctgtacctacgacttgtactgacctgagaagcataaaagaatggagaattcctcccaagttcaaagattactggagttaggtggaaagatatttacttattttaagaaatgaaaactctaatcacctgcatgggaatgtaaagtacctgggagggaactgttttccttaatgaacagacatctctcaactcccaaatcatttagagggatgcttaaaagcagcaagaccactgaatacattttccatgtt

SEQ ID NO: 124584 - DNA, 537 bp, Homo sapiens
gggtgatactggcttcatagaatgatttagggaggattctctctttctctatcttgtgaaataatgtcaataagactggtaccaattattctttgaatgtctgatagaatttagctgtgattccatctggtcctgggcttttctttattggaaattattttttgttaccatttcaatatcactgcttattatcactctgttcagagtttctatatcttcctggtttaacccaggagggttgtatattttcaggttttctactttatgcacataaagatgttcatagttgcattgaatgatcttttgtatttgtgtgatatcagttgtaatatttatcattttgtttttaattgaacttattttgatcttctctcttcttttctttgataatttcactaacggtctatgaattttgtttattttttcaaagaaccagctttatgtttcatttatcttttgtgttgttctttgtctgtcacaatttcatttagttctgctttgatctttgttatttcttttcttctgctgcattcgtgt

SEQ ID NO: 124585 - DNA, 327 bp, Homo sapiens
ctgtagcacaaggattataaattatctttctctagggatgtgtcagagttatactttataaactcataatcacgaagttacagataatctagtcctgtcatatgcatcgtgtcatactactatataccttgcctatttatttttattggatatataaccatccaatgaatggactaatcctaatttactcagctatttctcttcacataatattgttcacttccacattttcattgttacaggtaacagtccatattttttatcattttccataagctagagccccttatatgaaattactgaattaaagattatgaactaacattt

SEQ ID NO: 124586 - DNA, 931 bp, Homo sapiens
gagccaccgctcccagccctaagcttcgtttgtaagtgaactacttcaaaaggttccaattaaaagtttgcttttaacttttcctcctagattttgctctctcacagcctaatttcacagtttctagtgttcccttcccgaggagagcatgaagcaggagctgcagaacctgcgcgatgagatcaaacagctggggagggagatccgcctgcagctgaaggccatagagcaccaggaacccaggcctggcttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttctgtacaaaaattaacacaaaacaccaaaacaaaaaaaaaaaaaaaaatctttgggccgtacagggccttaaaaaaacttttaaaaccaattcttttatgggggaggggggacccaaaaggagaacaggaaaaccgggcgacaaggtcgtaagccaagagagacccgtcgacactcagaactcggagtggagattccacagcaaaaaaaaaacagcccggggggaacaaccaagattcgtgaccacaaccgagagggaggatccggggctcacaggggactctacaacaggggacaagagaatcgataaatagcccgacgctggcgaaaaaacgaacaacaccagacaccaagtaagaagcaaacaaaaaaaaccatccgcagatgacacaacgcacaaacacacagaataccgagagagaccagccaaaagcaagaaacagacaacagagcacataccaaagcaacagagcaagaaaatcagacaacaagaaa

SEQ ID NO: 124587 - DNA, 280 bp, Homo sapiens
ctgacacaaagacctacgtggtgcctgtgacacggctaataattactgtgtaatgaacccgttgccgcagacaaagatttccttttcttttcctagtttgtccttccttccttcctttacctcccttcctccctccttccctccttccttccttcctccatgaatctgcatgtcaagtaagtgtttttattcagaaaggccagcctggtgatggtgggatgtctcagcccctgtgtggtggaaacagagtccatgctttctgctaacagcccagagatag

SEQ ID NO: 124588 - DNA, 885 bp, Homo sapiens
agagatggggtctcactatattgcccaggctggccacaagctcctggtctcaagccatccttccacctcagcctctgttgatacacaaaagtctttcattttgttgaagtccacttgtttgttattgttgttgcctgtgctttggtgtcaaattcaagaaatcattgccagatctaatgtcatgaagctgctaagagttttatagttttggctcttatgtttaggtatttggtcattttgagttatttttttttttttttttttgggaaagggggtcccgcccggcacccaggggggggttgggggccggaaatctcgcccggtctggcacctccaaaaggtgcggcacacaggagtggaagtctcgcgtgttcctaaaaaacaataacaaggcaacaacaacacttgttttagaagcacggcttaggcaagggggtcacattgtcgtgtatccccagcactgtgggggaaggccacacggggaggatctctctggagccccggggagttcacagaacatacccggggacaacactttttcactatgcactattatataccgcttatagaattaaaatacgtcttttacctttagtgccgcttataactattatgaccatttattgcacgtttagtaacctatttttgattaaccgttttttcgccattttttcactaataattgcgagattaactgactaagtagttgtgagaaaatgtcaccgatcgtagtcggccatggttgtcaacgcttggcgggaacatgcgcatacatgttgggacaaaatcatgataatataccgcgcagcgctaatattagagcaagaggtgacatactacccaggataggccaaagatgagaacacgtgaaacaggcacactaga

SEQ ID NO: 124589 - DNA, 359 bp, Homo sapiens
cagtccatcttataagatatcttactgtaacctagaagatatcgtactgtatcacaacaatctcctagtaggagacagtgtaccgtatcctaggagaggggcacagtccatcctaggaggtatcttaccgtatcctagaagtctcctagtgggagacagactactgtaccctaggagagggccactgtttaatttatttgcatttcctgccagcacctggcgtaccaacaacgggtattcagcaaagatttgcggaatgccagggtacgaatgaatgtccagcactctggacaactcggaacagggggtttccgtgaagagcaagtctcatcacctgccacctccaagatcccaaagcc

SEQ ID NO: 124590 - DNA, 471 bp, Homo sapiens
ccacacacaatcagggacacaaagggacacgtgtacatttacatactctcctagcaggcagttcatacatagtcacgcctaatcatacacagccacgggcactcacacaacacagacacacagtacagtaacacttggacacttaaattctccctgtagtcacatgtaggacaaaatcaaacatatgcttatacagacacacatactaacaccttgtaattgcacataatcacagccaagtacacaaccacaaatatgaagctgcaaaaactctacatcagacatgaccacggtcacacacaaccatcaatccgcagagacacaccaacacagacacacgatcacacatcatcaattacagccccacacacccaaccccaattaacagccatacactgtcaaccactcatctggtctcagcccagtgttcgcgagacgcaggggttgagggctacttccaggctctgtaga

SEQ ID NO: 124591 - DNA, 461 bp, Homo sapiens
ttctggccctggctgcacctaggagtcacctgggagcttaaaaacacactgatgattgaggtctccttacagatcttgattgaatctggctgaggcatactgtgggtatctggacttttaacagactttgattgaatctggctgaggtatactgtgggtatctggatttttaacagctcttgattgaatctggctgaggcatactgtggttatttggatgtgtaacagctcttgattgaatctggctgaggtaaattgtgagtatctggatttttaacagatcttgattgaatctggctgaggtatgctgtgagtatctggatttttaacagatcttgattgaatctggctgaggcattctctgggtatctggatttttaacagatcttgattgaatctggctgaggtatactgtgggtatctggatttttaacagctcttgattgaatctggctgaggca

SEQ ID NO: 124592 - DNA, 720 bp, Homo sapiens
ttaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgt

SEQ ID NO: 124593 - DNA, 151 bp, Homo sapiens
ttctatgggacagttgattacagaacattgggaccttccctgattcaggttagtggtcccaggtgacccaggatagctgcttcactctggacattttctcttacatacatttgaaatgtgacggctttgccaaatgagacacattatcttt

SEQ ID NO: 124594 - DNA, 352 bp, Homo sapiens
gacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgac

SEQ ID NO: 124595 - DNA, 251 bp, Homo sapiens
cagtcccataacttcccttgactccttattttactgttacttttataattttaactattaactcacctttaataaatgatgatgttgtgcagtttatataactggtattatttgtatagtagttctcttcattcacaaagtacattaccattaccaaagatatttctaaatatatgagattattttactcctcagtacaatttctatttctgcccagattaccagattaccaatcatttctcagtttctca

SEQ ID NO: 124596 - DNA, 238 bp, Homo sapiens
ttaatcagggtcaaaagaaatggatccctacatctgtgagttcctttagcatgataagcagcacattagaatacttagctagtagaatatgtttgtatcctctgtctcctgaaatcaaataaaattagaaaatcaaatacaccttcaaaattctggagtatgtgaaagctatgtgaactacattgaaggctcattcatctttcctgaaaacagaattcatgtgctcacagcaaggtcg

SEQ ID NO: 124597 - DNA, 596 bp, Homo sapiens
atgtagccaagagaaaggataaaggctgagctgtttgaagtttccagagaggactgaggaagtcaacctgggtccttcttgtgtggaggtcacacttcgcccaagatagcagaggccgtttaaactgagatggatatatttaccctttgtttgatgccaggagtatgtgatcatgaattgttatgtggctgtgtgtactacataccggtgtgttcacaagggtaggtataactgagctgtgtgcataagtgaacgagtggcctttgggtttagtgtgagcatctgaatggtttggtgaagggatgtgcacgtgcatctttaaccatttacccatcaagcctctcattaagttaagacaggttacggaaaagaattccactaggtgagagtatctgcagacaggcctacagcccacaccagaaaactgggaatcctcaactcgccccactccctgatccctcatcatccactgaatccatgctgccactcccaccatcagcccccatcaactctccctgggctgctgctcagccttcaatggcctcccccaaaacccttctgaatgaactgcagcaatagtgatgacggtaaaatga

SEQ ID NO: 124598 - DNA, 341 bp, Homo sapiens
caggactagcttagaaatattgttaaggaaaaacttcctgtagaatgaggtcatcacaattcctgcatgcccccaggtggaagcccaagggggaaaacaggtgttttttttgagacggagtctcactcttgtcacccaggctggagtgcaatggtgcgatctcggttcactgcaacgtctgcctcctgggttcaatcgattctcttgcctcaggctcccgagtaactgggattacaggtgcacaccaccgtgcctggctaattttgtatttttagtagagatggggtttcaccatgttggccaggctggtcttgaactcctggcctcaagtgatctgccca

SEQ ID NO: 124599 - DNA, 929 bp, Homo sapiens
cctgtagtccctgtagtctcagctagggagactaaggcaggagagtcacttgaacttgggaggtggatgttgcagtgagccaagatcacaccactgcactccagcctggacaacagagagagactccatctcaaacaacagcagcaacaacaacaacaacaacaacagaacaaaaccaaaaaactagtattaaatacctagtagtaaaatatctttttaatcaaacaagttaaaaatctctacaataaaaacaataaaatattgacaaaagaaattgaagaggacacagacaaatggaaaagatattccatgttcatgatttggaagaatcaatattgttaaaatgtccatactacccaaagcaatctatagattcaatgcaatccctatcaaaataccaaggacatacatcacagaaacaacaacaaaaaaatcctaaaatttatatggaacaacaaaagacccagaatagccaaagccatcctgagcaaaaagaagaaaattggaggaatcacattacctgactgtaaattataatacaaagctatagtaaccaaaagagtgtggtattggcataaaaacagacaaatagaccaatggagctgaatagagaacacagaaagaaatccatacatctacagtgaactcatttgcaatgaaagtgtcaagaacatacactggggaaagtacggcctcttcaaaaaatggtgcttgaaaaactggatatccatatgcagaagaatgaaactagactcctatttcttaccatgtacaaaaatcaaatcacatggattaaagccttaaatctaagacctgaaactatgaaaatactagaagaaaacattgggaaaacactttaggacattggtctgggcaaagatttattgagtaagaccttaaaagcacagttaaccaaagcaagaaaaaaa

SEQ ID NO: 124600 - DNA, 930 bp, Homo sapiens
tgctgggattacaggtatgagccactgtgcctggcccagagcctgtttttctgacagtcacaccgcttattggttgctggatagaatgaaaaagcaaatggaagtacctctccccaccagtagtttttctgggtttcttttatgggggagcgagggtagagtaacatgtgggtagagggacagtgtttcaggaacccatttggatatttaagaacaggactaaatacttaaattacttctgtgacaataaaaagatacccaggaagctacactcttttttagttctatattttttgcatcatacgtttaaaaattggttgctcctaaatgaagctttagaatcctttgcaagatagtactactgcttcaagcagctaaccaccaatgaacaagaattatgagttcaaactctggcatagaccaaccccctaacttggatctcctaactcataatccagagttcttttccagagaactgctccgcttttaaaaaccagtgccaggattcagatctcaaatgataccattaaacactgataggcaagaagcatttgtttctatgagtaaataactctttcccggtctattccaaggttccttattggcggtaattataatggttggtaatatatcatatgataatttggccacgtgcttattcagtgcttaatatatgtcagtcttttcttacattatatgtagtttttcttattgaagacagagtttcttgctctgtgcctgccaagatcacgccattgcactccagcctgggtgacagggcaagactctgtctcaataaaaaacaaaaccaaaccacagtttatcccttaggaaaacaccaaaaagcttcttatgtacatgaacttgtattagggtcacactttaaggtggctctagaaagtataatgagagacttacagtaagactgct

SEQ ID NO: 124601 - DNA, 616 bp, Homo sapiens
gggggtcagttgcttctatcagtctcaatgccccagaaactgagcgaaaacccaagtattcatggcctactgaacgcaaagtctgagtctgaccctggtattctattccttggtttttagaatgcccccagacaaagatgagggctgaaggctcagaaaggccgggtcaggccaggtgaggtggctcacgtctgaaatcacagcacttttggaggccgaggcaggatcgtttgaggccaggagtttgaggccagcctgggcaacaaagtgaaaccctgtctctacaaaatattgtaaaaattagccaggtgtggtggcacacacctgcggccccagctattcaggaggctgaggcgggaggaacccttgagtccaggagctgcagtgagctatgattttgccactgaactctggcctgggtgaccgagcgagaccctgtcttcaaaagaaaacaagaaaggtagggtgacctgcctgggaatatgtggtaggaacagcagagtggagagagagcgcttgataaggtgtcttgttgggagacattccccacaccatggtgccatgggaatcacataagcaggtcaagtgtgcctcactcaagcactcaagaaccaag

SEQ ID NO: 124602 - DNA, 595 bp, Homo sapiens
ggaggaggaaaagagtgtgaagaggactggaagagcatggatcaggaaaatgagagatgatttctttaaaataacagcatactttgagactctgaagtcacgagaagtttgaattttgatttgctaaaaatcttaatcacaaaacaacagtgattccttcatttatatgaattaaaagcttgattagtattttcttttcttttcgagacagtgtcttgctccatttcccaggctgagtgatcacggctcactgaagcctcaacctcccagattcaaccaatcctcccacctcagccactcgggtagctgggactacaggtatgcgccactatgcttggctaatttttgtattttttgtagagatggggtctcaccatgcaagcccagctggcccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaacaatattaatgtttagaatgacaaagatgaattattacaaataaatctgatg

SEQ ID NO: 124603 - DNA, 282 bp, Homo sapiens
tcacacagtgaatatgatcagattacctccctgcttctgtaaggtatggaaacacaatgtatgaacacagaggcttccctcaacatcagaaaactagaggcaagggtactgttctgaagtgttggtgttacttccacccccttcagaatgaggatatggccctgcagatgccaagtttggctcaaggagaaaaggaatatttctctgtattcagaaatattccctagggctgggtgcagtggctcaggcttgtaatcccagcactttgggaagcctaggcaa

SEQ ID NO: 124604 - DNA, 507 bp, Homo sapiens
atagctagatttaattattttgggggttaggaaccaagatatatatatctctgtgtccctgacaatgcctagtagattgcattgttcacaataactactcagtatttttgagtttatttgtatttgctttatcaatttgccttaactgtaaccatgttcaaaccattgtttgttttgctaacaacagagggcaccattagggcacttgtacacccaatagtcctatcccagtccctggtagcttttttgagccgcacttttccttttcctaagtaatgtcatagaaatttggatgttatactaactggcagtggcccatttctacttatagagaaatcctggcctcagtttatttgaaaaagagtatttgttacattttgatcctttgtagttttcaaactttttattctcctcattattctttatccaagtgaaatcttacccaggatcttactgtattaattagatccatttgttttctgaagggagaagatagaggtgaaggca

SEQ ID NO: 124605 - DNA, 318 bp, Homo sapiens
gataattccagaacactagtagacagctctcctgagcacataattttacataattatgtaattactggcagcaaatgggtatttactgcattcaagcaggaaaacccagcttcaccacagactgattcttctaaaacgtttaaaaataagtatatgaaaatgtgttctgaattaagaactgggtgagaaaattcctaattaaaaaaaaaaaaagccttagctgggtgtgttggcacatgactgtagtcctaactactcggtaggttgaggtgggaggatcacttgagcccaggagtttgagaccagcctggacaacat

SEQ ID NO: 124606 - DNA, 687 bp, Homo sapiens
cattgtggcctctgcgctgggtctgtctcaaattctcacattcctaaagcactttgttttccaatggcattaaagtatccattgttaaagccttgggttttatttacatttagtgtggaattatataggacagaaattgatggggattattttggatagaaggacttttgggtcacaatcttcatagtggtttcctgtttttaagagttttttctgagatgcaaatatttatttcataggctattgaagaccttttttgagattagtcattctttgactattttaaagactatatagtgatgataagcaactatctgttatcaaagaacctaaataattgtagtaattgaaattcaagatcacagtgaaaactcatcagtttatagatatttgtctagaagagtgttcttcctataggtaggtagattatatatttatgcaagtaatgagttattctagttgacatattgtactgatttacaagtaagattatttctgaatttctgtaaacgtgaatttgaatctgtgatagaaccaccagcaaattacatatgctcttaactcagttttcaaatcagcaaaaatacacgtaagtaaaatggaaataaattattctcttagaggtaaatgtgacacacaagtggcaagcaaaagtaaaatttgtacatagagcaaagaccccaaaag

SEQ ID NO: 124607 - DNA, 296 bp, Homo sapiens
tatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattatt

SEQ ID NO: 124608 - DNA, 212 bp, Homo sapiens
ggttgggagaggacagcaggagtccctagtcgcatctgtggagaatgcagccattgagctgcggtcccagtgaagggtctcgagcatgtggccatggggttcactcaagaacttactgagaagtcaaactcgggctacccaagacgcaggagctgttcaggaatcaagagggtgtgcatggagtttgcacttagggcatacatggaacagtg

SEQ ID NO: 124609 - DNA, 334 bp, Homo sapiens
ggagtaggatattttttggtggggggaggggctatggctgtggaggtgagtggcattagctgctgagttttgcatacgttaagcaatctttattagacattcaagtggaggcatcaagtaagcagttagatacctgagtcaagttcaggaaagagggctggactgaaatacacaattgtgagtcatctgcctgtggatagtgaagtcaggagagtagatgggatcactaaggggaaagtgtcattaaagaaaagactaagaactgaaccttgaagcattctataacattgaaagatcaggaaaaggaaaccaagctagagcaatcagagaggta

SEQ ID NO: 124610 - DNA, 456 bp, Homo sapiens
caataaatagcaaaagattaacacaaatagaccacacaaaaaacattctgcttcatctgtccagaatgcacatttccttttgctcttcctggaaggctgtgggccatccttaatggcccaactcaaatgccgcatcttctgtgaagctttaggaattgttccagattgttattaatcataatctctgccccaaaatcattcttcttatgactctctgatgctttctgttacagctgtgtttgatagtcttccccagagcgtgtgaacatcttgaatggcaatgttttattcaactatctgcaggacttaggacaatatactgtaggtattcaataagtgatcattgaatggaaattcatcctttaggaactttatggagcaaaagtgagtgtaaaacacatttgcaaatattctttaaagttattatttacctttggctaatacgagtaaagatta

SEQ ID NO: 124611 - DNA, 588 bp, Homo sapiens
attatgcatgactcaccaaagaactaaaatccaacataataaacaatgccgtaataatttttgtattattttatgttattaataatttagtaggtattttagttttctgtcctgtacaataccagtcatcaccatacttgacagataacagataatttcccaaataaactttatatcataagcccttatcagtctcttttaaagacagaaagtgattaactctgttaatcaatgctggctaaaaaaaatacaggagcactaaccattttgtaaccaaacctgaacacacaatccctgatatagagacataaacttaataatgacccaacatttagagagaaaagagaaagtaaagaaagaggaagacagagaaaccggggctactttctaaaatagtaatcactaggggaatgaataacctgaaattgtacctttataattgagaggaaggggttaaaaatgtacaattaataaattactggtttttatgaatgaccagtgacatcttctgagaagaccccaatccagctaagcaaagataacctatttctttcaaactgatttgggatatattttcccacagaaaca

SEQ ID NO: 124612 - DNA, 573 bp, Homo sapiens
atacgtactgcgtcgaccaaaagggaattttaaacagggagtgaaacttttgtgttttacagagatgatgttgctgcaaacactcattggagtgagagagaccaaaggcaaagaagtcaagtaggaggtctctaggtgaagaattatgaggccctgaatcagggccacagcagtaggagttggtggaagacatttaagagggggaatttataggttgtggtgactgattggatgttaaaaagaaactctagaaagacacttgctggttgggcgcagtggcttacatctgtcatttgagcactttgagaggcccagcactttaggaggccaaggcatgaggactgcttgaggctaggagttctagactagcctgggcaacataatgagacccctatcgctgcaaaaaaaatttttttaattagccaggctgggcatggtgacccacacctgtaatcccagtactttgagaggccaaagcgggaggatcacttgagcccaggaggtcaagactgcagtgagctgtgttcgtgccactgtactccagcctggatgacagagtaagaccctgtctca

SEQ ID NO: 124613 - DNA, 329 bp, Homo sapiens
agagatctcttggtgcagctgggctggttctcctcttcccatcccctcattttccatttctttgggtcagggcccctgagccttgagaagaataaggaccgttgttttatctcttttttctcttttgtagagacatggacttgccatgttgctcaggctggtctcaaactcctggcctcaagcaatcctcccacctccccaagtgttgtcattatagcatgagccactgtggttggccaggacccttgttttcctacatggccccagcatgacaaccagcccccattactcaggccagtcactttgtgatggcgatgttgtcccagcaa

SEQ ID NO: 124614 - DNA, 573 bp, Homo sapiens
gagcaaacagtgaagtcgggaaccctgtataggcactaagggcagggattcggggcacaagagcaacctgctccccttcctgtgtgcctggaccagatacagggcaggaggtggggcaacgggtagacaagtggcctgccccaagaagggggccgcctggacccctgcctacccagaatcagcacagctgctatgggtggcatcaatgggccagccgacccaacagaaccccttctcaggaactgagcagtctcggaggagttcagcagaggcggggcgggtcggggaagaggccaggatcactgacagccattcagcccaggggtgtggcctcacctgccctgagggggcaagcagggcttcttagccttgctaggtggccactgcacatcaaacccaggtgagcacccaggccaccatcctgctacagggacacatggcatcttctcccaggagcagggccggcagaggtcagcataggccaggtgtagggttgggtgcaggcatggcctgcactgccccaggagggaaccccatacctcaagactgctggtgtcgccgaaaccagaaccc

SEQ ID NO: 124615 - DNA, 491 bp, Homo sapiens
tcctgacacacagaaaccttccataaatatatgcccaagtttgaatggataggtaggtagattttgaaaagggatgcagaagtgccgttgtaaaatcctctctgaagaagtggaaaggtgcttttccagaaatggtggaaatgttctactgatgagtgtggtgaaatggattggctgacctcttaacagctaggaatgaaggcaaaagtgagaaggagggcagtgttttacccagagtagtgtcactctctgaatgtctatatgctgtgatggatagaagaacactaggcctgagaggtgaagccagctggtcttcctgggtcgagtggggacctggagaatttttctgtctagctaaaggattgtaaacgcaccaatcagcgctctgtgtctagttaaaggattgtaaatgcacaagtcagcactccgtaaaaatgcaccaatcagcactctgtgtgtagctaaaggattgtaaatgggccaatcagcac

SEQ ID NO: 124616 - DNA, 395 bp, Homo sapiens
aaaaggaaaaagtaaccatattcaaatattcccagaacattctgttatccttaacaaaggactgaccttaaggaaaattattttaccagaggctaaccaacagcgggtatatcaaagcctgaccaagtggaataaggaaaatatccaactagggttctctctctagctttcttgttccacctaaggggggtaaaaaagctgagaagcatttgtaaaggtgaaagcccaggggcactgtcccacaaaaaacctgagcctaatcacaggactacatacagactattctccccgctccacaacactcatcttactacaatcaacagagctcctgtaaaacaggaaatcacaactgaaagaatggtaaggctcaggctctatttaaaaaggagtctcat

SEQ ID NO: 124617 - DNA, 447 bp, Homo sapiens
cccatggctccccttgggtgtctcacacagggaagaccaactcagctggcaccgcagaaactctctttcccacagtgatcagtatagctgcccaaaagatactgtggatggaagggccagctgccacataccctcctgatggaagtaccgagtacattggcctgagactggagtcctctccaatagcccactgtccagcccctggccttaccaacgctcaggacagattagaaatggaccgtaagtcaacagcaccctcctttcctcaacttgccacttgggtgggcattagctcatccagagaatttgatttggcagataccatgcttcttttatatcatttctttgccacctaatttgtacttatgattgtagaaatataagaaaatataaagaagtaaaagaagaaaataaaaagaaattatatttcaaagataaccagttaag

SEQ ID NO: 124618 - DNA, 698 bp, Homo sapiens
agcggaagcgcctggaagcggaagcgcctggaagcggaagctggacagacgaggagaggccttgggtgtgacatcaacggaacctgagggaagcaaaactcagcaaggacgcacccggtctgctggactggggctttgggttggtgacgtggacgatgagtctaattttggggcatccgcgcagttgtgcagcggtcagtggggtgcaggggtggacgtgaggtcaacccacgccggcctcagagccccagcgacctgcaggcaggtcaggagccagagggtggggcgggggcggaggaggccaagggaggaaggaaaggtcgggggaagcacaggcgggcccctctttccagattccctcctttaagagggcggggagaagaaaggccccagcaggcagcgagctcaggtgccctcgcctcgccgcctctttcctcttcctgtgaagagcgagacaggggaaggagcaggaggattccccgctggctccaggaggtggggcagcaggggcctgggagtgaaggcgctgtggggccctgacaacctcctttctgcccagacacgaaacccgaaccttcccgaaccttcccacacccgcctgtgctgaggtgctgcccccacctgaacagggaggaggatggccaaggcctgggaggcaggatggagcctccctttaggggagtgagcacttcctcctg

SEQ ID NO: 124619 - DNA, 314 bp, Homo sapiens
tatcatgtggtctaggttgactgtttttttcaactctgattttttttcaattatcacggggcttttttggggatttttatctccccgttttgacgtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtg

SEQ ID NO: 124620 - DNA, 171 bp, Homo sapiens
ctacatcctcggcaacccaagttctgcaattttttactcaaagtttctagaatgtgcctctcccaggccccgttttctctattcctgactcagtccaggccattttcctcgtgtacagtccttgggatgtttcttctccattctgcccatgtgagcttttgaaacctttgt

SEQ ID NO: 124621 - DNA, 343 bp, Homo sapiens
ccatgtctgtgctgtgctcaccccatgtctgtgccgtgctcagtcctaggtctgtgctgtggttaccccatgtctgtgctgtgctcaccccatgtctgtgctgtgctcagtcccaggtctgtgctatggctgcccaaggtctgtgctgtggctgcccaacgtctgtgctgtgctcagtcccaggtctgtgctgtgcttgccccagatctgtgctgtgcttagtcccaggtctgggctgtgctcagtcccaggttggtctggtttcaaagccccagttctttccactatccctgtactcatgatgactcccccaaaacagaggtttttgttccacaggtgagac

SEQ ID NO: 124622 - DNA, 259 bp, Homo sapiens
tggtgttggacattctgtagggaaaggacagctctctcttgtccctccacaaagagttactccacgcaaaatgtccacagtgctgaggttgagaaaccctgccctagatccttacagaggagtccttcttggccatgtgcatgcagcgtgagtttgctggaacacatgtaggacctgcttccaggatggtgctcacacaagctctgtccacaaagctggggcccaagtgagagagactgtggtgacactgagggagccg

SEQ ID NO: 124623 - DNA, 523 bp, Homo sapiens
aaactgcagataaggaacaaagaagatagtaagtctgactcaagcaatctgtgccaataacatttaaaaacgactggaaatgcaagaaataaatagggtcaataatcatttctaaaagaaatctatgccctttacccatattttccgtggcatttctcttgtgcctcctatgatttgaatagtggacaagacattggtcattctttttgggccatcctatattgaaaaatccttctatgtttagggaattcccaacatcaccattttctgactccccaagggaaaagacagaaatatactttctcagagtttattacacttaagggcacaggcatgtgacccagtctccgtcaacccggtgtagaaaggcccgttttcattcagaaactactgatgtgtagaagcagattcctcaagaaaaacattcagatgaggtggttataggtaattaataatccattcacgcaaaactagtgtcagtgtttagggtcaatgggacttgcagtgtaaactatgtggtcat

SEQ ID NO: 124624 - DNA, 395 bp, Homo sapiens
atgatcggggctgctttttattaaacagaaaagcctttccaaggactcccatgtccttgctatctgcctaagggatttcttcttaactcctgcatcactatggaaggggactggagttaaatgtaatgtcgcagagcaacaactttgtgctacatattatgccttacaagttgaggacattacaaagagggtctcgaggctcgtatgcaccccgtacctcacagcaggttggctgaagggtaccttccagaaaccaaagtctatgaatgcccagactggccaaatgtgaagcctgccttcaacagaggagcacatgaactaatagccccttgattgcagagctccatttgatgcttggacctgtcacttatgttacaactgaaggacagtcttca

SEQ ID NO: 124625 - DNA, 879 bp, Homo sapiens
gataataacagatcagtagcaggtaggatttgttgagcctggatgttgtacctctgtgctaagggctttgcttctttttgtcctatttaatccttacagcaatgttaagaggtagctccgtataatatcccattcattagtgaaagaaactgaagcacagaaagtttaagtaaattgcccaaaggctcacagctggtgtattacctgcctctagttagctctaacaccggtagcctctaactaataaatctattggaattatcataccaagttggggatggcgagtgatggggaagcatattttattattagtcatgctctcctcagagtgtctttatttaattggagagtgcttagtgttaatttccagataaagtaggttgggggggcttttgctgttagttaaccctgtgtacgtctccagaaatgcattctgtgttttctttttcttactgtttaaaaccagatctctctgtcctttccaaagtgctgggattacaggcgtgagccactgcgccggcacattcagctcttatcaaagaaataacccagacttaatcttgaatgatacggattatgcccaatattaagtcaacaaatataagaaaggtatcttaaatagatcttacggcaaatacagtgatgaaggatctgatgcttcatctgtgcagtcatctccaaaacagtaaaataacacttgtgtggcatttgaattttaaggggtgattccatgttgaacagaaggtgatggaattgatctaggggtcttcaaaggggtccattggatatgtgtttgaaagggggagtgagtgaattattcaatggtgtgtgaatactttgggcaaaaaaaagggggcgtaagaggggaaagaagtgtag

SEQ ID NO: 124626 - DNA, 379 bp, Homo sapiens
agcatcccacaagagagctggaggcagcagccctctgtgcccagcccgagatccgcaacgcataggtgccatgtcagcacacaacttacaccagctcaaagctggatcgacagcagcgcccagggttttggtgattataaccaccctgcaggggttcttctgagtacgtcttcaggtttcttgtgtagttttgttagaagggattttagtggctccagggccttaggaccctagtgtgcagcgaggagtgtccacagagaccctgcccagtcaggccctactttaggctggagcctgtgggcttatcttcaaggattttacaaacacttctgacaggaggccttgcagggagatgatgctgagttgggactgcgcacag

SEQ ID NO: 124627 - DNA, 174 bp, Homo sapiens
aacctcaataatagccaaagaaaatgcatcaagagacatcagagagactcatttttcacctatcaaattagcgaagaataaaatgactgtcaagaccccatgttggtgagaacatgggggatccaggagccctgaaaatacctttctggatagcagtttggcattaggtaccaa

SEQ ID NO: 124628 - DNA, 479 bp, Homo sapiens
atcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagact

SEQ ID NO: 124629 - DNA, 170 bp, Homo sapiens
atgaatggggcccagcccacacggggctctagctgggaccagataggcaggtgctggccaagctttccattagcccagtattctgaagctcacaccaggaagacaccagcagggacgccagccgctactcttctgctgcagatttacatgtaatacagaggctctcagag

SEQ ID NO: 124630 - DNA, 286 bp, Homo sapiens
cagcaggaacgtctcatgctcactctgttaattacttcaaggtttcttctgtgtctgctttgtgctcactgacactcctaggaccacaatggagctggctgctgggtgacagaaagccaagcccctttggaaagaagaggggcttccaaagccctgagaaggaaggaaggcccgaaccagagggtcttccctccaaaggccagggagtgaagtttggagccaggctgacagggccggcctggtttaggaaaggagaggctggaaacagacacagcagtggtccctg

SEQ ID NO: 124631 - DNA, 792 bp, Homo sapiens
aaaaatcttcaccctttcctcaacttatttagctttttgtgtccttgtcttcaacactataaaatagttttaatacaggtggtacagatcctctgatatgtataatatgagctgtattatatggtgacatgagaaaacctgcatggtggcaattcagagccagtactatggtttttagaataagtgaatatatcaaagtttttcatttaatgggagaatctaagagtttgtgtctactggattttccctaatttttggatgtgaatgaagaaagaatgaaatctctatatttttgataaattgtatctgcattaaactaggcctgtccttatttgtttttgtgattagttaaattcaaatctttggttcttttatgtaagtggtgattctgccccccagggaacattggcattgtctgcagtgggtgtgagtagcatctagttaggtcagacatgcttcaaaacatcctacagaacacagaacagccctcacaataaaaagttacccagcacaaaataccaatactcattgtattattcatgtttaataaaaattaagttgaggctgaatgcggtgtctcacgcctgtaatcccagcactttggcaggccaaagcgggtggatcacctgaggtcaggagtttgagaccagcctggccaacatggtgaaaccccatctctactaaaaatataaaaattagcttagcgtggtggcacatgcctgtagtcccagctacttgggaggctgaggcagaagaatcgcttgagcctgggaggcggaggttgcagtgagc

SEQ ID NO: 124632 - DNA, 207 bp, Homo sapiens
cagtagagaagcaaatatttttgtccagtaggaaggggaacctcaaatgttacagtttttgttgtcccatagaacattaaccagttttgtttttgacttagcaatcttatttcagtcttctgactctaatgaacaacatgtactttgatttcttgtacattctgttgaatcatctttacaatatactgattcccccattaatgagct

SEQ ID NO: 124633 - DNA, 176 bp, Homo sapiens
tgcttttccacagggggaaaatactgtttactgcccatctttgaaaaacattttacttagagcataaacttgaagctagatccttttaaccacttaattgctggacacttagtaggtattcataagtatatttgtatgaataaagtaaatttgagatcatcctctgtggacaagta

SEQ ID NO: 124634 - DNA, 504 bp, Homo sapiens
ggcgcgaattcactagtgattgtgagctgagatcgcaccactgcactctagcctggatgacagagcaagactctgtctcaaaaaaaaaaaagaaaaagggaaatttagacacacacacaccctgggagaataccgagtgaagatgaaggtggagatggggtaagccacttacaagtcaaggaacgccacgatttcgagcacaccaccagaagccaggcatggaccagacccctccctcagccatagaggaggaattaaccctctagatgcctatgatcctgcacttccagcctccagaagtaccagacagtcaacatgtgttgctttaaaccggtccgtggaacttcgttatggccaccccaggaagctagatggtgctcagtaaggaggtccctattggggccatcttgtagttgtcaggcctgcctctcattttaaggtgctttgagccaacacttcagaatcctcacagatctcatgtaaaactcggatttctggtttccc

SEQ ID NO: 124635 - DNA, 545 bp, Homo sapiens
aagcccacaagcacctcacattcaaatagctgaaacagcctatcacctttcctcagacctgaatctcctgcttctgttttccctgtctcatgatgggagatgtgagacagggaaaccattgtctcatgatgggaggctgtgaggctaatggaattattattctcctatcatttaaaacagaaagcgcttgagttgtccttgatgcctacattttgcctacacagtcaattatccttaaaccctaatccctgtttctcaaatctaactcctcctctccttctctcaactctcgctggcctagatgtctctcacatagtcttttggaatgtcttctcttctcgcatagtttcacttccttgagtacactgatcacatatagctactcttacctttctaaaatataaatctgacttgaattctttaatgtcctctaatacttccaccggggcataaaaagctgccaatgacctggcctctgcctatctgtaatggtttattgcctagtcttttcagaaagcatttcctttctttcaagggaactgctc

SEQ ID NO: 124636 - DNA, 164 bp, Homo sapiens
aaggacactttgggataggaaaaactcaatcttccaagtcattgatagctatgtataccccacacccaagttctgttgaaatttcctttgccaatacaagttacattaattatattcattgattaaagataggcttttcagccaaagttatagctttaataatc

SEQ ID NO: 124637 - DNA, 289 bp, Homo sapiens
caaggaagtctgtatggaagcagatatatttaactctgctattatttaagacttaaagatattactaaggacagttctctttttatctttgtatacatatttgtgatggctgttatcttaaaactttgtagccaatgggtataaatgataaataaatcatttgaggatggcttttggtcataaaccaaaaattgaatataaatatttaagtaaaatattgattgtgggctggtgtggtggctcatgcctgtaatgccagcacttcggaagtttggggttggaggattgc

SEQ ID NO: 124638 - DNA, 387 bp, Homo sapiens
gggcttttagctgaaatgaagaaattagaaagaatctgtctgttcaatctgctgctattataggttgatgttaaataataataacaataggtgagtagcatttcccaatagtttaccaggaaggatatttagctcagaaaaggcgagaagaacatgcataacaagggtgctgatcagttaaaagaggcagaaggggcaagctgtgatacttagctaagatgtataaatataccaaaaaataactcctaaagaagaaagaagggagaaaaaagagataaagaagaaagatgttgggtttgaattcaagagcaaagaccccaaaagcttttggggttctttgctcatgtcctgaccccaacgagcacttctgacaatgagaccagagac

SEQ ID NO: 124639 - DNA, 598 bp, Homo sapiens
gcactctcacctcaaattgacgggggcacttccctggagcgactgacggagagaagagatgaagacaggctccattctcagctagagacctttaataaaatggtggccttcagagatttctggcatataaaacttacctccccattttcatgtatgtagcaggcagcatgaatcttgggctatcaagattcaagagactggctcagaatgaaggacagataatatgagaagccgaagacagactgaagtcatttattcacttgtccgttcattcatttatcaagcattcggggcctcaccagagtaccagaggtactagagccatcagcaaaatagataaatacaaccatgaaacaataggctgaaatttctgttctcatggagctttaattctagggaatgggaagacagttaaataagtcaaagttatagtttatcaggaggtgataagtgcaaagagaaaggacaaaatagggacagggcacagaaagggcaggaatggagaacaacagacaatgtgcatagggagacttccatgaggaggtgcccttggcacacagatctgagaagctgaaagtgcgtcatgagggtatctaga

SEQ ID NO: 124640 - DNA, 557 bp, Homo sapiens
cctcattcccctccatactccgaagaatgtctttaatgtttgaaccactatgtcacattgcatctcagatttaccttctctggctttggatgctcctgaatgggggtgattatttgcatttcctttgctcctcttggaggactgggtcacatttagtttaagggttactattagtgagcaaagagaacaaaggcaccaggagctgagaatgcccttttctaggtgactttttccctctatatctgacctaagttgtgcacttcttcagtaatcagagactataattacatgctaatgttatagccctgtcagtatctgtttctacaagatctttatgtattccaaggcatcctgtgtagggaagcatacaatatattgttaattttggacaacttaatccatcccaattctataggctgatgataagcttgaagatgacaaggccaggtgacagaatactggaggattagtttctgagtagttcaagattgtctttgttgattaaaacttcactgtgtatcagccactctgatttggacttttgttgaatatgaata

SEQ ID NO: 124641 - DNA, 405 bp, Homo sapiens
ttttattgtcagaaactccaaaaagtcaatcgtactaatttatcaccatttgctttattaatttatactttgcttatatggaattttgcccaacagacctcattacaatttctaacttgttttgttttttttctgagacagggtctccctctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcctatacgtggattccagaggggtgacagcaaaacgtgggaccatccagttgcaggaaaacaagcttaacacgcccactgattctacattatggtgagttctataatt

SEQ ID NO: 124642 - DNA, 430 bp, Homo sapiens
tcatagtttgattgagaccccaggctcaccttgcttatctgacataggtctgacccacctgtctcgttagcccaccactgcctgacccagcaaggatttcgctcccaggttcttgcacatgcgtggctaacccaggcccaggctgcttctccattccttccatttgcttttcacccctgcccacctcactgatgatcagcctcactggccagcccaccagtgctgccatctgcttcttggatgtattccttgctgccaggcaaaccttgcttcctggattatttggaggcagagaggtgctttgtccttttctggtaacaattaatgacacaaaggcaaggtgaaaaggcgctgtgctttttttctaatccacttgtatggatttcagaccaaatttttaaataaatgtacaggtaattaagtatccctc

SEQ ID NO: 124643 - DNA, 810 bp, Homo sapiens
gggattataggcatgagccactgcacccagccaactaggttacttcttatttgtttatttgaaagagtgcttgttgaattgttctttccacagattatgcttctaataactttaaatattaattatggaggaaacgggttaatcattttaaggattctttttggttgatataatgattctattaattaatatttgtcttatgggagccataagcgtaataggcataatgagagcacacacttgtaagtcagagtggttcttacaggggagacaggaaaaatggagtccaaaaggcctttctgtaagttccttgggagcagggactaggtctttcttgttcaccattatgtcagtatcaggcacaatgcttgacgcctagtaagtgttccataaatagttgaatgaatggatgagtttctcattaagcacttttagtagctcatatttcttgtactgtggataatcaagatcaattatattcatctaaggttaagagcctttgctatactcagttttctttattaatgtaaatttaataaactgatttttttaaaaggcatgcatctatgtatacacacacacacacacacacacacacacacacacacacagacacacacacaaaacaagtgaaaatttattgtttcttcccctgagccccattctccagaattagctactattaatggcttactatattttttctaggtattttctcttcatatacattttctttcttttctttttgtgagactcctctaaaaaaaaacaaagggggctttaccggggactttctaagggggaaaaaac

SEQ ID NO: 124644 - DNA, 128 bp, Homo sapiens
tccctgtgggtggaggcaggtggtcctgagccctctggggagagtccatgtcctccttaactcctgggatcgcacagcccccagcacaggaggacgtctggatttactgaacataaacttgttcagct

SEQ ID NO: 124645 - DNA, 378 bp, Homo sapiens
tctgttctgttcaggtcttcaattgattggatgcattctgtccgctttagggagggccatctactttactcaggctaccaattctaaagttaatttcatccagaaacaccctcacagacacccccagaataatgtctgttcaaatatccggtctggtcaagttgacacataaaacatcacaacctccaagaaaggaattggtattctaaaagggattcggagagaggcctatagcattttgaatgaaaaaaggttacttctggctgcgtggtgtagaggagttgatattcgaaccttttttttttccataattgcagctgtaccatctaccaagaacctgcccattctagaggaaaggcctgggtttaagtctcattc

SEQ ID NO: 124646 - DNA, 344 bp, Homo sapiens
tgttgtagagacaggatctctctatgttgcccaggatactctttaatttctggcttcaagcgatcctcctgcctcagcctcccaaaatgctgagattgtaggcatgagctaccacacctggccttgaaataaagcctttgaaaaaaagtactccttggattgttgcaagactattatccagagttctgaaaatgttgattttgaccatttttgccacttctcctcattgcttttgagaggtgaagccagctgggcttctgggtccggtggggacttggagaacttttctgtctagctaaaggattgtaaacacacaaatcagctctctgtgtctagccaaaggt

SEQ ID NO: 124647 - DNA, 474 bp, Homo sapiens
caactccggaggtgggactggggcaccataccaaatttaggaccagctaaaacagggtgggaggtggggaagcagttttctgtaagacacgcagaccgagaatttctgcataagctaccccttaatttgcatgtaattaaaagtgggtataaatatgagtgcagaactgcctctgagaacctactctggacacattgccgatggggtagccctgctctgcaaggagcagtgcctctgctgctgctctgacactgctacttcaataaaagttgctgtctgactcaaccaactctcccttgaattcttttcttggcaaagccaagaacctgcctgggctaagccccaattctggggctcacccgtcctgcatcagttagattgcccttgcttatccatccaggcttctcccttgtttcagtacgtcaagggaacctcacatgagaactcactggaaatacaactggcacagcgtta

SEQ ID NO: 124648 - DNA, 334 bp, Homo sapiens
ctattgaaaacattcttctcctggctcctggggctccatgccgtcccatttttctcctacctctctgagtgtttctttccagtcttcttcgcacactcctgaacttcctgaccatcctttagtgctggggttcctcagggctctgtcatatcactccatctctctagcccagatgtctctccagagcttcagacttatacattcaacagcccactggaccacactcttctaggactacctgcaggcacctcaaactcaatatatttagaagtgaatttgccatcttcctcctaaaccagcccctatctcgtgtgtttcaaatcgctgggaatgg

SEQ ID NO: 124649 - DNA, 448 bp, Homo sapiens
gaaaaatgggcactttgtctttggtgaacaattcttgttcccagccttgtttttctcggcagttagaaggatgctgatttggagcccttaatttatttcatagggtatgatattctaagaaagcattatatatccaaagctggattttaggagtagagaatttgtggggaaatccagagtaaaaatacgatgtctgggactgaccctggaatagtacaagttactctgcttaggaattcaaatttcccatcttaactaatagcaatgtatgatgcacaaacactaataagagaaataagcaatcataaaccaatatttctgtgattgattgacctttccatacatatatcaagcatttactaatctttcgggttaggggctgatagactgttctcttgaagatgcatcctcttgtttataagcactgatatagggaacttttatggta

SEQ ID NO: 124650 - DNA, 475 bp, Homo sapiens
caactagcctagccatcacatcccatattacaagtgtcggaatctaagactacttgaagatgagcgaaagacaaggtcaattttctttgaagtaatgttcattgaaagtttcccgcaagttttctttctgttcatatattatcggtgagaccttagttacacactttatttttaaacaaattatgtgtccagggccacgcatggtggctcacacctgtaatcccagcactttgggaggccgaggcgggtggatcacgaggtcaggagatggggatcatccttgctaacatggtgaaaccccgtctctactaaaaatataaaaaaattagccaggcgcagtggcgggcgcctgtagtcccagctactcgggaggctgaggcaggagaatggcgtgaacccgggaggcggagcttgcagtgagcccagatctcaccattgcactccagcctgggcgacagagcgagactccgtctga

SEQ ID NO: 124651 - DNA, 278 bp, Homo sapiens
cacaaatcccatcttgattaaagaagagaaaacaatggtgtctttgtttggagcccaaagggaaggattgactagattgggaaaaatgcagattgggagatgtttggagtgggccagatggagaagaaagagtcaagtcacctccacccctagtggcctgaatgctgtcatgcggaattgcctggtccagttaacaaaccctcgcttcattgttttatttttaatttgtattttatcttaatttactttttagctaaaaaggtaatatgttcattagg

SEQ ID NO: 124652 - DNA, 622 bp, Homo sapiens
tgattatctactctatttcccctgctaggagacaattaacgaacatactttatccttttcatgatttttggcacccacatcagtgacattttaattaaagttcataaacttcataagctccactttgcaatgtcagttccagtgctactattgtttctaattttacagctgttgtaccaaattcatgcagctgcttgtttttatattaatctttatctttcccctaacccataaacatactacctctggcacgaagtcatcctttaatatagtcttattgaaaacaaataataatggagaccatatagtacaatgattatgagtagaggctatagctcctgatattatatcctagctctgcaacttactagctgggtgacctcagttatgtcatttttctgtgatttgggtctcagataataaaatgaaactagaagaatctagcccagcaaacctggtaaaataatattgttatgaggattaaggcaaactaattcacataaagatacttagcttttatttggcaatgaattggaattgagtaaatgagtgatttattgaggagttattgcaacaatctagaacagagatgataatgactttgcccaaggtgatggcagtg

SEQ ID NO: 124653 - DNA, 406 bp, Homo sapiens
tactctatatatgcttatgtatgcttatatatataaacatacacaaccaaacacattgttgctattattttgaataaactattatctgttagatcaattgagaataagaaacatattctcaattgcttattcctctccaatgcctttcctttatgtagatctggatttctaacctagatcattttcattctctctaaataatttcttttaacatttattacaaggcatcaaattccctcaatttttgtctaacaaagtctttatttctccttcacttttaaatgataactttgcacagtatagaattctagattggattttttttcttgacactttaagtattccactttcttcttgcttacctggtttctgaaaagaagtagggtgtaatttttatcattgctct

SEQ ID NO: 124654 - DNA, 678 bp, Homo sapiens
tcaggggacaggacttgtttgtcttgctgcctttatctgctcgtgggcagggaggtctctttctttggataggtatttgttctaccctaggttctttgttgttctccctggatcagggtgccaggcccagtagggacacagcctctcttggcagtctcttacatatgtccctggatccaaccactgaagactggtccctgcagtagtttttgtacagtcctttatagaactacatataatagcttaatgtttgcatgaggtttacatggctcttggtgattaaatcaaatgccctactcagtgatgtggcgatgctatcccagtcttcgtaggttgtctctggtctcctgccaagcggaacgtgccaggtgaacacttgggcacagtgagccccgatgctttcaggagcctgagtattcaaactaaacacagcaaatccttcaaagcccttccagcttcatctttagaatactgaatgcgggaaattccacagtgactcctaggaaacaattcttatttctaactgggctcccattaaaacaagatgattttcctgattctaacctgacgtctttgtgactgattctttagtgctcttcttattctttccctagtgagtcagtaacataattattcaacaaaggaatgtgtgtgtgtgcacgcacacacgtttgcctg

SEQ ID NO: 124655 - DNA, 279 bp, Homo sapiens
gtgatatgccacgtgacatagctcctatgtgatgtgactctttctcattcttggcctctttccactggggttactggaacataaagctgagcccagctcctaggctgtgtctctcctttctaagccctacccacaaaggacattgtgacgtatctctaggcttctcacctaggtaatattacttttttacctaggcccacccctcaggggtattgtgaaatactgctggaccaacatgctagatgataggagtctctgctactgcttggggtgtgatta

SEQ ID NO: 124656 - DNA, 736 bp, Homo sapiens
gtctctgtctgaagcagctgactaaggtaatactctcactcctccttccacaagcaaagaaacagacctgacatcaatcataaaaacaactactgtttattaagtacttattacgtgccaggtactttttgttaggggctggtgacttaacagcagcaatgataatgaccaccacatactggatatttaccgtgtgcaacacaccacagtaggaacttacatgaattgtctctatatggctgtgacacattccctgaggatccaggtatattttttaagtcatttcatgacctgatttctcccaagtacttcagtttctgagatctctctctcccgggagcagggaccccagccccttttagcactagacagcaaacccacaacttcacaaactctaacttcaccccaacaggcagattccctcaggaaaaagagtggtaaatgaataaaccctccaaacagaaaagggctgagcacctaagagattcaggatggcatttttggaaatgttcacttcaggttgaaaagaaaacttttgaaatgattagtgagttatttagaacctcaatattctaaagtttgagaagataacatactgaggaatttaatttagatttccttaacatgctctcttatgataagagagcattcagtatataaatgctatgcaacagtactgccaaattgcaacacagtatgggagaaatttgtcattttgaaatgctaagggagttct

SEQ ID NO: 124657 - DNA, 239 bp, Homo sapiens
gcctattttagtcaggttacttttatacgcgattaatggtcacctcagagtcaccccattcatcgcgtataaaagtaacctgactaaaatgtgttcattttgtccctctctagttcatgactaccatttttttcatttttaatccagcgatttttttagagtggttctttaagcatcttgtattagccatttcaatggtcattatatatgtttggatttctcttattttgttgaactag

SEQ ID NO: 124658 - DNA, 336 bp, Homo sapiens
atttcctcacatctgccatgctccttcctgccactaggcctttgtgtactaggcaattctttctgcctggatgttcctcctttccttttgtacctccttgacttctcctcccttctgtctcagcttcagtttcacctcctcaggaagtactccacgccctcctgatgacatcgaatttccctctcataagatctaagcactgagtccttctcctttgcagcactcgcagcaattgaaactgtatgtttgcttgtcttcctcaacatctgttttatttgtttgtttcaccgttttatccacaatatataccctagtgtcaaacatatagaaagagct

SEQ ID NO: 124659 - DNA, 261 bp, Homo sapiens
tgaagggaaagttagagacaagatggcaacaggaggcaacagaatcaggaggcttgatcttaaaatagctgagacttaaatatgcctgtagaactaaacttgaatatacataaacttggatgtgtttaggaatcacttcaggtgcttgttttttttttctttttttgagatggagtctcgctctgtcacccaggttggagtgcagtggcgcgatctcggctcactacaagctccccatcccaggttcacaccattctcctg

SEQ ID NO: 124660 - DNA, 741 bp, Homo sapiens
caggctggtctcctgtctcggcctcctgaagtgctgggattacaggcgtgaaccaccatgcccagcattgtagattcttttgtatttcctatatatgcaattacatcacctatgaataatgatggctttgtttctccctttccagtgtgtaaccctgtttttccttcccttactgtgcttgctatgacacccagtgcatgttgaacagaaatagagatagcagatgttttgccttctttctgatttctctctccaactttttacctcacataatgattgttgctatagttttctaaaatctaccttttatggaatcaagtgtccatctagacttagattgctaagaggtgtttttttaatgatgaacgactataggattttaagagcttcattttcttcatctattgagacaatcatgtatttctcctctattctgttaatgtgacagattatattgattgatttttctgaaaaatcattcagattataaactacttatactttgctagtataaaaccacgaagtaacagggtggtcagagcataaaagagctagccatggtaagactcggggagaaattttttttttttgagacagagtcttgtgctgttgcccaggctggagtgcagtggcgcgatctccgctcactgcaagctccacctcccgggttcgcgccattctcctgcctcagcctcccaagtagctgggattacaggcgcccgccaccacgcccggctaatt

SEQ ID NO: 124661 - DNA, 156 bp, Homo sapiens
gcaagcgataggcatcgaagacgctcgcttcagaagtgattgttccccgctagcggggaacaatcacttcaatataccaatttagcaaaaccacaacctatgtaaaattcaactctccaaatactctgcacctgcatcctccagctgacataggct

SEQ ID NO: 124662 - DNA, 506 bp, Homo sapiens
ggccacagggtaaaccactgtcccctaaatgggagagacaacaggcagatacagagcatcccaacttcttagtgcagaagcctaggaatggaagtttctgtgggaaaccagtattgagttgctttaaccaatacagcatatccagctttgaacaaaaaattacacggcagaaatgaaagacaaaaaccacattttgaagaaacagagcaagcattagaaccagattcaggtatggtggaggatgttagaatgatcaaaccagcaatttaaaacaactatgattatatgctaagggtcctaatgggaaaagtggggaacatgcagcagataagtaatgtgcacagagagatggaaactttaagaaggaatgaaaaagaaatggtagaaataacactaacagaagagaagagtgccattgatgagcacatcagtaggccagacatagctgaggaaagaatcagtgaactggaagaaacatcaatagagtcttcagaaactataataga

SEQ ID NO: 124663 - DNA, 193 bp, Homo sapiens
atcagtgttctcttgctaaaattggaggtaaataaataattaaaattcacatatggaatacctataattaaaactatacatacagcaatagacacaagtttcctttgaaagcaacagataagagaatcacagctgttgttaaaagctgttttgcaaagaaatatgaaggaagcttgactgataatatttaatg

SEQ ID NO: 124664 - DNA, 115 bp, Homo sapiens
tggaagcagtgagctgagaaaatgcagccgagtcatttattgtgccttcttagagactggccagatagccagtgaagagtcttccctaattcatattgattaggaaaagcttggt

SEQ ID NO: 124665 - DNA, 660 bp, Homo sapiens
aatctcggctcactgaaacctccacctcccaagttcaagtgattcttgtgcctcagcctcccgagtagctgggattacaggcgtgtgccaccacacccagctaatttattttttatttctttgagccagagtctcactctgtcgcccaggctggagtgcagtggtgtgatctcggctcactgccacctctgcctatgggttcaagcaattctcatgcctcagcctctgaagtagctgggattacaggcacatgccaccacacctggctaatttttgtatttttggtagagatgggatttcaccatattggccaggctggtgttgaactcctaggctcaatggatccacccaccttggcctcccaaagtgctgggattataggtgtgacccactgcgcctggctctgccctattttttaacctcaataaattatattactttagtaggtacctgggtactctctagtattaactaattgggcctcctttttggctagaccattcttattttaaactcagtagtgatctgatttttttaatcaatgactttaattccaacaacaaagaaaaggtggataaatctgccttggttacagtaataagctgttaaaggcaaaattatactttttatacttttcaccaataatgtctactactagat

SEQ ID NO: 124666 - DNA, 307 bp, Homo sapiens
tcttactcaggaaacaaaatttagctcaattaaaaagatcttaaatgttaaggttgagagattttaacttaaatctgaaggagtttggtctagttagattgccgaagtgcatgtagcttgagttaattccctgagtctatagtcatgcttagagaatttttgactgcaccatcaccctttcatcaaagtgggcagagatgacccctctggtagcaccggattctccaaggcaggggatggggctttttacactgcaggcattaggcaagctgaagaggtgtggtcactccctgtaggaaagaacatt

SEQ ID NO: 124667 - DNA, 442 bp, Homo sapiens
aaatactacgtatgtgctcatgattcccaaatatacttctcagggagctctgtcaccaccctgaaactccaaatttaaatatacaactaactacgtgacaccttcactttgatgtagaatatggatctcaaactttacaaagtcaaaacagaattctcaactcctctttccccagcaccaattcatttttccccagtctcttccatttcaaactgtggcactgctgcccactccagttgttgcttgagccaaatatctagggattaccttcgattttcctttttctcttttccactgctaaacaaactatcagtccattttattaatttttaccttccaaagcataacccaaatatatttacttgtctccatgtctactaccagcaccctgctctaaatcactgctatagcttcctccatttccagctgtgtcccctgcaat

SEQ ID NO: 124668 - DNA, 193 bp, Homo sapiens
agatgacatttggacatgcctgttggatgctagggaaatacaatctcctgaatctaagctcgcaacagccaaggaggtgtaattggctccacgtgatcaaaggaagcccaggctctcatcctgcaaaaagtgaggagctggcccggctcagtggctcacgcctataatcccagcactctgggaggccgaggca

SEQ ID NO: 124669 - DNA, 134 bp, Homo sapiens
atgatgagtatgcgcagtgctgatgatttgtccagtgtcctcctagtttggagatgttggtaaaataaaattaattgaagggaggaattaacatgagaatcaagcccattattagtttaagaatgaatttatcc

SEQ ID NO: 124670 - DNA, 490 bp, Homo sapiens
aagacgcctgccacagtggaaagagcctggttctgccctcgttctgccacttagctgggtggtcttgggcaagttgtttaattgttttgtgtcccagcatatcatctgaacgatgggcataatcatacctactttgtaaagatttcagaaaacatgtagcaaaggccaagttcagtaaatgatggtgggtttcaccaaaagaaaaccaaattacccacacacaatctactctgaaaaaccaacagtccctttcatgcttcagtgaaacaaagggcaaagggcagttggggaaagcatgaaatataaagactatcactcataatctggctttacttcctatcacctaacttgcctcattccttcattaattaagtgacccctgggcaacaaagcacaataaggctgctgttattctgttaattatactttataattatatgtgacataaccagtctcaagctatttttacctttatcttaatcttcacaaa

SEQ ID NO: 124671 - DNA, 242 bp, Homo sapiens
gtgcttagtgtggggcctgacacagtctgtgttcagtaagcaatggcttcctctctgcccctccatcccaggaggatgcttgacacagaagcccaggacctcagctcacacctaacttcccctcacctagaaacccccttcaacagtcctgctggaagctctcagaggagggagtacagaagccctggccttcctggggaccagtgcaaacaagagaaaactttccaagggtcagagagagt

SEQ ID NO: 124672 - DNA, 316 bp, Homo sapiens
agatagaagttcattatcagttttatttaataagcagttgttcctgataatcaaagtgattcagatatcacttaaggtcaccatgctcattaagtcaagagattatgtgctggagtccttacatgatgacctaaggcaggtctatccatgccttcaacagcatgtctacaaattcccaagcttgtctttctccaagtcacctctggctgtgatttctagtgaagatgaactctcatctctcattctttactctgttatcagtccaaacatgtaagagccctttctccttaatcacttaaccttaacccacatatcg

SEQ ID NO: 124673 - DNA, 639 bp, Homo sapiens
tattttctagataccaatctcttaggagatatatgatttgaaaacattttcaaccattctgtgggatgtcttttcattttcttgatagtaccatttgcagtacagagtttttaattttgatgtagtccaatttataactgatctgttttaatctgatggtctttgtgaatcttgtcctgtccttggctttccccactattttggctactgggatgcttagagtcaaatttgtggctattggctttatttttatttacctttgtgcttcaatttccaagcatatttattttactccactatgtttcatgtatactgtaactcacgccaatccctcttagatcaaggtgagacatacatgaatgtatgttacatggccatatgggatactgttggttgaaagctctccaagttaagttatatgaacaataaaaggtcttttttagttaatgctccagttagccaatgagctggtggaactgagactccaatgtgaaaataacaaaataaactcacttcctgtgaatcaataagaataagaaactctaaaaagttggctccaactttacctttgttctcacacattactgaagatttctatcaactttggaagtatcaatcaatggtcctatcttgattaaa

SEQ ID NO: 124674 - DNA, 347 bp, Homo sapiens
aataagtcaactttgatgaccccatttaatgataatggagacaattgagacagatgatatgagaatttttaatatatatgcatccaacactggagcacccagatatgtaaagcaaatatgattttagatatatagaaaggtaaactttaatacaataatagctggagatttcaacactttactttcaacattggataggtccacttgacagacagtaaacaaagaggctgggtacagtggctcacacctgtaatcccagcactttgggaggccagagtgaacagattacttgagctcaggagtttgagaccagcctggcaacatactgagacaatgtttctacccaa

SEQ ID NO: 124675 - DNA, 125 bp, Homo sapiens
cttaagcacaggaggtcgagtgagccatgatcgcggcactgcattccagcctgggtgacacagtgagatcttgtctcaaaaacaaacaaacaaccctttgcttggcttttccttattgaaattgt

SEQ ID NO: 124676 - DNA, 734 bp, Homo sapiens
ggtgtggagggagtcctagctcagagctcaggcaggcgctgtgtttgcagcaaacatagaggtgtttcctccttgcaatggagcaggcagctctggaggagggattggaggcaggccagaagcggaggtggctgattaagggactgtctgcagaatggctgtgtggtttgtcagctccaggatgaactcaggcaattactctaaggatattgggcagtttgccctggggaaggggctagggctccatataaggaatgacacccacaggaagggggcacagggcactaacttctctgcccttccctgcccataccctaaaaagtggagggagggacagccacttgacaagtcttgccatgtgtacggtgtcctaggccaggcttcctattcaggggcgaggcttgtagagaaagcagtttactcggcagcagaggagagcctcaccaggcacctgtattaccagcctagttgattttcaataggaaatcagtctactgaagaccccaagaccgtagaggaaaacgagcagcataaagcaggaaaaggaagaaagaaaagaacaactgtcatcagaagaaataattcaaggaaaagaatgaacacattttaaattagcatcctcagattgaggttattttgtctgcaacacaagaatgggtcatgacagaggagcaatcagaaaagcaaagaattaatgaaaatttaaagtgtggttgcctccactaagagagttc

SEQ ID NO: 124677 - DNA, 344 bp, Homo sapiens
cctctctccactaattattacttagctctgtgttcaaaaagactcagccttctcatctataaatatgggggtaataatacccacttacatggacgagtgccagagtatataaaagcgctactgtaatgactggtacttactaactgtgcaacccatgttaattcctttccctgtgatatgttccttcccctcttaagaaaacatttcagttgtctgatgatggtgcaggtctctagaccatcccttttcctccagagttgggctcatggaccgtttgaatcttaagatcctggggcctcgttcttatctgaaaaatgcagctgcatcaccaccagtagggggtc

SEQ ID NO: 124678 - DNA, 641 bp, Homo sapiens
agcctattgctattttttggtagcacttttagtactatttgaattttaaaactacatattactgtggtataaatacaatttaaagctcaaacaagattctgaactggccaaagcaaatgtctcaacggctcattcagttttaaatctcagaaactggaaaaatcccaccagtcaatcagacacctgggttcagctctagatttgctggttaactaactggtcaatgtatgcttgatcacatgacttaaccactgttcctccattttttcatctgtaaaagtaggttataatctctctcatctgtgaaaaagctctctgagctacaaataagtggaattaaccatcctctagcattctatagctaaatatattgagggctgggcagggccaggcattctgatgcttacgctaggggaagatctttgaacacctgacttccctgggagaccaagagcgccacacagtgacttgaaagggccaggactgccctgtaacatggatgcccacaatgcagggtctctatcctgcatcccctgccctgctaaggggaaaagtcgttcagagcgggccacactggaaaaagggggcgtaagcgaatctgaattccatcaatggggcgtcgacatgttgaggccattgct

SEQ ID NO: 124679 - DNA, 554 bp, Homo sapiens
gtctgcattgttgtccatgtgtatctgtgtgtgtgtgtgtatgtgtgtgtgtgtgtatgagaaccttcacttttagaataatattacattccaaatcaaattctgcctcaaaagagctattcttccacaattttctgcatttctgtacaggttacaaaatgtcacaattcaatggggccaattattagattttcatttaatgggcagttttaatattctcagagaagctgaatagtaataacattttaaaccactgcattccatttaaagactcacaaccagttcttctctctttgagcacacctagttatatttttgggtatcatttaaattcaggctcccaatctgtagaaaaaatcaatgagttaatgaatagcttcattttgaaaacttttaaaatattttatcctaattataaggcatatctagtgacattaatttggcgaaatcccaaatcatcagattgtgcagaatagcccttaccaaggagtaatttagagcattttcagtttaacaaatgtgctgtttttaggaccagatcatggctttgctta

SEQ ID NO: 124680 - DNA, 220 bp, Homo sapiens
tacataatgataaattgcttatgttctgaaacagttgtctctctcctacctttttttgctacgtagtctctagtagttctgtaacatcttaggtaatttaaagagttttgtttcgttttgatcaattcatgacatgtagatgcataagagtgggtcagaacataagagtgggtcagaacataagggtggttcagaacataagggtgggtcagaacataag

SEQ ID NO: 124681 - DNA, 320 bp, Homo sapiens
ccgagagcaggtgcagtgatctcagccaagcttccctgtcccttagaaaccataacttgtgtcacgcagagaccgcagacagggaagtagcagagggaaggctctttctggatctgtgatgtttggttcttgatatcccgcccagatcccttttagactaagctcatgtcagaacttaacacttaacagatgcagatgtaagtgaatgtttacatttccaaatgtttaggtctcttagtctttgaatgaactcatccagagggtgaaagcagaatgggttcctaggtgcccctgaccaacacctctctctctctccagat

SEQ ID NO: 124682 - DNA, 501 bp, Homo sapiens
gttgtcttgggggcagcgccagccaccagagcccgagtcagcgcggccaggactctgcaggggcaggtagcgacccttagagacgcaacgtggcgcagcggactcggctgcgtggggcaagggccggggccggacacaggagcagcggggatgccgggtgcgctccgagggtgtggcccccgggctgtgcggggctcagagctgcttgctgggcgcggtgcccgacaaaggacagagaggagtcctgggaggcggctcatcattgctgaagatcaaggcttggaggagctactggacttggaggtgcagtcccgatgcctggagtccattcttgctgttcttgctgagaagatgttagagcaccacaggcttgttggccaaggtcctggaaaggtcttgctctgacacccaggctggtgttcagtggtgtgatcacagctcactaccgcctccacctcctcaaactcaatcaatcctcctgcctcggccttctgatgttta

SEQ ID NO: 124683 - DNA, 1172 bp, Homo sapiens
gttgtcttgggggcagcgccagccaccagagcccgagtcagcgcggccaggactctgcaggggcaggtagcgacccttagagacgcaacgtggcgcagcggactcggctgcgtggggcaagggccggggccggacacaggagcagcggggatgccgggtgcgctccgagggtgtggcccccgggctgtgcggggctcagagctgcttgctgggcgcggtgcccgacaaagttatcctggatcctatctttggtaccaatgtgacccatcctgagtgaaggctccatttctggcctttggtctctttctcggaaagcaggcctcagtggcctcagtttcttcccagaacctgcaatgccccaccaaggtgacaagaagtgcaaggagtcggttttcactgccaaccaaagaggtgacccccgcaaagcaaccatgttgggacagtccatttgctgcgttttgattatttgctaagagcaaataccttttctgtttgggttttgcttttagaaaaaaaatgtggcagatggtggtggctttccccgtcattgaaagaagaaaggtagtaactctactggtgcactcctctgagttgtgctaacaaagaagaatgctgaaagaaaagggaaatgaacaccattttcaggcagcttctccaagtttttttgacagtgttataattttcctttagcgactgttgaagcaaatatctgtatttatgttcagattaaaccgagagagcaaagactgctaaagccagtaatttctgggctgcaaatgcaggatagctccagtgaatttcagattcttaaaggtttttgctgtagcgaattcatgacacaaagcatttggagggaaacctattagagaagaaacacatcctaaatgagaattactgaggacgggaggctcttgtcatttattggattagttatagcactttacacaagcctgtaatatttgttctgctgctgtggtgtgactggtaaaatgaaaaggtatgtcaagggagtgcttgactgacgttcttatttcttccgtcttcttatattgctgggaggattctaccactgcagggctagaaattaatatcacactcatttgataggaagagcaaaagcaaggttatgagtcagagacattttggtcccagaacaataactctattgattg

SEQ ID NO: 124684 - DNA, 378 bp, Homo sapiens
tgagctgaaggaaacaaccagtacagagtaagcagtggatggctgcctttggaacgtggtcagatatgggttctcagacctggagaataattttagaggacctctagggatttatttactgactttcagaaaagtaccgtaaagactgaagagttaatcactcgactcttaggatgtaaatgccatagaaacacccggcttcaggtcttcataaacatatctgtcatgttgactactgtaacctagaatagtgtctgccacctaataagcatgagtatttgctgaatgaatgaagagtcacatactgcttttcattatggctaactcctttatgaggtatgcccaatcctgtcttgttttgcctcttactgtacactc

SEQ ID NO: 124685 - DNA, 137 bp, Homo sapiens
caccttgtttctggtggttaaatgctgccacttggcctttgtcaccacaaagtaccatttatttaatttagcccactgccatggttgggcctacagagaatagccaccagtgagttctcaaggatgccagatctccc

SEQ ID NO: 124686 - DNA, 647 bp, Homo sapiens
tgcatacccaggagagtaagggttcttcacaggcaggtcccttggcctgggcagagctggctcagtgtgtgtggactgcgcaaacagtgcagttctgctgaggggtatgctggctgtgcctcatttgtttttggcagttgtggaccctcatgtccatctctgtggggtcctttctgatctatttaaaggacatatggagaagcaggatagctagggcacaggggacaacctcacgaccgtcacctacttatggcagcccccaccggggtgccctctctcctcacacactccacctgctgccagaggaccctcagacccaagcatctgcctgctctgtgactgagcgctttctcatgatttaatctctgagggcgggtaaactgcccactttcccgtgactttttctttacagctctttctgtcaaccagttaacgagttccctgtctggctctatcttgctactgtccccatctgtggcttgtcttttcactccacgctgtcttttggtcacaggtaatgtcctaatgtttcttactatctaatgcaatcacttttttttttggagacggagtctcgccctgtcacccacgctggagtgctgtggcacaatgtcagctcaccacaacctccacctcctgggttcaag

SEQ ID NO: 124687 - DNA, 168 bp, Homo sapiens
ctcgtgatccgcctgccttggcctcccaaagtgctgggattacaggcgtgagccaccgcacccggctgaaaattgtccctatttcttaactacaatagtgaaaaacagaatcgcagaagtggttatgagttaagactacttagaaataagaatggaatcagtgacaga

SEQ ID NO: 124688 - DNA, 1114 bp, Homo sapiens
ccgggaggcagaggttgcagggagccgagaccgcaccactgtactccagcctgtgtgacagagtgagactccatctcaaaaaaaaaaaaaaagaaatacaaaatctgtaacaaacgaacagctgatggagaacaggacagcatttacttctgaatctataaagtacttaagaacttatacttgtggaaaatcacaatgacaatgaatatttcaccaaatagatggtggcaaatagtttggcaacacatattagaaaggtgatttctatactacacataaatgaaagacaaaccgaaccacaattgatgttttactacattaatgtaatttacactatgcctatacccacatggcaaattcagttataactgaaaaactagagcagtccctttttttttactatgatttgcatattttccagtatcctaatacatgcatacttatcttttatagattataataatctacatttaaaattccattttaatattgtggcatgaaaaatacaaacaccaatacagtatgttttatgcttactcaaagttaactggctcagagttttaaaagctttcccggataaagcagagtcaagtctaccctatatccccatcctataaattcctctttgtcgaacctggcaatctcagtgagctatgattgcaccactgcacttcagcctggacaacaaagtgagactctgtaactataaaaaacaaaaacagacaaacttggctatctacctcaatccatcaatcaccctcatgcctttgaacttgacaacatcactcctcatcttagtttttaaagtaaaagataggaatagtaatgtaaagcattcaaaacaaaaatgaaacctgcatatttgtttatttatttatctgagatggagtttttgctctgctgtccaggctggagtgcaatggcgcgatctcgactcactgcaacctccgcctcccaggttcaagcaattctccttcctcagcctccccagtagctgggattacaggcacccaccaccacgcctggctaatttttgcattttttggtcaagatgaggtttcaccatgttggccaggctggtctctaactcttgacctcaggtgatccacctgcc

SEQ ID NO: 124689 - DNA, 1067 bp, Homo sapiens
ttagaatgatgttatgattaaattttatttttgtctggatacagtggctcacacctgtaatcccagtgctttgggaggccgaggcagatggatcacttgaggccaggagttccagaccagcctggccaacacggcgaaaccccatctctactaaaaatacaaaaaattagccaggcctggtggtgcacgcttgtaatcccaggtacttgggaggctaaggcaggaggatcacttgaacccaggggaggctgcagtgagctgagatcgtgccactgcactccagcttgggcaacagagcaagactccatcttaaaaagaagaaagaaagaacttctattttttaaatgttttttcctttcattgaactccatttatagcctttccattcagagcataaagattaaattttaaaacaaggcttggcaccctggcttatgcctgtaatcccagcactttgtgaggccaaggtgggcggatcacctgagctcagaagtttgagtccagcctggctaacatggtgaaaccccatctctaaaagagtacacggtcctagagcagtggtgtgcgcctgtagtcctagctacctgggaggctgaaccaggagaattgcttgagcctgggaggcagaggttgcagtgagccaagatcgcaccattacactccagcctgggtgacagagagagaccctgtgcccctcaaaaaaatgttttttttaaacaagaatctctcaggcatactgaaatgttgaagaggaaattatattaatatctgggacttgtttccaaatttggaattggggcagggtgtaaattgttggcaatatcaaagaaacgaggagttggaatgataattgtagaagctgcatgatagatacacattctttatacttctgtatatgttgaaattttttatcaaattataattgtgtataatgactaattatgctttcattgtctattctgtgtggttatgttacttgctgaaattaatacataaagagtcttcaacttaaatgacttatcaagcataaatattaaaatactggatgttactacaaatttgactcc

SEQ ID NO: 124690 - DNA, 128 bp, Homo sapiens
aactacagaagcttactgtctcacagttctaggggccagaagtccaaaatcacggtgttggcaagcttggttccctctgagagctttgagggaagagtctgttccagggctctcccttggacttgtag

SEQ ID NO: 124691 - DNA, 291 bp, Homo sapiens
ccgttttggcctcccaaactgctgggattacaggcatgagccactgttcctggccccttttttctttctttttcaaatttttcttcctaatacagcagacttccatacctgtctgtggttgaccattagttttccctgttctctgcttggtgattgatttagtgatttctcagcaggtagtaagctgtaaagcgtaagcataattatcatcttgttcagtacttactctcccaaatgcaccataatcatgaactgtgaaattctcttcgttcatggctgagtaagtgtggg

SEQ ID NO: 124692 - DNA, 212 bp, Homo sapiens
atcacagtttatctgttaatcacttgttggacatttgggctgcttctagcttttggttagtacgaataaagagtctggacattagagtgcatgtctttgtgtaatgtgttttcatttgtcttgggtaataacttaggaatgatattgctgggtcatatggtaagtgtgtgtttaactttataagaagtatatgtttaacaaactgcccagct

SEQ ID NO: 124693 - DNA, 648 bp, Homo sapiens
gatttgagcctcattcagattcaggttcagatttcatgaattatcctgtacatctatgtccccagacggtgccgtcccattagggcccctggttttacagctcccagcccctctgcctgtaactcttactctctgtcctgggcaggggtaaagtgggtgcctcagagccctgttgataaacggcagagctgggcttgaacttcggaatccaagtccacaggaattttcacattttgtagcttcctaaatggctttatcatattttcacccttccataggtgatatatccctcatctaggaactttaaaaactttaacaatttaatccaaatgaccctaattaataacaagtgaatacctgtcctcagaatctcctgaataatctggtattcaacaggtgcgctctttggaggcagagagcagatgaataacttcctttaaaaaataacaatgccctggagaagtacatagttaatttatcttatctgatgtctacactagcatacacaggtaactgtcctcccaagaaaggtcattcccaacatgttcccagaacaaagcattatccatatcacgtatcaatcgttgccttttgcattcacttgtggtatttaatcagttactttgacaagcaaggtttgaataatta

SEQ ID NO: 124694 - DNA, 705 bp, Homo sapiens
ttaccttttaacatagttctaggaatttctcttaagggaataatgtaaaatgtgaaaggttgtatgcatgaagttattttttatagaattatttataattgggcaaaattagaagttgtttaaatatccagaagtagatgaacaattaaattatggaagctctattagatgaaacatgatgcattcatttaaaaataatagtgaaaagaattcgaggttgcagtgagctatgattgcgtcactgcagtccagcctgggcaacagagcaagaccttgtctgtagaaataaaaaaaaattaaaaataatggttaagtgtaagcagcagcgtggaaaagtgaatgatgcagtattatagtggaataaaagcaaattttattatgatcaaaactttataagataatacatatcctttcatccttaagggaaaaaagactgaaaaaatttatcaaaatgtttgtgatgtgaggtttttagtgatattttcctccctcttgctaatagaattatctacattgtatatggtctcataatgtcccttctaaaacacagatttgactatgtcattcctttgcttatcgctcacccaccctaacacatacaacaattactattaggcagattcaaaattgattagcttgatattcaagacctatcacagcctttttctccagacaactatctagcctggacccctacataacttt

SEQ ID NO: 124695 - DNA, 479 bp, Homo sapiens
aacagactaatatagtaataatatgtaaatacatcacgggagacagaattgttaagtatattttgaagttattagataattgaacagttctatcagcattgtacataacaaggaattttttgaggtattaaaaataactcagctaaattctcctccttctacagttaaaaatataaaaagattttggacttttagagatcctagcatacattttcattttcatagtgtttttaattcatgaaatagattattattatcaataatataacaataaggaaactgtggttcagaaacattgtttatacaagattgtatacctatggacttgacagagtcagaccttgaacctaggtttttcaacttgaagacataatgatttttctcttcaatccatagtatacagtagagataaattggtagttttcatatggcctgaaatttcagagatattcaactttctgtgtcactaatataatttc

SEQ ID NO: 124696 - DNA, 130 bp, Homo sapiens
aaccaggtacacagagtccataaagaggacaaccaaaagggagaggtcatgtggtcatgaagcacccctttgaatgtggaaatgtgaagaaatgagggcaaatcataaagcagcagtgactttcttgcat

SEQ ID NO: 124697 - DNA, 415 bp, Homo sapiens
gggggaaagttgggcatgtgctcgggttgtttgtgaggccataagggaggcccatattgtttggaggcttgggggaatcaggaggatgttcattcctaatggaaccaggtagtgggttgggggtgagggtggtggctctcttcactgagaggtatggcatgtgagcaagcttcaaaggggagaaagagggataaggagaaggacctttaagaggagggcatctgccaggtgcagtgcctcacatctgtaataccagcactttgggaggccaaggcaggaggattgcttaagcccaggagttcgagactagcctggacaacataaggagacctcatctctacacaaaatttttaaaaaattagctgggtgtggtagtacacactggtggtcacagctacttgggaggctgaggtgg

SEQ ID NO: 124698 - DNA, 291 bp, Homo sapiens
tactattttataaatgagaaaatgtagatgtagttaataaattcaccctaaaagaaatgagtaataatgataagggtgagtaaaaactaaacattggttaaattcttccccacattgattcagctccagttaattttagagaattagctcgtgaatatttaacaagatttatgtgggatgaaagaatctgctgcattttaaatactactctagccttcctcaagtattgtcagatgaatactttgttagctaaagcaaattggtgtcccatatatatggcatttacatttt

SEQ ID NO: 124699 - DNA, 639 bp, Homo sapiens
ggaatgtctcagtgtaaaacctgattgtatattccatctactgagataggagaaaaccgccttagggctggaggtgagacatgctggcggcaatactgctctttaaggcattgaggtgtttacatatgtgcacatcaaaagcacagcacctttttctttaccttgtttatgatgcagagacatttgttcacatgttttgctgctgaccctctctccactattaccctgttgtcctgccacatccccctctccgagatggtagaggtaatgatcaataaatactgagggaactcggagaccagtgctggcacgggtcctccgtatgctgagcgctggtcccctgggcccacttttctttctctgtactttgtctctgtgtctctttgttttctcaagtctctcgttccacctgacgagaaacagccacaggtgtggaggggcaggccaccccttcatctggcgcccaacctggggctaagggatctattctatttatttgcgctgactgaattttttcttccactaatttaatttcttttgttgcctctggggttaatattcttttaagtctggttctcctcttaagatagagagcaaatttgacatggcataagtaggaatgcctaaagttggccgaat

SEQ ID NO: 124700 - DNA, 413 bp, Homo sapiens
agacctaagatcctacaaactaagcatgtgggaccatcaaatgggcttttctaggctgggagtccacataaaagcaagactaacgcattctttttaagaaagaacagaaatctttcagtgatagataaaaattagatacggaaagttcataaactgggttaagtgaatcattagatcgtgctgttatttgctaaaaataataaaaacacacactgaatagcaaatggccatgaatatttaaccatcacagattccttttttatgtgcagtgcattgtagctgttctaatgtacaacaaagaaagaacagtgggaaagtgctgtagacctaatggggatttttgttgtctttctaccgtaaagaaatgaatctctcgtcttgtggtttcaaaataccaatctttggcaactaag

SEQ ID NO: 124701 - DNA, 749 bp, Homo sapiens
ggacaatttagcagacgtcttgtaaatccctgaaaggatatgtgaaattatctgtgtaaatgtttgtatcaagggatggtaatatatgtattgtcttgatagagttctatagatgacctcattatgctcctatgaaagtaaacttgtgtgtcccaaatctgattataaggaaattatgctttcttaccacgttagattagagctggtaaacattatttaggagagatagataataagcaaaacatacatacgtacatatatagagagagaaaaagaatatataaacatatattctctagagagaataaataaaacatactatatatatacaactgtatatatatagtatacttatattcaattatagtatatagtatgcaattatagtttatagtataagtgaaaacttaagagctaaaggttgttggtgatgatagggtagcatagatgatttgttctcctgttactgccaattaacatatttgtgtatgtgtcttttcacatatgcatgagcatattaatgggattaaattcttggaaaactttctaaaggaatataggcatgtaacactttcatggtattgccagattgctttaatttctcctttaaaaaaaagctttaggccaggcacggtggctcacgcctgtaatcctagcactttgggaggccaaggtgggggatcatttgaggtcaggagttcaagaccagcctggccaacatggtgaaatcctgcttctactaaaaatac

SEQ ID NO: 124702 - DNA, 519 bp, Homo sapiens
tgcaaataattcatttgacagaacgcccaagaattcgtcctttaccccgtaagaatacagcagttccccctcatccatgagggatatgttccaagacccctggtaggtggctgaagccatggagagtaccgaaccctgtatacgctacattttttcctatacattggtgagtgggtagtgtatacagtgtggatacacatgctactcagaatggtgtacaatttaaaaattaggaattggctgggtgcggtggctcacgcctgtaatcccagccctctgggaggccgaggcaggtggatcacgaggtcaggagttcaagaccagcctggccaacatggtgaaaccccatctctactaaaaatacaaaaattagctagttgtggtggcgcacgcctgtaatcccagctaattgggaggctgaggcaggagaatcacttgaacctgggaggcagaggttgcagtgagccaagatcgcaccactacactccagcctgggtgacagagcaagactccatctca

SEQ ID NO: 124703 - DNA, 419 bp, Homo sapiens
ttaccatggccatcttcaccatgcagtgacagtcctagtgtatctcctggccacaggccttggtgagcacattcagctaccattgattctgtgtccaccacgttcgttaacctgtcattagaatacttcctgatgagttcccctctttgtgtgagtgtcatgtccccagccagattgtttttagctctttatgagctgggatcacatctcctattttattttctgtccctttatcagttccctgataatagcaggtcacttgatacttgtttaattaacagggcagaacagactgtgtaacttgagtaaagggatgctgggtaagtgtttctggaacacaggttgattttcttcccccaacacatctgcagtggctattataaaatgttctgtaggatggtcaatgtgctagccattca

SEQ ID NO: 124704 - DNA, 432 bp, Homo sapiens
gtacgaatactttaatggaaatttattggagatgagaaattatgaaattcacagtctttaccattcaaagggaagttgttcatctcttacaatatgtgcgattagatcattgataccagtttgttttttcaacagaaacaatcaccttaaaactttacattcggggtaaaacacatctggtagaaaaatcaacttagtttcattgtttagggttccaattagatgattaaatactttctctggatttgcaagagtcaaagaaacaggttacacagagggtaagaaaaactccttcctgttaataacacaatgttagaaggtcccttacaatgtaactaaaaaatgctcaggcaagaaccatcctaaataatatatcagtcatttcttgaagtagcaagtgttgccttaaaataatgttttatgaatacccat

SEQ ID NO: 124705 - DNA, 459 bp, Homo sapiens
caccccacctctcccactcagcccctgcgcccaagccctggctcatgcctgcctgctgcccgctcatggctgtgcgcagcccgctgccatgctcccttggaaagccctctcttctctccatctagccaagctgactccctcagctcttttctttcccctgtgtcactgaagccctgcttggcggaaggccctggagctacggagaggaaggaaggctctgcggcgctcccagtcttgggagggataggggcaggtgagttaacttctggttatcatagctaaggtatccaggggcagtaagtaggggccagggcaaacggtttatgcttattaattcacgtcatcctctcaagaaccctgggaggcagttattatgattctctccattcctcagataggtaagtggaggcatagagtccaaggtcacaaaactagtcactggtgaagctgggctttgaa

SEQ ID NO: 124706 - DNA, 478 bp, Homo sapiens
gttcaagtcaacagaagtccgtaagggagcatggtacacagacagggaaaggcactaactgcgtgccggatattgagagcttcaggagaagggaagccatttgagggtcatagccctgatgcttaaggacagatgacacgggacactgaccactggttcggagtgattgagtccaggtcagtcatacttttgctgggatctccattccattttgcaatcatctcactggaaaggtccacccaagtagccagattgtccaaggagcttgaaggcattccacagtcactcctaattggaacgtgctgggctcaccctcttcccaagaggccatggagataacaaggacataactcagggacatcatgtgaaaatcagtggccctctctcatgcatagcagtaagtgaatgggcctgattctctctttattatatgtctttcttatcaaggtgagttatcttatttgtgcctttctcccac

SEQ ID NO: 124707 - DNA, 443 bp, Homo sapiens
cctcaggtctcacctcataaggaaagcttcactgaccccctttatctaatgtgagtggcttccccaattaccctctaatatagccctgtggcatttatcacaatctctaatgatcttgttcctttatgtatctacttatttatgatctgtcttttttttttctcttgagacagtttcactcttgtggcccaggctggattgcaattattcacatatctggctgattattcctcaggtctcacctcataaggaaagcttcactgaccccctttatctaatgtgagtggccttccccaattaccctctaatatagccctgtggcatttatcacaatctctaatgatcttgtccctttatgttatctccttatttatactctgtcttctttttttttttttttggaacccgcttttcagggaaccctcaaaactccaccctgcggg

SEQ ID NO: 124708 - DNA, 442 bp, Homo sapiens
tgtgctctattcgtgtgagttgtagtctgttcgtgtgtactgtcgtcgaagtgtgtactttattggtgtgcgctgcagtctactcatgtgtgctgtagtctatcagtgtgcacaagcattctgtctaaagcaacaacgtgcatcccttaatttaaaaacactttactgctaaaaaatgctaacaatcatctgagccttcagtgagtcttcatctttttgctggcagacagtctgcctcgatgtggatggctgctgaccaggcacagtggcagctgctgaaaacggggtggccgttgccaattcctaacacaacagtgaagcttgccgtatcgatggactcttcctttcacaagatgtctctgtagcatgtgatactgtttgatagcattttacccacaacagaccttctttcaaaaccggagtcaatcctcacaaatgctcc

SEQ ID NO: 124709 - DNA, 751 bp, Homo sapiens
ggtcattaattaggaggttttctaccctggttggtgatgatataaacttcctgcctttgtgtatgctgtagtgatttttcagcctattctttttcactggtcttttcctaaccttgagtgattctcttatatgcttatacaggtcagtactcaggagacccttctgcagatctccaacattttatatcagtatagctctttcttcgctggcatttactcccacaaattctagttgccagggcttccttaaacatccaattttgtcacatcagcttgccaagtctgccaggctctgttttggtattctttttccgctctggtttggcaactctctcacaagtagcctgtgataatcatagggctcacctcattgtttctctactttcaaggatccctgtctgcactgcctcttggctaaaacctaattaccattttttatattttgtttggttttttagttgtctgttatggaaatcagttccttttaccctgttacagccagatatggaagtccttatgaaatctcttcctcaataaccaagacattggccattttagaattttatgttacttaggtgtgcagttcaggggttcaaggagattgatcatttatgagaataagaaaatgttttttggccaggtacagtggcttatgccaccgtactttgggaggccagggtgagacgattgcttgaggccaggaattcgactctatctttacaaaaaaactttaaaaaattagccgggtatg

SEQ ID NO: 124710 - DNA, 402 bp, Homo sapiens
ggctggtcttgaactcctgacttcaggtgatccacccgccttggcatcccaaagtgctgggattacaggcatgagccaccacacccagcccttgttttgtttttaaatcattgtcctctctgctgttgaccattacactcatagcaaaggctgcctttctaattagtgccagtttcactaacgtggctaagcagcacgttttctgagtctgcatgtgctggccacacttgccgactgacacacagctgagatggaggacttcagagttcaatgactgccatttcttgggttttatcaccctatgtgtaatctggtatacctggttaataaatccaattaatgggaagtgtagccttctccttgttttcttcttaagttctttggaaagaatatttgtattat

SEQ ID NO: 124711 - DNA, 263 bp, Homo sapiens
tgcattttaaagagtagtagccaatcagtcagtaattaatcaaggcctctcctttcggtgaaggaggaaggcccttgctggttgtggtggggaatctccggaatctggtagtctgggttaaatggctcatgttggaaaagagaagtggtgggagaaatgccttattaattgtgaacttgattgagctttattcacctttaaaataaaattttcaggtcggggcacaatgactcacactggcaatgttagcactctggaaagtg

SEQ ID NO: 124712 - DNA, 495 bp, Homo sapiens
attactcaacaaaaggttttaaatccatgtaaaagaattcaagaggttgtgaaatagttctaggcttgctaagaatatcctttggctattttgaaaatgaagaaggccaataggatatatcttagcatccaagattaggaaaaattagtgtggaagagagcactttgatttgaggctacttgatttaatacaaaaagtagcttatttaaaagtaagatctttttaaaacaagtaactcatttgaaatatgggaagctataataggagaaaaataggggattttagtttcttctgaaatctaaaattactgagcagtataaaaacagtatattagaatgatgtcatgcaagcaatatatgcatatgttcttgaaaagattcagacaattcagaaatagagtaaaaattaagagcccctatcccatttatctcgagcagtattagatttttttaaaagagcagaattgtcctttttcccctagaaattaaaaaaaaa

SEQ ID NO: 124713 - DNA, 310 bp, Homo sapiens
cctatcaggtgcgccgatgtggtcagcactagggctcacctcactctgcgtggaggtctctggctatttattctcagtttggtactctggttttgttattgattctcatttgtctggcatctctagtggaatcaggccattctttttatcccttttcactgtattttgtgttagtgtttagtgttgtgctgtcaaaaagtgctgcttgtcataagaaggaaaaccgtaggaaaggacacaggcatggggctcataagcctcttgtttgagccagcctcgcagctcatgatttagcagttctcatcacacc

SEQ ID NO: 124714 - DNA, 455 bp, Homo sapiens
tcttagagatctattttgagctgagcattaaaggatggatataaggagaaaactcagagttcagatttgatgcagcagtgaaccaacgaatttcctttgctcatcccatttatattacattctatcctggtcattataaattaacaacatagctttacttgcccagtaacatatcattacttgcagaatgctatttatttcacagaaattgatatactgaaaggaactaaaaatatctttcttattctgtgaacatgtgtaaccaatattatgtccttctaataatttgaagcccttcattcaccaagtgctatttgtaacactttactaaatgttaatagaagaagccctctattattttacttctctgaagatagcaattatgaaattgtccctgctgaatagcaaactatgttgataatatgcaattaagatgcatcatcagaaaaagaaaa

SEQ ID NO: 124715 - DNA, 139 bp, Homo sapiens
tgtgaccccaagctgatgggaagaggatgaccataggacttcaaaatgtccttgagctgtaaattctgtaatagggtcaggcccaccagtggccttcaggcatttgtccagtggtgtatggataagttctagcacttga

SEQ ID NO: 124716 - DNA, 168 bp, Homo sapiens
tgctgtcacctaagactgctgaacaactagttgtatcaataacaacttttgccttcatagctctttatcattttcatagctgagttcagtgggtatcaatacccactgaactcagctggtcaaagaccagcagcaccaagaaccaaccactttcctctaaaagcagtt

SEQ ID NO: 124717 - DNA, 236 bp, Homo sapiens
aaaacattatgcctaacattaataaaagtccatttcaagtgctttacagcctaatttaaatggcatatacttaaagtactttaatttgcaactctgtggaataatagcaactattatttttttgtgccacttatgttccagacattttcctaagctttttatttcattagtcccctcgacaactcagtgagttatacacaattatcctgcaatcacaagccatgggaagggattct

SEQ ID NO: 124718 - DNA, 278 bp, Homo sapiens
tcttctggctggacaggggagcttttgttgggcactttctgtgtttgtgccccactggcattttcaggtggtcagcttctttctttggctccaagtctgggatatataaagcaaagtaaacccaaggaactcagtactgtgtcattcctcgagtcccaagatccctggttggtctgcctcatcctttttcagaggctccctgtgttttccttatgtatagcccaggggttttagttgtagttagaagaaagaattaggaaaagtcctattccatcttc

SEQ ID NO: 124719 - DNA, 554 bp, Homo sapiens
tttactgcttgtcgactctagagtatacctgagtcgcgctaaaagcgctcaacgtagattcctatttaacgctttaaaggcgaacacagtgccatcttactagagctctactcagcaatcctgtattcttatctctggtcattatctcaccgcgtcttgacttggagaaccctcgcgacgccgcgaaccctaacctggatctggttaataccttcatttcacctcatggtccacaaacttgtgggcatctttgccttcttgaaatggcccccaaggccatcctggcttatggcacctggacttctacagttctgccccctgcctgcttattctcctcctccctctgattcattctctgcacagtgggcattgctctccttttacaggtgttcatcagatcatgtcagccctacacttgacaagactttccagtgagttctcattgtgcttggagtaaaatccagccactttatggcccataggacaatggtctggctctgctttcctctgatcccatcaacgatcccatcaacgactgctccccactctgacct

SEQ ID NO: 124720 - DNA, 459 bp, Homo sapiens
tttccatttctgaaccacccttaaagaaaatcatttatgggatcactatcctcatgatagtccaacagagcaaccatgccatctggattcatgttttcaccagtaaagaactagtagcttttgcaatcagcaaggatgtgcagcctctgtcgcaaaaggttttactttttctggtctctgttcttcaagtttgcctttgattgttttcatgtaatctttgatgtagttcttgtaggtgttttttgtgaagctggtttcttgcaagtgatagtctgtgacagtatcaacagtgataactgtggttttggtacctttgccctcgggaccttcagcagaggcatttccgccaatgagcaagtcatcagtgttaccctctgtcctactgaccatattcccctccaccaccaggcacagcccatctgcaatctcccaaatctcataaatgtggaataacaccta

SEQ ID NO: 124721 - DNA, 208 bp, Homo sapiens
tatgtctgtagtgcctagaagtacctaacaggcaggtagtagacattcattaatattttttatatgaatgaatgactacaagtagggtgggccctgaacaatttgtgataaagagggtgcactttgtttcagtgcatttctagggtttttgtttgctggttgaaacaataaccccactggagagagaaaaagcagggagtgaggcaga

SEQ ID NO: 124722 - DNA, 224 bp, Homo sapiens
gaagtggcacttccaggccgcatttagttagctatctcatccactctcttgagagttacttttaaaggatattagtacaattgtcatccaggaatctaatattacttgaaatttacctgtttttaattgatccatttcatttgctgaaggacatgtattagaattttacagaatcataaaatttcagagttaagggaaatcttggacttgggggtggggaggat

SEQ ID NO: 124723 - DNA, 163 bp, Homo sapiens
tatttctagggaataactagaaatagcttaagagggaggcagtgtggtgttttagttaagatgtgagaaagtgcgttatctagtgatcactgttacctttctagaacatctaagcaacataaacattctgaaccgtagttttattctcatctagaaaaattct

SEQ ID NO: 124724 - DNA, 485 bp, Homo sapiens
tggaatggagcgggcgggctgggcttggccgcgaagcccatcggaggttttccaagtgcaaaaagatacattgtttgcaggttggaggccaagtctggatctcagatggctgcctcagatgaggtcagcggcaagtgttgagtaggggactcgagggtttctatctaggggctgacctcaatgtctggggacactaccgcctcattaacaagtcagtatccacaaggggtagggcaaggcctcagcctggaacatttctggcctccttctaactgggaccaccactaaaccgactggtcccaactacccagagggcacctggtatacactgaatgcaatgtcctagccagtcagtgcccagcctggtggggacaaggtccccagggcaggctgggccggaaggcacggccatccctgcttatcctataggcaggcagagctgggacgggcaagcacaggctcagacttccccaaggtcactcggc

SEQ ID NO: 124725 - DNA, 562 bp, Homo sapiens
tcattgcctggatgaagcccctgcaacaggagagcttttgcctcctctgcctcacctcagccccctagacctctgtgtgcaactggagtatggtgttaagtgagcctggagcagtcttaggaaaaggcttcaagtgaggctaggtgggaaggcctgggacagaaataaattcaaaacaacaaccaaagaactgataggtggaataaaagaagtgggacagaaaagattcaaaggtgggaattgaaagagagaggtacagtaagaatagctggcgtccagtgaacatgtacagtggaccatgcacagttccaagcacgttcgatttattatttcatctaagactcacgagaactctataagacaaaggtctgacattctcatccctgtgttagatgtgaggaatctggagcacaaatgtgtaagtaatttttctgttgagaaatggacctatcaggggttgaacccaagcagtttgcctccagttaatgtccttcgccactttatattccacctatcagttctttggttgttgttttgaatttatttctgtcccaggccttcc

SEQ ID NO: 124726 - DNA, 534 bp, Homo sapiens
gcgaattcactagtgattgtgagctgagatcgcaccaccatgtccagctaatttttgtatttttagtagagacagggcttatcaccatgttggccaggctggtcttgaactcctgaccttgtgaactgcccgccttggcctcccaaagtgctgcaattacaggcatgagccactgcacctggcctggacagggactttttaagggaagaagggaagcaaagaggtagagaagagaaacactaaaagggcgctaagaaaaaaaccactcaacgtggtaaagacactttggaaaactattggcaatttctttttttttttgagacggagcctcactctgttaccagactgaagtgcagtggcgtgatctcggctcactgcaacctccgcctcctgggttcaagccattctcctgcctcagcctcccgagtagctgggactacaggtgcacaccaccacacccagctaatttttgtatttttagtagagacacggtttcactatgttggccaggatggtctcgatctcttgacctcg

SEQ ID NO: 124727 - DNA, 855 bp, Homo sapiens
ctctgcctttgcctcttttaaaatgttctaagttgctagccaatcaggacaaatacagaatgtgaggtcctgttccagccaatggaaactggacacagcagtaaggtggacgcgtcaacttataaatgaccctgcctcctttgttcggtgtactatcgtggcaaaactgctggcaagtgtaccctttctgtagaaagtaaaaatggccttgctaaggaaattaaatttatgttcaagtgctatttctttattgcaccgaggaacaagcatttctaacagtaggttttagtatatagtttagatgttccttatgttgattgacatttgatggctcttcagtggttcgaagatgccagaaaagaacaatgagaatggccagaaaaatctagaaactatggtgaaagtacttacaagttgaatatagccataatagaactggattgtgctagaagtgactaaggttggcagtggaattgggagcttagtaggcccaatcaactgtgtggctttcttcacttaggcagggaaaatgtggtatcttaggatcctcttgcagtaatttccaaacataagagctgcgaaataagttataattggaaaaaaatcttcaatgatgttgaaaatatttttccctctggattagccttctcttttattctcagtcataattttagtagggagttttgttgtcactttaagggtattcattccatttcgacttgtcacccagattctcttcgaggatgacaagaacagccagtagtggctggcttgtggctcttctgtgctgttgctggctgcagccaaacaggaaagggctgttcggagtttctattggaaccatcaggaatactg

SEQ ID NO: 124728 - DNA, 702 bp, Homo sapiens
gtgtctcaaactcctgggctcaagcagccctcctgcctcaacatcccaaagtgctgggattataggtgtaagccaccatgctcagccttatgtgctcatttaaaataattcaattttattcattaactcagcctctttcaggcaatgctcggttagacttgtatacatttaactttatttactagaaagtaaatcatttatttaaaaaaatccctgtgattaagactgcataccagggccttgacatgagttgcaaatgattgattaataaatgagtgattgagggagctggcaggtagagaaccagcattattatagtttctgagaagacatgagataatttcaatgaggaggaaatggtcagtgaagtcaaatacactgagaagttaaagtaagtgagagttgataaaaatctgtttgatctggctgagtgcagtggctcacacctgtaatcccagcactttgggaggccaaggcgggtggatcacaaagtcaggagttcgagaccaccctggtcaagacggtgaaactccttctctactaaaaatacaaaatttagctgggtgcggtggtgggtgcctgtaatcctggctacacaggaggctgaagcaggagaatcacttgaacctgggaggcggaggttgcagtgagccgagatcacgccgctgcactctagcctgggcgacagagcaagactccgtc

SEQ ID NO: 124729 - DNA, 571 bp, Homo sapiens
ctgtatttagttcatagctccagtgttattcattgatttattaaacgtccccgcttcagacagaacccctaccgtccagttacaaccggattgaaaacccagctccttcccgtgaggacctcatgaccagctgacagatctaagcctataagcagataaatcatcccacagggtagctgtatccatgcaagaaacatgccagaggctgcgagtcgggtggagtggagaatgggaaggctttctaggaggtggatccctgggctgagttttgagggcttaggttatactgaggcaagaaaggagggcaggagaaatgagagctattttcgggtagaacagccaccatgaaaaatatctgaggaagctaaaagtagttaagtttctgtctgtgtggcaagatctgagactggagaggttaaagataactttctcctataaaaaatggtaagctattaaaagattttaagccaggtagtggtcagatttgcaatttagacagatgactttggccactttttggaggacggattaaccagagaccagtcaaaagcagttgaatagacccagtaaa

SEQ ID NO: 124730 - DNA, 332 bp, Homo sapiens
aaaatataactcttattatttcagcaaaaaaagtaatcaagtgtactgaaaattaagattattgaactggagcagacaaagtaaacaagccaatgaatatagcatattatctgttgctcaaatatatactctgcaacaagaagaaagaggcaaaatgtaaaaatgattttcaggggaagaacaaattataagttgcattgatctggagcaggcatactcacataagaaaattgtggcaagtaaaacctgccatgaaattaaaggaagagaaataaaactagaacaaaagtggcatgaaaaccatccttttcttcttacattagtgagcattg

SEQ ID NO: 124731 - DNA, 202 bp, Homo sapiens
agaggaaggatgccacagcctctgctgaaacaggacaggccacgtctgatgactttttatgttcagcatggtccattacaggctagcggtcaaaaaatgttaaatggctgagttttgccctctacctttctcctacttgatctccttccagcttttcctctcacttttcttaattcccttccctcttctttcccctttttct

SEQ ID NO: 124732 - DNA, 793 bp, Homo sapiens
cacggtggctcacgcctgtaatcccagcacgttgggaggccaggcgggtggatcacctgaggtcaggagttcgagaccagcctggccaacatggtgaaaccgtctctactaaaaatacaaaaaattatctgggcgtggtggcgggcgcctgtaatgccagctactcgggaggctgaggaaagagaattgcttgaacccgggaggtggaggttgctgtgagccgagatcgtgcaattgcactccagcctgggcaacaagagtgaaactccatctcaaacaaacaaacaaacaaaaagaatatatccatattagtaaaaactctttccccctttttactaacctactcccaaaacagggataacctaagctcaataaaataaaggagcctactatcagtgggtttacctcaaggggtttaatcattgtcctggtaaaaagctcttctgtgcttcccaaataagatctggctagatatacagattcagggccccattcaagagatggtatttcagtgggtctcaagtcaggttcctagaaatgactatttttaacacgtgtaccaggtgctgcttggtttggtagttatcacaggccattctactctttacctgtcagtttaattttgtccactctgagataggttttctaatagcatgtgtcgaataaagtatccagcctggtggattatcagtgaacaaacacaactgagcacaatagttaagtgttcattaggtaatacgcagatgttcttgtcccagtgattcgtacagagccatctgtctggaggtagata

SEQ ID NO: 124733 - DNA, 406 bp, Homo sapiens
tgccacttccctgctgaatttcagtgttctgtaaaaatttttatttgtttttaaaaagtcttatgtaactatagaattgaaattattaatggaatagaaaattaaatgtaagaaaaagcaagaaggaagcaagaccaatatttaggaggcaatcatctctccagatgactcacagaagaggaaatctcaaggagtagattatttttaagaagtttctggtacagttcctctgaggtcctgtgactacccctcccccaggaaataacttttttatttaaccactacattgacatctacagaagttgacacctgtaagttttagacataaaattgattcaacttacagtgcaacaatttaaatgtatgcatcactgctatattgaaaatataatatgtcgttagactt

SEQ ID NO: 124734 - DNA, 567 bp, Homo sapiens
ttctacaggggtttatttttacttaatgtattagtcttcaggtatcagggttgaaattattaccctgccatttaatgtataagaatttattttcttcagtatgatctcattctcattccctgttcttaataaaaggaggacctgtgtgattataggtccttggatctcacttaacttaaaactgttgtttggatggactcagctcatttaggtaagctaagtattcagcttattcaaagtttaaagcttcctcacagcttttggagacctcctctttcccttatgctcaagatagtacttgcatgttctgtcagaggactggagtgactgatgtaattcctcttacccagtctttgggtgatagtctctgttcttgctgtagcctagcatgggtttccatgcatgatgagtgctgccaggaagcctttctatcttaaccactatgctcccacctctgctgtcactggggctactgattctccaggacctaatttcagcttccatttgctcacctgcctgggcggtccaccttgaaatcatctgtatctcaccctgtgactcttccct

SEQ ID NO: 124735 - DNA, 264 bp, Homo sapiens
acgtgatatcacttatctgctgcttcatctccttggcatggggcagcagccagtcctgcagttagcttctccacctcctcctggatcttccttcagcttttctaactcttgagccggggagtatttagctccaagacaaagtgtgccagcttctcctgtagacacccacatcatcaaagttagaggtaagagagactgacacaggatccatccatctttctgggttctggttggtggttctaggattcagcttgttcctcctcc

SEQ ID NO: 124736 - DNA, 537 bp, Homo sapiens
ccaaatggcgattttctatcttcataattccttctaccattattagttaaaattcttctacgcggaagttttcccttaccccccacttacttactttcaattatttatgtatatcagtatggactcgtgggtatctgtttcattctgtgagctataatccattacaactgatatttattttgttgctcaaattgtccacatttgaccattggaagccctttaagttggctcttgtgccctttcttcatatcaccatcatttttgaacattcttcttttctggtaccacaagacactctaggctcttcttgtactccatttgatccagcccatgagtcaatcattttctaaagacaccagatttctgttattaaagaatagaatttagaaaccaaaaatctgggtgttacttgtgcttattcacaaaagaacgtatctccttttttctacagtctatttacttatttgcttaaatcttccatacacataaagtactttcagaattgttcatccatacttctgtgaaaaatatttacta

SEQ ID NO: 124737 - DNA, 483 bp, Homo sapiens
aaaccttatgttctgacccaccctggatttggaagacaggaaggaggtgaagatggttctgaggactctagcttggtgggcctagtggagatggacattttaaactaagatgcggcagccttgggtagaaatgggatgttcagctttagacaggagacttttgagacgcttggtccaggaggtaattggaagtccatcagcatgttatactagcccgccagttgagcatgaaggcttttctctttcagttctttctgagttgttaatgatctcttatatccaactggctttccttatttgttacacaatcgaatagtcaatgttccctggtgactgcagagtttctacagaagtacttaaagatgatcgtctggctggaaggagacttctcttgaagtctccattgcataggaagcacattgcttttaactgaattgtgtattatgggtcctaaaaaggtgggtcagaacataaggggtaccg

SEQ ID NO: 124738 - DNA, 434 bp, Homo sapiens
actccactgagatctagtatcctacatctaactgcctgcttgccatctccacttggaaatctaataagcaactcaaactacagagatgtgaaagccaactctgggttcaccctcctcctgtacaaccaactccattgtagtttcaccctccacccaaatgctcaggctacaagtctaggagttgagcttaactcttgtcttacctaaatgtaatctatttgcaagttctaacagctccacttccaaaatatatcatcaagacgaccaattctcatcacctccacagctaacatcttaccatcagtcattatccagcataagtcatagatagaagactctaactgatctcctacttccactcttcacaacatctacggtggcctttgaaaaacaaactggatcatgttcaaaaggttcctactacacacagaaca

SEQ ID NO: 124739 - DNA, 834 bp, Homo sapiens
  misc_feature (592)..(592): n is a, c, g, or t
  misc_feature (598)..(598): n is a, c, g, or t
  misc_feature (633)..(633): n is a, c, g, or t
  misc_feature (635)..(635): n is a, c, g, or t
  misc_feature (649)..(649): n is a, c, g, or t
  misc_feature (651)..(651): n is a, c, g, or t
  misc_feature (653)..(653): n is a, c, g, or t
  misc_feature (671)..(671): n is a, c, g, or t
  misc_feature (677)..(679): n is a, c, g, or t
  misc_feature (681)..(681): n is a, c, g, or t
  misc_feature (688)..(688): n is a, c, g, or t
  misc_feature (712)..(713): n is a, c, g, or t
cctctattcctttcctcttgctcagtgtgcatcaggcatctgggcttcttttctgctcctgtaaatgaatgccaagtggtttccctcttcaggacctttgcacatgctctcccctgcccgaaatggacttcccatacctcctgccatagctggatttttctcatgtttcagacctcagctcgcacatcatctctcgagaaatcctccctcatcctgtgaagagaaaatcatcgtccttttcattgcctcgtcctgcctggttctctcaaagcagataccacgctaaaaaatcagcttgttatttattgaactgcttgtctgcatatcctcctcccaaactcacggcaaatcagaacagaggctccttgtggcaggagtcccatcttgttcattctcagaacctaatatagtacttggcacatagtaggcacacaacaaatgtcattagaatgagtaagtatcaaggggtcgggcgcggtggctcgtgcctgtaatcccagcactttgggaggccaaggcaggtgaatcacctctggtctggaactcccgactcgtctgatgcactgtcttgcctcccaggtgctggattacnggcgtngcacctcgccggcaagaataacttttagaaataancnggtgtccaggtgcngngntcatgtctgtgtccagcntggagnnngnggggcgntcactgagcgggttggacagctgnngatggtgagggcctttccctaattcaaattgtggctgttgggggcccgttgccctattcgggggggcggtcttaccgggatttggggcatgtgcccggggaaggctttaaaggggggcttc

SEQ ID NO: 124740 - DNA, 270 bp, Homo sapiens
tcctgcctcagcctcatgagtagctgggactacacgcatgccgctgcacctggctaagtttcttgcattcatagtgaaatctttttgaacaccactaccattactgcccctcaactttttatggcccagggaagccaaaggcccatctcagaacctttttttttttttttcaacattctcagacttttgatcccagcccagcatcttccctgtctcttccggacggtggtgtgggcggggcccaggtcgagggggtcagaggatcactgg

SEQ ID NO: 124741 - DNA, 364 bp, Homo sapiens
acaggggtggtagggggaagacagctgtccggtaggataaccagatttctggcttgtgtgactggatagaagcagcatcattctgagccaatgaagccagaaaaggaccagccttggggcaaagattgtaaggtgcagaaggaggcaagcaggtggctggataatatggcccggggtccagagggaggttcaggccggtgagagaaaattgaattacttgggaggaaatggtttctggagttgtaggcacaatgagataacccagaagagaaacaggttgaagagagaaactcagagggattccaacatttctccatcctacacatgaggacacagggctcaaagagcagcagtgacttttcag

SEQ ID NO: 124742 - DNA, 228 bp, Homo sapiens
attaacagtccactcctcctcctccgcaagagactcagaaagaaattcatgactcccgcattcctttccactcacaaaacatgctttgtgaacagccagagaaagacagctcgttacaaggacaactgtggtcacaccctctcagcaaaccgcagccacacaccagggcctcctgcctgacccctggccagccggcttccctgatgagctcagaggcaggacaagcag

SEQ ID NO: 124743 - DNA, 467 bp, Homo sapiens
  misc_feature (18)..(18): n is a, c, g, or t
  misc_feature (77)..(77): n is a, c, g, or t
  misc_feature (89)..(89): n is a, c, g, or t
  misc_feature (101)..(101): n is a, c, g, or t
aaccccataggttgagcnagaaagggttacagccaaaatttttggccccccccccggaaattgcccagaagaaggtncaccaatgggantgaggagaatgnacgaattttgcgccggctgctcagaagataccgtgaatctaagaagatcgatcgccacacgtatcacagcctgtacctgaaggtgaaggggaatgtgttcaaagacaagcggattctcatggaacacatccacaagctgaaggcagacaaggcccgcaagaagctcctggctgaccaggctgaggcccgcaggtctaagacccaaggaagcaggcaagcgccctgaagagcgcctccaggccaagaaggaggagatcatcaagactttatccaaggaggaagaggccaagaaataaaagctccccctttgtctgtacatactggcctctgtgattacatagatcagccatgaaaataaaacaagcc

SEQ ID NO: 124744 - DNA, 134 bp, Homo sapiens
aaaagaagctcagaggccactcttgtgtcctgaatactttgcctgctgagatcgccctcctgggcttgcagtttgtcttttgggagatgtagttaaacacatcctccagggagtgccctcagcagctagagtga

SEQ ID NO: 124745 - DNA, 466 bp, Homo sapiens
gggaaacgttataatgtgttatcaatttaaaacccccttctagttatttttttgagacagtctcattctgtcactcaggctggagtgcagtggcacgatcttggctcactgcagcctccgcctcccgggttcaagcaattctcctgcctcaccctcccaaagttctggcattataggcgtgagccaccatgcccagcctactttgattctttctccacagttttctttaatacttcaactttttggggattcattatgtgaacaatagggaaaaataagagcttattgtgaaaggcactgtagaaacttgttcagaataaatgaataatagcagagaatggccacttgtccctctcttagttctagcagcagttaagatttgttgatatatagtgaacttttgaaaagcctaagtgtgagtctgacattataccaattcagaatgtaactcgaaaatgtactcatg

SEQ ID NO: 124746 - DNA, 177 bp, Homo sapiens
cttgttccgaccggttctgatcccatggcagggcttctttggggccaggacagagcctggtgtcccccttcagtggcctgttcacggctggctttcaaatctaaatgtggtttaaaataaagcccacatttggaagctcctgataatgatgtgggagcacctctgagcagtccctgc

SEQ ID NO: 124747 - DNA, 155 bp, Homo sapiens
ttgaacctttggctccagagagtctactctcctgaaggcaatgctaagctaataccttctgccacagaattgatttgactttagttcatacctctaagtattttttaaagatcagttatttactcaatggtctggcagttgctttctctggtttg

SEQ ID NO: 124748 - DNA, 450 bp, Homo sapiens
  misc_feature (433)..(433): n is a, c, g, or t
  misc_feature (444)..(444): n is a, c, g, or t
cacctcttcctctctcccaaccacagaaacagccacgactcctatgacaaacttggtaaccaccaccactgagatctcctcccacagtactcccagcttctcttcatcaaccatctactccacagtcagcacatccacaactgccatctcctcacttccccctacctcaggtactatggtgacttccacaaccatgaccccatcttctctgagtacagacatccctttcacaacaccaacaactatcacccaccattctgtgggctctaccgtttcctgactacagcaacagacctcacattaacattcactgtttccagttcctcagcaatgtccaaatagtgtcattccagtcttcccccagcatccagaatacagaaacctcatcccttgtcagcatgacctctgccaccactcccagtttggagaccanactatcacaangtactg

SEQ ID NO: 124749 - DNA, 279 bp, Homo sapiens
  misc_feature (221)..(224): n is a, c, g, or t
  misc_feature (240)..(240): n is a, c, g, or t
cacctcttcctctctcccaaccacagaaacagccacgactcctatgacaaacttggtaaccaccaccactgagatctcctcccacagtactcccagcttctcttcatcaaccatctactccacagtcagcacatccacaactgccatctcctcacttccccctacctcaggtactatggtgacttccacaaccatgaccccatcttctctgaaacacagtnnnnccgtctgttgatcatnagtaatatttagcacaactctgtctgcaggggggtccta

SEQ ID NO: 124750 - DNA, 298 bp, Homo sapiens
ggtgtctctccctcatacaaaagcatttcactccttctgtcccacaactcctaaaccccaatttatcaccacctcttctgcttaggtatctttctaacacaaaattctcctcagaattctttaatgatttcttattgcccaaaggatataaccaatactcatttgtctgttacacaagcctctgcctgcctatttagtctcctcccttcacttctccccttacactctaggtttcaacaacactcacccacttgtaggtcaagaggcttgtcaacatgatctgtggttctttgctatt

SEQ ID NO: 124751 - DNA, 441 bp, Homo sapiens
gagagtacagtaagatacaaatggaaacaacaaaaagttgaaaagcatgggaggaagggtgaagttaaggcatagaaattttattagttttctttttgcttgtttgtttatgcagagttgttatcagcttaaaataataaattataagatagtatttgcaaacttcatggtaacctccaaccaaaaaccatacaatgaatacacaaaatataaaaagcaagaaactagatcatatcattagagaaaattaccttcactaaagggaagacaggaagggaagaaagaaggaagagaaaaccgctaaacaactggaaaacaaataacaaaatggtaggagtaagttcttatcagtaataacaatgaatgtaaatgaactaaactctccaatcaaaagacatagagtggctgaatgggtgaaaaacaagaaccagtgatcccttg

SEQ ID NO: 124752 - DNA, 151 bp, Homo sapiens
tatggtcaaaaaactaaaataactttgtatattctaaagaggactcaaaccaagcagtcagcccagcagcaattctgagtctttaagtcattctttgagcatataaaccagaagttaccagagcctcctcctttaggcaaaaacctatttg

SEQ ID NO: 124753 - DNA, 325 bp, Homo sapiens
caagggaggtggatgcggcttgtccatcagcatgccagatgagggggctcctcccaaagggacagaggggatggagtaagggccggggacaccggagacagagggagggtacccggcctttgctgctttccctgcttcatacactgtggagggagatcaagagcaagagagattacgtcgtcccaccctccacaaccctcacaccaaaaatccctgaggatgcacttcagggagctcctggatgtgtgtatgtgcatgtgtgagcgtttgttcttctaaaactgaactgattcatcagaatcactctcccccactccctcggact

SEQ ID NO: 124754 - DNA, 695 bp, Homo sapiens
ctgagcagctgtgacatagccaggtggcctgcaaaacctaaaatatttactaattggtgccctaagaacaagtttgccaatcccctgatcattagatcatctagtccatcctatactgtacaggtgagtaaactgaggtccacacaagaatgacttctctatggtccaaactcaagttaagtaagaagcaaggaagactccatttccatggtactttccaccacttggccaggaaactctcaaaacagacatcctgctgtttgggaggtaaacctcagggtctcatatcacatcgcaagtgagtgtatttgccaatacattgatgagaagaggactttgggcctagtcagtatccaagaacaactgctaaaggtctgagtaaaccttagtagactagaaaaagttaatttaaaaaccacacaggccaggcgcagtggctcacgcctgtaatcccagcactttgggaggcccaggcgggcggattgcctgaggtcaggagtttgagaccagtctggccaacatggtgaaaccctgtctctactaaaaatacaaaaaaataagccgggtatggtggcatgtgactgtaatcccagctacctgaaaggctgaggcaggagaactgcttgaaccagggaggtggaagttgcagtgagccgagatcacaccactgtattcccgcctgggtgacagaggga

SEQ ID NO: 124755 - DNA, 257 bp, Homo sapiens
aaggcatgataaagcgtggtgtgttccctatgtcagttgcattccctaaggaatcaggtggttggtgagatcggagggtttgggaaggtgatggcagatcgaaaagtaggtaggagctaggtcatgaaggatttagcgtgctgtgccatgccaaggagtttggccttttctggaaggcactgaaaatccactgacagtctcataaggagaagactgaccaggtcatactaatcagtcctcagtgtagaaaggtgagt

SEQ ID NO: 124756 - DNA, 439 bp, Homo sapiens
aaaaaaaaaattgtcctgaaaacattacttcttgcttcagtggtcagtagtggtggtttatccctctctttttctctcccccaagagttgagggttacactagggcaggctggcgatactgaaagcagttgagtttctgccttgagaagaggcatgtccagtagaaactggatgggtaaacagactggagaaaaatataaagacttgaaattcagctagatagaataagcactgtgttcagaatccagtcaggaccaggttgtacaagaaataggttctaagtttacaggacaagaaataggttctaggtttcaggcaaatgcaacatctaggaatttagagtagcaaagtaggatgcaggtggtaggacacaggtaaaactagccaggtaagacgggcaggcaaggcagataagtggaagtggaggctcaggaaatga

SEQ ID NO: 124757 - DNA, 253 bp, Homo sapiens
ccggttcctctactccggttgcctctactctagatagaataagcactgtgttcagaatccagtcaggaccaggttgtacaagaaataggttctaagtttacaggacaagaaataggttctaggtttcaggcaaatgcaacatctaggaatttagagtagcaaagtaggatgcaggtggtaggacacaggtaaaactagccaggtaagacgggcaggcaaggcagataagtggaagtggaggctcaggaaatga

SEQ ID NO: 124758 - DNA, 583 bp, Homo sapiens
ccaaaataaaaaaagaatttataaaagcctctcatttgtaattgtttacattcacaaacatcaaacagtaaagacgacacatagagaatttcagtgacaccgtatatgcatatatatcttaaacttgcaataatatgtaaaaataatttgttttccatcccttgttagaaactttccttttctcaatttcagtgagaagataatatatttatattgctttattgcagataatatgtttattagggggctttttttcctgtacattcctctatgtaattgtttaatactatcatgatttaatgacacaaatcattgactattgtctctatagtcccactgtatctcttggaatacttgaaatagaaaatgttctaggaaactttatttaaccaatccaattcactgtagtatttcccaaactccttagttctcagagttatatggccttggcccagactagaatcagtacatgttaatgtacttcagaaccatgagtgaaaactcttacttggctgtcacctcttaatcggcttagctccctctgcactaacagatgttggcaggcagttctgagcctgtacag

SEQ ID NO: 124759 - DNA, 738 bp, Homo sapiens
atgtaaggtaacattcacaggttctggagattaggacatagacacattgcaggggatgtcattattcagcctgccataccatcctgacttagaactctgaagtcatcatttgatttattttcttgtttttcagttgactcccaacctaacagttgccaaatacattttctcatgaagattatttttttattattgcaccatcctagctgcccagtctgttgcatcaacctactagttgagttttccttatctccattcccttcttcccatgtctcttccatcccacacatcagtactagattgatcttcctaaagctgtactcaagtcattcattgccacatattgtatgccacattataggtagagtcctcaccctaaatgaaggctgttgtgattacagacatgtctgattttccatttttaaattccactacttctctgtatataccgtttacctaaaactgaggtgttccattttcactaatctcaccacattggccatgttttcctgcttcaatacatttccttaagctttcctccacatataattcctgtgttcctgtcttgtcacccatctttttaggattatcccaaataccattcattacttgaagcctctcttagtaacaatataacttctttagtctgagccctaataacacttttaaaattctcttcttattctatttatatttgaacataaattataggtagttgtatacttgtatacttacctc

SEQ ID NO: 124760 - DNA, 325 bp, Homo sapiens
aaggaatagtttaggtctggtggccaggtggactgggctaatactgaactccagaatcaagagctgttgagttgcaggctgcactgggctaggggcaagccctggagagaacagcagataatgtttttcccttaggggtctgtctccccagaggaagaaggcaatgaagctgagcccaatatgctcagttaccctgctcagatggactctacattatcagaggggaatgacgaaggcactgaaagaggccaggaaatagtccttttctttttctttttttttttttttttttttttttttgggcaaaaaagggaaactccttctc

SEQ ID NO: 124761 - DNA, 271 bp, Homo sapiens
agggatgacaatttttttggggcacagtctaagttggtctggtgtctggaatgagactggggcctaataaaaaggagcatctatacaggagcttaaatgggctgtaccttgtagcattctgaggacaggtctgacttctgagaagggaaagtggtaaaagtattgtccagtcctttttaagttggtggctgagcttggtgaggtgtgtttttaaaagacctttagtccattctacttttcttgaagatggaggaccgtaagggatataagg

SEQ ID NO: 124762 - DNA, 251 bp, Homo sapiens
tgtgtgccatgtacctacactcctaaacctgtagccctgctgcagacacagcaagggagcctccagtcatctgtccaaccagcaaaaagcactgagtaactaccacatgctgtactgagcaaggacctgcagggaaaacaacagtccagactccacctgccaaaacctttgctctctgaatgcacattaagaatacaataaggggtcagcacggtggctcacgcctataatcccagcattttgggaggccg

SEQ ID NO: 124763 - DNA, 353 bp, Homo sapiens
ggctaagcaagataggcttcttctactaacacagcttagtaatcctctaacttggtgacattagttaataaaccagtactaaagtaattctgtagcacttcagttactataattactttctatgtttgagccttattaggaaacataatccagaagctgtatcattttggcttaaatgatataaatcccttggggaaaaatatcacagcaagcttatatactacgtagtatgcaaacaaacttaaaaatcaaaagcaattctgcctcgactctatgtcaagcactgtctgatgttccttctacacaggatgtctcccttaatcttccaaaccatcctgtgatctatcttgtga

SEQ ID NO: 124764 - DNA, 271 bp, Homo sapiens
gaggggagtgagggaatgcaaccaggatggagacagaaacaaaaagagaagggaaaaatcaagaaggcaaacaggggagggcaggaaagccaacagagttgtctgttcacgcacaaaagcctgctggtgcttcctccagtgcagggagcctgccccaccgcccgccacgggactaagacagcgcctcctcaggtgtggtccagggacccatacaaagccttcacaaccccacaggcatgtgccagcacacagcaggcaggtgcagcaccat

SEQ ID NO: 124765 - DNA, 259 bp, Homo sapiens
ggagacaggaaggaactgaatagtaatgaacaacgatgcaaggggatgtctctgaatcctacccactgtcagcgtccccatggctgtagagttgggagtcagagagacactggactccttcaggcatttgcacaaaaaacatgaacctaaacctcagtgtttaaagaagccttagtttttcttatctctccgacagagggaaatatgggtggaggatttcccaattctaggctttctcctcctgtgtgcctgattttaa

SEQ ID NO: 124766 - DNA, 417 bp, Homo sapiens
tcaaatgccacagggtgaaccactggatgagttgggagattcctaatgccctgaagtagagtttcagcaaagagaaaaagctaccagccagaagatgatactatgaggaattaatgtggaatggcttcgtgaagaaattagtatagactatttttccagaatttgctcgagtacaaaaaacagagatagaccaatctactgatttggacatatacttgaggaatcctttttgtatgtttttgttcacattgtttttaggatgaaaggttggtatctgtagcccagaaacgaaaagtttaaaaaacgtatttagcatgacaagaaaaaaaaatgcttcctagaaagattaggtcaagaagtcatccttttatggctgcatagtattccatggtgtatatgtgccacattttcttaatc

SEQ ID NO: 124767 - DNA, 101 bp, Homo sapiens
agtccagaatgtgctaagagcacagtcagtagttccttcaatcatctactttaaagtgcatatgaatcacctggggacttagttaaagtgaaaattttgat

SEQ ID NO: 124768 - DNA, 176 bp, Homo sapiens
tttacaaattaaaaatatttataagaaacattgttttattaaaccattgaaagcattatgacagtagtatttcattttaaaaatatacaaaattgagctgattattccaagcccatttatttaaaaaaattttaaaatatagcacatggcaggccttcataaaaattccttcctct

SEQ ID NO: 124769 - DNA, 1579 bp, Homo sapiens
gccaagcttggcacgaggtggcacgtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcct

SEQ ID NO: 124770 - DNA, 1558 bp, Homo sapiens
  misc_feature (1156)..(1159): n is a, c, g, or t
ggtttataaatggtttgtagctaacaaaaaaaggaatcctttctttttcttacactccacttccaaaccatcagcaaatcctgtttgactctaacttcaaaacgtatcctgagtctgaccacttcctagcctgtctactgctaccaccctgctataagccaccgccactcctcctcccctgatagagtggccctgttaaaaggtgcatgttgtgttgctcctttgctcagaacactccaggaaagcttctcatctcactcaggaaaaaccgaagccctctttttgatctgctgttctccacctcactcagtctgctccagcagcactgaccttgctatttctagaacatgctggagatgctgccagctcagagccctgtcatttgtattccccattgcctagagtgctctttcttcatcatccatgtctcgtccccccaccttctttcgagtgtttgctcaagtgtcaccatagggagagaaccttttctgaccaccttaaagttgctgaaaacctcccccagcctgcctcttgccagcatgttccatcttcttccttttttagcacctaccaccttcacatatattatttacttatttttattgtctgtttctccctgccacgagagacggagatttttacccctagcacctggaactgttcctggtatcagaggcattaaaatgtttgttggatggactaatgaatgagaagagaaggctgggctgaatggctcacgcctataatcccagcactttgggaagccaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaannnntgtcttatgttcacttagatttatttctagcccctttgcacttataaaggggaccatttgtggtgcttgctttcattcaggttaatatttttaatgtctttcattggtattcaggaatatgcttcagttccaagaaaagaaaaatctattatactgtagttaagccaaattgggggttgttttctttacatacaagaagctctaggggtaaactgtcccaaggtaagtattatgttctataagttagcgacccaggagtttcctttggttcgccagttaggaagcggggtataacggggtcggaacaaggggggggggttcagcaaaatattttgtgaggaagttagaaaaggttgagattctttataggggaaatgcaaacggggagtatcgtgggaa

SEQ ID NO: 124771 - DNA, 1045 bp, Homo sapiens
ggtttataaatggtttgtagctaacaaaaaaaggaatcctttctttttcttacactccacttccaaaccatcagcaaatcctgtttgactctaacttcaaaacgtatcctgagtctgaccacttcctagcctgtctactgctaccaccctgctataagccaccgccactcctcctcccctgatagagtggccctgttaaaaggtgcatgttgtgttgctcctttgctcagaacactccaggaaagcttctcatctcactcaggaaaaaccgaagccctctttttgatctgctgttctccacctcactcagtctgctccagcagcactgaccttgctatttctagaacatgctggagatgctgccagctcagagccctgtcatttgtattccccattgcctagagtgctctttcttcatcatccatgtctcgtccccccaccttctttcgagtgtttgctcaagtgtcaccatagggagagaaccttttctgaccaccttaaagttgctgaaaacctcccccagcctgcctcttgccagcatgttccatcttcttccttttttagcacctaccaccttcacatatattatttacttatttttattgtctgtttctccctgccacgagagacggagatttttacccctagcacctggaactgttcctggtatcagaggcattaaaatgtttgttggatggactaatgaatgagaagagaaggctgggctgaatggctcacgcctataatcccagcactttgggaagccaaggtgggtggatcattcaggtcaggagttcgagaccagtctgtctgggcaacatggcaaaacttcatctctacaaaaaaatactaaaactagctgggcgtggtggcgtgcacctgtagtccctgctacttaggaggctgaagtgggaggatggcttgagcccagaggtgggggttgcagtgaggcagtgagtggagcattctagcctgggcaacagagccagaccctttaaaaaaaaaaaaaaagcaaatttcatttaaaaatttttttcattcaaaa

SEQ ID NO: 124772 - DNA, 1153 bp, Homo sapiens
ggtttataaatggtttgtagctaacaaaaaaaggaatcctttctttttcttacactccacttccaaaccatcagcaaatcctgtttgactctaacttcaaaacgtatcctgagtctgaccacttcctagcctgtctactgctaccaccctgctataagccaccgccactcctcctcccctgatagagtggccctgttaaaaggtgcatgttgtgttgctcctttgctcagaacactccaggaaagcttctcatctcactcaggaaaaaccgaagccctctttttgatctgctgttctccacctcactcagtctgctccagcagcactgaccttgctatttctagaacatgctggagatgctgccagctcagagccctgtcatttgtattccccattgcctagagtgctctttcttcatcatccatgtctcgtccccccaccttctttcgagtgtttgctcaagtgtcaccatagggagagaaccttttctgaccaccttaaagttgctgaaaacctcccccagcctgcctcttgccagcatgttccatcttcttccttttttagcacctaccaccttcacatatattatttacttatttttattgtctgtttctccctgccacgagagacggagatttttacccctagcacctggaactgttcctggtatcagaggcattaaaatgtttgttggatggactaatgaatgagaagagaaggctgggctgaatggctcacgcctataatcccagcactttgggaagccaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcct

SEQ ID NO: 124773 - DNA, 617 bp, Homo sapiens
tttttttggagatggtgtctcactctgtcacccaggctggagtatagtggcacaatgtctgctcactgcagcctccacctcctgggttcaagtgattctcatgcctcagcctgctgagtagctgggattacaagcatgcaccaccatgcccagctaatttttgtctttttagtagaggtggggttttaccatgttggccaggctggtctcgaactcctgaactcaagtgattcgtccaccatggcctcccgatgtgctgggattacaggcatgagccactgctcccagcccagtttatcttattaactatcagttcgacgataactgtgtgaaatacaactggtagaatagagtcccaggtatcagaaagtttactgcctttgagggcaaattcttgtgaatctttaaagtatcatatgcaattcaaataggtttaaaatgtcagtacatatatgtattaatgaagactgtggttgatcatgaataattaacagaagctgaggatttaaatttgtggggttttctctcttttttttttgttctgtgactctagctaaaggtggttatttaagtatttttaaaaattacatgaatatccaggtgaacaatgatttaca

SEQ ID NO: 124774 - DNA, 1491 bp, Homo sapiens
gcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcct

SEQ ID NO: 124775 - DNA, 1131 bp, Homo sapiens
gcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatctaaaggtggttatttaagtatttttaaaaattacatgaatatccaggtgaacaatgatttaca

SEQ ID NO: 124776 - DNA, 1142 bp, Homo sapiens
  misc_feature (740)..(743): n is a, c, g, or t
tggtagagagaagttttcaccgtgttgcccaggctggtctcaaactcctgagctcaaggaatccacctgcctcagcctcccaaagtgctggaattataggcatgtaccaccatgcctggccaaattaatttctttctgccaaacatctaagtggagaaatctggggggcagctgaatatgttactacatggtgtttttatgacctcagctaacttctgttttcacacagaaaattataactgttaagaaactgtttgttaatacttgtgttatatttaaacttgtgttatatttaaacaaactatgctttttcccctttcctgtcttctccctcccccatttaattgccttaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaannnntgtcttatgttcacttagatttatttctagcccctttgcacttataaaggggaccatttgtggtgcttgctttcattcaggttaatatttttaatgtctttcattggtattcaggaatatgcttcagttccaagaaaagaaaaatctattatactgtagttaagccaaattgggggttgttttctttacatacaagaagctctaggggtaaactgtcccaaggtaagtattatgttctataagttagcgacccaggagtttcctttggttcgccagttaggaagcggggtataacggggtcggaacaaggggggggggttcagcaaaatattttgtgaggaagttagaaaaggttgagattctttataggggaaatgcaaacggggagtatcgtgggaa

SEQ ID NO: 124777 - DNA, 358 bp, Homo sapiens
gcccacctagacctcccaaagtgctgggattataggcgtgagccaccaagcttagccaacatctgtctttatgctgtgttaacgttattactactattaatgtgtctattgacaaaaatgatttgggtttgtggactagatgtatacaatgattgatttatcttttgacaggtgccttggaacactatgttaattgcctggatctggtaaacaagaggctaccttatggccttgctcagattggagtgtgttttcatcctgtttttgacactaagcagatacgaaatggtgttaaaaggtataaaaagtggcaaataacttggccttgtatttaaatagtcaaaaaccagtcatttcc

SEQ ID NO: 124778 - DNA, 1592 bp, Homo sapiens
gcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcct

SEQ ID NO: 124779 - DNA, 1997 bp, Homo sapiens
  misc_feature (1595)..(1598): n is a, c, g, or t
gcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaannnntgtcttatgttcacttagatttatttctagcccctttgcacttataaaggggaccatttgtggtgcttgctttcattcaggttaatatttttaatgtctttcattggtattcaggaatatgcttcagttccaagaaaagaaaaatctattatactgtagttaagccaaattgggggttgttttctttacatacaagaagctctaggggtaaactgtcccaaggtaagtattatgttctataagttagcgacccaggagtttcctttggttcgccagttaggaagcggggtataacggggtcggaacaaggggggggggttcagcaaaatattttgtgaggaagttagaaaaggttgagattctttataggggaaatgcaaacggggagtatcgtgggaa

SEQ ID NO: 124780 - DNA, 2025 bp, Homo sapiens
gcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatatgcagagacactcacctacataactacaatccagtcatcaaaatcaggaaattaacagtaatccactattgccacagagccctacaaattgaactgattatctcaataatggcatttataggtccaagatcttgtctttcatgtagttgtcatatgcctttacactccttcaaatgaacaattcctcttgtcttgcgtgaccttgacatttttgaagagtacagtctagttaatctgtagaatatgccttggctgggatctgtctgctgtttccacgtgatttatgtatttttgtcgggagtactacagaagtggtagtactgagaagctctcttctcagtgtgtcatatgaggagtgttactggtgatgttaacttttatcatttagttaagatggtttctactagatttctccagtgtaaagctaataaatagtttgtatttattaattaacggccaggcgcagtggctcacgcctgtaatcccagcactttgtgaggccgaagtgggaggatcatgaggtcaagagattgagaccatcctggccaatgtggtgaaaccccatctctactaaaaatacaaaaattagctggatgtggtggcttgcccttatagtctcagctacttgggaggctgaggcaggagaatcgcttgaacccgggaggtggaggttgcgatgagccaagatcgtgccactgcactgcagcctggcgacagaacgagactctgtctcaaaaaaaaaaaacaaaaaaattaactagtaattaataagtgttgtgggcagatactttaagatgatgcagacaatttctttgtcaccaaattttgccttactggttgcagcatccattgatgattcttgcccagatcagttagtaatgtgaggtttgccaaatggtgatttttttttttctttatttgagacaggatctcactctatcactcaggctgaaacac

SEQ ID NO: 124781 - DNA, 176 bp, Homo sapiens
cccctttatgtaaaacacagggctccccactttgagaatcaccaccctcggcgattcctgatcaagtttggagacagcccaaagcagaatggcagccttaggggcctggccacagaaggcacctggttcgtccttggtggccagagccgcctgatcgtgttccttctgtgctgtgg

SEQ ID NO: 124782 - DNA, 307 bp, Homo sapiens
tcctcattctgcacaggcttcaatctgcgtccctgcccccaacccccgactccatcctggttggtgcctggaggggctccctgcctcagcctgcctccttcagccggggggatctgagctccacatgttcctgcagggagccctctggaataggactcagccaggaaaagaaatgaggctgacacgggcctcagcatggatgagccttgaggacgtcacgttcagtgagagacgccagacaccaaaggccacacagggaaggtttgaccccatttctatgcaatgtccaggacgtcgacgcggccac

SEQ ID NO: 124783 - DNA, 416 bp, Homo sapiens
ggggcttactcccacgatcacaatattgatgaatgtctgacttatcttagaagtcctgaacacccctctcttcttcctcatttatttacatctcatgactggtcaggtgagaggtagctctgtgctgtgtcatcctaacacaggaatccagaaggaaggagggaccgtcaagatccccattgctatagaaaagagaaaaaagcatgcggaatagaacgctgtttcttggagatttctcctgaaaaagtcacatgttatttcttctcacctccatcggcaaaaaaaaaaaaaaaaaaaaaagtcatgtggccatgggaaaatttaagtaggtgggatggaacagtcagaatgcattcataaaaaatgaactgaaaatatttggagaacagcacggggttgtaagggatgcttgtggg

SEQ ID NO: 124784 - DNA, 601 bp, Homo sapiens
tcagcgccgtcttttaaagttgagtttcttgttattctcacctgatgtaccttatttatcccacacccaccccaataacatatcgtgctcactgttatctttgaggcaacccttgaattttactcagcctggagcgctcttcacatgtcttgtccagagccagttcggactcattcttcagccgtgcatcagtcagtgggggctagcttaaactgtggtgacaaacaacctccaaatttcagtggctcaaaaatcttcttcctcatttatttacatctcatgactggtcaggtgagaggtagctctgtgctgtgtcatcctaacacaggaatccagaaggaaggagggaccgtcaagatccccattgctatagaaaagagaaaaaagcatgcggaatagaacgctgtttcttggagatttctcctgaaaaagtcacatgttatttcttctcacctccatcggcaaaaaaaaaaaaaaaaaaaaaagtcatgtggccatgggaaaatttaagtaggtgggatggaacagtcagaatgcattcataaaaaatgaactgaaaatatttggagaacagcacggggttgtaagggatgcttgtggg

SEQ ID NO: 124785 - DNA, 704 bp, Homo sapiens
aactgcctgaggacaagcagcattctaggaagtggagttgcattaatttgtctcaccccggacatccatcccctaacatttgctctatgccctgcctatgcataacacctagcacgtagtactcttacgtactctctgcactgtcttcactttgttacataggaggaaaccaggctcatgtaagttaagtaacttgcctgagatcacatagctgataagtggcagaaccgggattcaaactcagaggttggccttattgaagaattcatatttctacccgtcatgccatgctgcctccattgaccctcttaaggggctcttcaagcagtattgctttcagggtctgcgtggcctcagttagttagatttgcttgttaaaaggaaatggtgacacgtattaaaatgcttctgaattttaaaaatcatggtgtaaaatccctgcgatcacattgctctaaatgtatggacttgaggtttatttttgcaattcatcgtgtagcatttacataggaatcctgtcctgtccttagcagatcaggagtaatacttaaaaacacagatagaaggctgggcccggtgtttcacgcctgaaatcccagcactttgggaggctgaggcaggcagatgacgaggtcaggagatcaagaccatcctggccaacatggtgaaatcctgtctctactaaaatacaaaaaagccaggtg

SEQ ID NO: 124786 - DNA, 563 bp, Homo sapiens
agccctgttaaccatccctccatcacgttacatcactgtaacactttaaatccagctactctaccacctctccctgctaatgaagagcttcactccatttctcatcattgccttaacactgtagaaatggtctcaaagccacgagcaaacctcttagctacccctttggacaacccagacttacttctgttttgtgatggctcttgtagatgaaattgccaaggaaacataacaactggctagttttcccacatgaaacacttgaggtgtgctctttgctcattgtaagatcagcccaagctgctgaaccgatagctgtcactcaagtttgcacactggcaaaagaaaaaatggccactctttacaccgactccagatatgcctttggagtctgccatactgttggcataatctggaaatgccttgaatttttaacttctgctggtgcttctattgccaatgggcatataattgttgatctattacaggctattttcctccctactaaaattactgttgcttattgttcagcccatactaaggagtctggtattgtatctctt

SEQ ID NO: 124787 - DNA, 442 bp, Homo sapiens
ttttgcagctggttggtggaggaagcatcagtaacagatttatttctgagaaagacaagtggttaatttggaaaattctaaaaaattcttcctaagcattaatcctcaattttaagggatctgcctgtataaatatttgctttggtttgataaattgtgctctgttcatttccaagcaagttattaagaacataaaatagtcttcttcattcattcctgctggccagacactgtgttcaccagggtggtgaggggatgagtaggaggttgaaagatatattctgaattctgaggcacaacttggaattcacttctcgtaaaaatcataaaaaataggttcttaggtgttctgtgtgggaaatgcgcgcgggaggagacacacacacaatacctttaagggtaaacaagctttatcccaaatggcagtgcagatataagcaaa

SEQ ID NO: 124788 - DNA, 728 bp, Homo sapiens
ggaaaaaaggacagtgattcctgagagatgacaacaaataacatgagccctccaattgccccagcttaatgctttgagagagtttctaggctgcaagacagggagggagaactgaagtagagtccagccaacttcctgagttaaggagatagaactgagagtccagggaggctatggcagttagagtccacaggacagactgttagagaggagagagctgcttagagagagaaccttagagatctgcattgagtcaccttgactgtttggcagagtatggatatgttcctgtatgtgaggaaactatttgaggccagggaaagaaccatgtgaaaaggaacagaggaacagttcctggcaatcacacagcactgggaatagtacatgtccctaccagccagattggagacatttatggttcatattttatggtgccttgtgtagaatactcaggaagatatttaaaagtggggaataattacccctagcaggagcactacttcacacccacctaacaagtaataaaaccaagacctgaagggatcaaactgtttccaagtaacataaagtctaagaagatttatggaaatccagaaatacccagcacccaacaagttaagattcacaatgtctagcattcagtcaaagatgaccaagtgtgcaaagaagtgagaaaacgacctctaacaagaataatcagttgagaccaaactgtagcttaaatagat

SEQ ID NO: 124789 - DNA, 299 bp, Homo sapiens
cagatgtcttaatgatctccataataagtaaaatttcaggtttttgcccaatgtcttggcattgggtaggtcaaccccaaagtatgattttataatcaggtttctgaagttgccactttacttggtgactatgactgaagtacgttataatagccagtacaataggcctccttaccaaatcgcaccaggaaattaagcctcaaactggctctgtgttgtgtgtactacaccatgatcatgtttaattttctaattagaaagaccttctcttaatgagtcagatgttaagactcatggaa

SEQ ID NO: 124790 - DNA, 362 bp, Homo sapiens
aattcataccttataaatttccattcaataaattatatgctgcacagaaggcattttacacgaatgaaaatatgcaataactatttgctaaatcagaaaataaacaacaaacagaactaccacttagcccagcaatcccattactgagtatctatccaaaggaaaataaatcattctaccaaagagaatgagctttttaaagagtttctcatctctcaatctaactagaaatcctgttaacatccagtgaatataataacatgtgcccggagctacacatgttggctggttgactgtgaattatggtcatttttgcactgcctcgttcactgctggcctccagaagcctaaatgttgatcca

SEQ ID NO: 124791 - DNA, 303 bp, Homo sapiens
agacaagatgtacatggaaaacaagatgtacatagataacaattcttgacaagttgtgctaatagccaagtggatgaaacttaactaacaacgctgctccaggacagagtgtggaaggtcaccactgtatcatcctcttccatttcaacgataaaattcctgaggaggatcactccagtctggaacctggcttgtttcaaatagagtattaactggcatgccttctcccttgcaattggtgttgccttcttgggagactgagtctgttgaagtttgaagggtttttgcttctggctctgcctg

SEQ ID NO: 124792 - DNA, 119 bp, Homo sapiens
cctgttatttttcttatctgtaaacaaggaataaaacctagactgttagcaggattgaattcactaagataatgcacataataagcactcaacaaattataatcatttgcatttttaat

SEQ ID NO: 124793 - DNA, 168 bp, Homo sapiens
cattttaccttcatataagtctgtgaaatgacaaggctgttattttcagatactacactcatagtgctcaagtgtgacatttattgaaacttcaaaagtttagatttaagaattaatttaatccaaataaactaaacttgcaattctaaatatggccaccaggtggtg

SEQ ID NO: 124794 - DNA, 309 bp, Homo sapiens
tggaggcagcatagtacctcactaaaagcacggactgcatggctttgaatccccactccactccttactggctctgtgatcttgaacaggtaattgacctcagtgcctcagttttttcatcggtaaataataatagtacctatctcataagaattaaatgagaagatgtgtggagctcttagaatagtgcctgacaggcaggcagtattatcatttttagaagccattcccagttgtggccagcaaaatgtaggatggtctcattgtgtttaattgaaatacctctcatagtattccagagtgagaaag

SEQ ID NO: 124795 - DNA, 312 bp, Homo sapiens
actcctgattcagcatttcctgctgtaccatttctctctctctttctgtttttttataatagagatggagtcttgctatgttactcaggctggtccctaactcctggcctcaagcagtccttcaacatcagcctcccaaagtactgaaattacaggcatgagccacagcacttggccctactttttttcatagtgcttttaaaccttatctgctgggcgcagtggttcacgcctgtaatcccagcactttgggaggctgagacaggtggatcacctgaggtcaggagtttgaaaccagcttggccaacatga

SEQ ID NO: 124796 - DNA, 213 bp, Homo sapiens
caccagattgtggaatgccattaaagcagtgccaagggggaaatttgtagcactaaatgtctattcagttgatcctacaatcttacagtgtagttacatcccaagaaacccatcataagttgaatataccctaagtcaaaaatgcatttgatacacctaacctattgaacttcatagcttagcctagcctaccttacatgtcctcactacatg

SEQ ID NO: 124797 - DNA, 119 bp, Homo sapiens
taaacacattagaagagaaccatatacgcatctattttgccccaaattctgatcacttgatatatcaggtattcaagtgtcatcataaaatctccaagttagaaggatcatctaggtca

SEQ ID NO: 124798 - DNA, 395 bp, Homo sapiens
tgggaattggataaaaggcacccatagagggaaaagagagacacgaaggacatcctcatctaaggcacctgggtggaaatggaattaccctgctggaatggcctgaatttcttgtgtcctcccaaatccctatgttggatcctcacccacaggtgatggtgttaggtggtgtgtcctttgggaggtcatgagggtggagtctcatgaatgggacgagtgcccttataaaagggaccccagagagatccctcaccccttccaccatgtgaggacacagtgaaaaggtgccatctatgaaccaggaagcgggtcctcgccagatactgaatccaccgtgtcttgatcttggactttccagcctccagaaccatgaggcaaatgtctgtcatttgtaa

SEQ ID NO: 124799 - DNA, 305 bp, Homo sapiens
gcttccctacacagccttgacgttctcaagtggagggaccacatctgattcattctgaattattgatgcagagtgcataaggtcttgtaatatggagccgaatttctgaaaggacctttgccttcatttttctgaaaacttagagaatgcaattcaaatcgaataagattgcttggaaacaaggctagagtgaggcaccctcacaaaccactatgtgtaaaatctgctgtttcagaggaccatggatgtgaaaggctcagccatgaccagatcccttctcacactgtccccacaggcaagagact

SEQ ID NO: 124800 - DNA, 183 bp, Homo sapiens
attctcacagctgtggagccaacgccacctgtaacagcttccctgaccccagccccatggggtcactctggacttcagggtttctaaccagccggcccttcagggccctagcccagcctgctccctccacctcaagctttacccagggcagcccccactgtcaatcataactctgcctaaaca

SEQ ID NO: 124801 - DNA, 576 bp, Homo sapiens
aaatattaacaactacatttcaagttctttgtcagcattcttctttttacaaatgaggaaattgaggctcagagagattaaatattttttccatagtcctattataagtgatagaaaggagttgaattaattttatttgatcccaaagcccttggcttttctgctttgtctgtaatatagcctgccttaagacttattttaacattgtctttttggtaagattagaaactttttgatgaaagccattttccactttacctagtgtttaaaaatgtacgtgaggctggcgcagtggctcatgcctgaaatcccagtattttggaggccgaggcaggaggaccgcttgagcccaggagtttgagaccaacctgggcaacacagtgggaccctgtctctacaaaaaatacgaaaattagctggacttggtggtgtgtgcctgtggtcccagctactcaggaggctaaagtgagaggatttcttgagtgtgggaggttgaggctgcagtgaaccatgatggcaccattgcacttcagcctggtcaacagcaacagaacgagaacctgtctcaaaaaaaaa

SEQ ID NO: 124802 - DNA, 331 bp, Homo sapiens
gtctagaacacccttccctacctagtcacatggcctgatccttcacctctcttgggtctttgctcaaatgtcccccttcagtgaggccttctcagatcaccctagtacttcccagcaatgctccattccgattcatctttcctacacacctgtctccactcagtgctctaaatattttgcacattgattatgtttattgcctgctccctgcaatacctgagaatacaaattccatgatgggggacattcatatgtgtctgggtctctgtgtccgccattcacaacagtgcttggcacataacagcccctccatcattactgaacaaacgaa

SEQ ID NO: 124803 - DNA, 758 bp, Homo sapiens
gggttggacctctggatgcaaagtgtcctcagaaccctcaggcatcccgctaggtcagtcggtcctcacattttgacagccccattttacttgtaagaaaactgaggctctggagaccaaagtcacctgggaaatgagtagcagatacagcggactctgtgcagagacctcagctgggctaggccagggcagagagttgaaattgctcctgcttccttgtccaggactgttcgctccgttcctagtggccaccgggcttggctcttggagtctgaaatgaaatctctggttgtgtgtgcagcaccaactatgcacagggcaccctgctgagctctctctaaaccggtctcattgtgtccttctgcagccttgtgaggtgggcactgttatcctcctcatttgacagatggggaaactgggactcagcagaggccacccagttaatgtggaagagcctcagcccggagcgggggctgactgggagctgttgcgctcagcaccacagcctcagctagcagcaccccaagtccaggctcctcaagaacagcactcctgtgtcatctgtccgtccatcccagcaccccgcacacagtcagcagggggtgggcagtgatggcattttgtggaattgagtggaaactgccagcctcacccagtgcagccacgttttagttgtagaccacgtcactgctgcgtacctgtctgaatgtctcacacatgcactcactgcaacatcgacactttgcacaaacacacac

SEQ ID NO: 124804 - DNA, 455 bp, Homo sapiens
tggacatacatgcatggtgtgtgtgtctacataagcacacacagatgcatactccctagctctgtaattctatctactgagagcgccttggagcagtgatcatcttccctccccagtggtatgaacgtttctagcacctaacacttggcccctaataccattctccaataaaaggaaccagacatctctggagaattgtaattcactaattacagcacaggggtagaaaaagtacaggatcaatctggaatatcttgtggtagtaagcaagaaagtgctcaaggaatgctaaagaatgtcaaaaagacataggatcaagcttgaaggagatcccactggccaaacagggtaatttcagcatcaataccaatagtaatagcaatggattataacctactgaacaaaataagaaatcatgaatcaatatagatataaataaatgagtgaataaatgg

SEQ ID NO: 124805 - DNA, 576 bp, Homo sapiens
tggggaggctgaactaacttgtactgagagtaataggctggatatcatggaaatgggaattggcactaatagctgctctcagataaaacttttcctgtgccttcttttgtatatcacatgatactatgtccaatgtacagtcaaacttaaaatagaaaaaaaatcaaatacatggtagtgagttttcaaactcatataacctgggctactttcacttaacacatagttactcataaaatgtcacttttttatgaattcaagaagttttttgggggtaaacttagtgcctcatgccttgggccatcatgtaggttacactctagtctctgtagtgaatcttagttactctctgactttggaacacttggtctttgcctccacgtgtgaaatacatttatagcttataaacaatagctttccctttaaaaataacatgtggatttgaaaaaacattgagatcttttctgtatttctgcctcagtgtcattcattgacattttactgtgtcatttctgtgttgtgttttgtgactaaaccccagctattccctatttttaaactgatagatgggttttg

SEQ ID NO: 124806 - DNA, 511 bp, Homo sapiens
tcttcagccataccgaccttccttctctttcatcttagggcctttccattggctgctcccttcaccttaagcgatctccatggctaataatcttgcctccttcaagtgttttcttataggtcatcttcccaaggaggtctactctgagtgccttatttaaaattgcagcctatcccctccttccaatcctgatgggccttaccttgctttacatgaattcttcttttcctctatagcactttataattttccagtatggtgcataagttacttattaatatatacattgtttacggtggttctaccttcgctaaaatctaggctcttaggctccatgagggcaggaatttttgtcgtcttgttcacagttgtattctcaacgcctaaaacagcgcttgcaatagtatgtgctggattaaaaattagctgactgaatgaatatatgaatggatgctgtagagaagaataaaaagaatgggtcaggaggcgacaagagcaagactccggtctc

SEQ ID NO: 124807 - DNA, 154 bp, Homo sapiens
aaaaataaaaaaagactccaccagtgattcctgtgtgtaaccaggatcgaaaaattctgctctaaagaatttctgtctcattctctccctttcccctcccctcttcctagggttggggattggaactggaggaagaattattttggaacaggtg

SEQ ID NO: 124808 - DNA, 276 bp, Homo sapiens
caacactccaggcattgggaccatgatgatgaagaggacagaccagccctgtcctcaggaagctgacttcccatttggggcagcaagcagtaagcagataaacagatctgttgtataagaaaaagtgcgggctgggcgcggtggctcacgcctataatcccagctactcgggaggctgaggtggggagactgcttgaacctagaagtttgatcattctgggcaacatggcgaaaccccatctctattaaaaaaaaaattacaaaaactcgccaggc

SEQ ID NO: 124809 - DNA, 362 bp, Homo sapiens
taagggaatggacccggggcaatgaggcattgcaggctggcatcaggggtattttggtcattgtaaaagcaggagagatccccaccccaaatttggtttggatattgaaactaatgatggtacacacacaccaagagggtaggaagaggcttattagttatataagtgaaatttctagggagcagagcaggcttctcacacaattccagaatgactagagagccaggaaaagagactggtgtgggtttttactgtggcacgagagtggggccagagtgagagtttccacactcaggcaggactttcatggttagaatcctcagccaacaccaaaggagggagcgtccagtcattcctaccag

SEQ ID NO: 124810 - DNA, 382 bp, Homo sapiens
tctcttaatgtgccatatcccaaggatttgggtgtcctttgtggattcattaaaggatactgtttggagggtgggacatttccatgatgattgttcccctaaccttttcattggtcttacaatcttagacaaagcttgaaatatttagctaaatgagaagtacttcctcattagtttcataaggtaaatccaagctgttgtgctgtggagtagaacacagggtattcttcctttcattcttgagactggtaataaactgcagcagttcagattatactgttaaatttttttttaatgaattagttttggaaatacaatattaccagtgtttgcaacagattttggtattcttttccattttattgtgtcatctttgtaggat

SEQ ID NO: 124811 - DNA, 323 bp, Homo sapiens
tggtggcatgtgcctgtggtcccagctactcaggaggctgaggtgggaagattccttgagcccaagaggcagaagttgtggtgagccaaaatcatgccactgcactccagcctagatgacaaagtgagaccctgtctcaaaaaaacaaagcttttaaaataaagttaatagaattagttgatcaaaaagggaataaaaataaaccaatgccacctactatttttagactggcgaaagtacagattaggagaggcaaggtggctcatacctgtaatcccagaactttgggaagttgaggtgggaagactgcctgaggccaggag

SEQ ID NO: 124812 - DNA, 428 bp, Homo sapiens
ctttggggtctttgctaagattaaaattacttacaaaactttccacagtagcttttattttgaatagatgaacctagccaggatagtaacgtgtagctgattacacgtgagaagtcttcttcactatgacccaccatttaaacaaaatcctataatttccctttaaaatccacaggtatcagccaggcacggtggctcacaactgtaatcccagcactctgggaggccaaggtgggcaggtcactggagttcacaagttcaacgccagtctggccaacatggagaaaccccacctctactaaaaatacacaaattagctgggtgtggtggtgcacacccagaatcccaaccacttgggaggctgaagcaggagaatcgcttggacccgggaggcagaggttgcagtgagccgagatcacaccactgca

SEQ ID NO: 124813 - DNA, 503 bp, Homo sapiens
aaaaaatttttaaggtatctttgaggaagagaaaagaaaaacacttgcataaccaaaaatgtattctttttttggtttgttatggaaaagctggagtaaagatttgaattgcattccatagattttattttttgtgtactttgaaaatgatgctgagctgacacaggatcaggaggtggcccagatttatatggattacaaatggagataggatgagttaggaagagaaacctgataggtcattcttgagccatccagggatcttttcaaaatctccatataaagggcctaattggagaaagaaagggagggaaatgatcttcaaatatattagaaaaaatagttttgattgaatataaagaacttagggcactaaaacttgttagtagaaagagtgtcaagaagattctggtatcatctctggaaatatttcaagtattaggtattcttggagagtttggtatgaccctgttatcaaataaaagattgcatcagtgagtgga

SEQ ID NO: 124814 - DNA, 346 bp, Homo sapiens
tgtcatagcaaatgtcagtatgtcattgtttttcgtggctaatacctcatggtttatttatcaatttatggatgtttggggtttttccactttggggctattatcaataatgctgctgtgaacatttgtgttaaagtttttgtggtggtgtttttagttctcttagttacatacctgggaatagaattgcagttgctggaccatgtggtaagtccatgtttaactttttgaggaactgccagacattttcacagtggctacaccattataccttcccactagcaatgcacagtgttccagtttctccacatcctcaccaatacttgttttggtttttttttttttt

SEQ ID NO: 124815 - DNA, 866 bp, Homo sapiens
atagaacattattctgctcagggcaaaataatgtgggctgcacagtctggcccaggcagccctcagtgttgtgccctcaagtgttgagatgacaggaggatggggtcaggccagtgatcctcaaagtcagaagaagaatactatgcctcaatcctactcatttcctttccaaactctccctagagggcctctaactgtggctgaggggaggggcggcactttttgatacacggtgcaacttgcccactttgaccctgacctttgctctgtccccttcaggtgaccctggcaagtagctttttagagcagtggttctcaaacttgagtgtgtgcagaatcccctggggttggggggcagggctttgaaaatacagattgctgggccccacccctagagtttctgatacagtggctcagggatgggcccaataatttacatttctgacatctgggttcctggatgctgctagtggagagaaccggtgatttgatagcattggtgagctggctcaactctctgctcaggaaagtgacaggatgcctcaaatgctgagtgctgcgtattcaaattccaaacacaaggcaactaggatgggagcccttctagactctgtgtattcaaggaccagggagaggcttagcagctctcagctctcctggcacagagagagttctctgaagcttgctgtttttctctctcctactttgatagtttcctccatttgtatgggcggaggttgcaaaggccagaatagactcagcgagagtgggagatgggggtgagtgagtgtgttcacttttgatgaggagcagatgtgacaagcactaaaatggagtgggcaataagaattattactagctgaggc

SEQ ID NO: 124816 - DNA, 304 bp, Homo sapiens
tgtcatcccggctagaatgcgggggtggtggggggcaggatctctcctcacagcagcctctgtctttcagactcaagcgatccttctacctcagcctcctgagtagctgggaccacagggacataccaccatgcccggctgactttgtaatttttagtagagccagggtctcgccatgttgcccataataaataacaactaagacctcatagttgtcagtcatgtaatattattttccatttgctccatctctattcccagtttcagttagtagagtcctgatatacccagtagtcaaggcaga

SEQ ID NO: 124817 - DNA, 466 bp, Homo sapiens
taagaatgataaaaagtttaatcataatcatacattttaacaagcatagatggaacatcaaaatcctttgggaatattttgatattatatatctatccgtgctttttgtttctgaaatgcaaattttttctaaaaagattaacatagagcaggtaaatgacagttaacaaatgtaaataatgtggcataataatattaactgagcctcataattctttgagtctgatggttttcaaataaaaagtcttgaatttaaaattgaaacagtgtttttgaatcgcaactattacaatataagaaggcaggaaagctaatgacataacctctaaatggcatgttcagaaagttttatacttccaaatttgggtgaagggagaactatttctactttctttacccttaaatctaggaagcagtatcaagagaggcttgctctcttgagcagtatcaagaaaaaggagcagta

SEQ ID NO: 124818 - DNA, 208 bp, Homo sapiens
caggcatggctccacggaagcacttcctggatgcggggaagtggtacaagggggagacttcccagaggagtggataatagagcacagccttagacactgagtcagggttcactgcggggaggggcacgggcagcagcaaggaggagagactgaggggcagtccagggaggaggtccccagggaggggaccgatcacaggtctcacatg

SEQ ID NO: 124819 - DNA, 985 bp, Homo sapiens
ccaatttacagattaggaaattgaggcccagaaaagttaagtggcttatttcagggtgctcaactaataatctctgacttctgtctccaaactccacactctttccacagccttaccttgttggagatcacttcccaagtgtactgggtcctctaaagtggcttagaggtcactcattggaattagttatcagtgcataattggacactttgcaactattaaccccatttacaaagatcttctttactttccatcaccaagttttactgctgaattgtattctatttaaactgatttatgggaatgcattaaaaatatctgactaaaatttctattttgtctataccagttctaataatcctttcttattcagttaaaattatttaaacatttataaatctaatttaccttggtacccacatattttacacagaaataatctaacagtgactattaagctgtacactgaaatcatctataaatttctagtattcaatttctttaaaaatacattatttagaaaagaagctattaaaaaatgagtatgccctaaatataagatcagattagcccaaagattttgttctgatagctcaccttcacagagtgacatttggggaatttttttctccctttatttttttatttcatgcagcaggatatgaccggttactcagcaaaggacctcatttggtattgtgaagcctacctgagaccacctgtatttgatgattatgtaaacatactacttttctgaagaaccacaggtggtcaacacttgagattttgcaaaacatcgtaaatgggaaatgaagtctctaaagaacttaacaattcaagcaggcgtgtccattcattcattattcattcatttatctaactctatctgggggtcaactatgtatcaaacccaagaatagtaatagtaagacccattctctgcctccaagaagcacagtctcacatggggagacagagccacaac

SEQ ID NO: 124820 - DNA, 367 bp, Homo sapiens
ttcacattgagggtctttcagctggtgattcagggaggagctgataatcttgattgagggtcatggagctggagacccagacaggagttgatgttctagttagtggatcttccagctgcagacccagggaggagctgatgttctagtttgagggtcgtgcagctgaagacccggggaggagctgatgttctagattgagggtcgtggagctgcagacgcggagaggagctgatgttctagtttgagggtcgtgcagctggagacctggggaggagctgatgttctagtttgagggtcttgtagctgcagacttggggaggagatgagattctagaacatcagctctccccgagctgaggaccatcgt

SEQ ID NO: 124821 - DNA, 856 bp, Homo sapiens
  misc_feature (692)..(693): n is a, c, g, or t
  misc_feature (696)..(696): n is a, c, g, or t
  misc_feature (699)..(699): n is a, c, g, or t
  misc_feature (707)..(707): n is a, c, g, or t
  misc_feature (710)..(710): n is a, c, g, or t
  misc_feature (714)..(714): n is a, c, g, or t
gactaccgtaagaagtaatccaaactgggtgacttaaaacaacagaaattacttctctttcatttctggaggccacatatccaaaatcaaggtgtcagatttgtgatttcttcagagactctaggtatccatttcttgcctcttccagcttctggtggctgtgggcatcccttggcttgtggccacgccatgccattctgtgcctccatagttatgttgctttttcttctctctctaaacttcctctgcctttctcttaaaaagatgcatgtgattacacttagggtccagctggataatctggaataaactcctctcaaaacctttatcttaatcacatcttttccatataagataattttcactcatttgtcatagaaagtaatattcacaggtcccaggaattagaaagtgaatatctttgggaggccattttttagcctaccacaccattcatcttttgatttctttaacagtggcaagatgtcttcctctgtcagttgtctccactttgcaaatactggataggcagaaacatgaaaactaaaaacaggttaccaaaatggtgttttcagtcttcttttatactttctggaggtgacatgatactttggtacagcacagtaaagaagctcaacaatgataagtattgcatcatcctttcagatcatttcttatttaatttcttttanncanggnatattggnagnatgnggaatatcctaggtggtaaggcacacgtcggtcggattaaaatggacctatattaaatgaagcttgccccggggaaaatattttgggacacaccttgacgaaaaaacgttcatggcggaaaaaagccccgggttcccaacac

SEQ ID NO: 124822 - DNA, 484 bp, Homo sapiens
aggaccttggaaaattaaattggagtcggcaataatatttattttcaaagacatctatgtataggcaggatgaaaatggggagtgagcatggagataaagaaaaaataataaaataacccaacaagatgtctttcatgggcttatggtaagggtgtgccctgaattgacaggaataatgaactcaagttttggaacctgacattccccaaatctgcaagagttaagcctaaaacaaacagaccaaagccccaggttatgaatctagtcactgttgagcagtgagctttcgccatcttccttctgagaaggagctcagtggttatatggtttttgtagtgttaaacaatgctgctaggccgggtgcagtggctcaagcctgtaatccgagccctctgggaggccgaggtaggtggatcacttgagcccaggagttcaagatcaacttgggcaacatggtgggaccccatctctattttaaaaaac

SEQ ID NO: 124823 - DNA, 162 bp, Homo sapiens
tcgcctcagcctcactagcagctaggactataggcaggtaccaccgtggccagcaacatgtagcttaatttagaatcctagaatttcagaagagcccttagagaccaattctctcttttaagacatgagggaactgagccacagagaggctagccactggct

SEQ ID NO: 124824 - DNA, 203 bp, Homo sapiens
gaagcaagggagtgagccatgtggctatctggaggaggaataccccagacagtgggaggtcccgagtcaggaatatgcttggcattttgagagaagcacaagcaggccagtgtttttgggatggaataagtgagagggaagagaggtgagaggacaaggttctagctacctgtagacacaaatgtgggagtcatcagtgcata

SEQ ID NO: 124825 - DNA, 194 bp, Homo sapiens
ttgacttgctttgaccaatagaatgtggagaagtgacactatttcaatttcagaactttttaattcgcccttgctctcttgaaaccctgatgctgtaatgaaaccatactgcaatgtagcccaggaggaaaagaccacaaagagagaagatgccaagccataccagctgtgtacctgagcccagcctgcagcta

SEQ ID NO: 124826 - DNA, 475 bp, Homo sapiens
aaatattctgaaccctattgagctcccagttgtatctcctgttccttacctcacatgcatacactgcttggtgtttagctgaagacttaagggaaacccaatattctgccctgcaaatcttaccttggctcccctaaattctctacccagggaggttcccttccctagccttagtgccacagcttagaaaccccatgtagaagcttgcgcaattatagggctttctttgttttccatctctcaggagtcactgtcctgcactggcttttgtctaacatctgaaaaacttccttgtatacattttatataggttttaatttaaggtggagaaggtaaatcgtgcctctgctactccattttgactagagtggaagttaactttgtatttcctaaatgttaatgaggctgagcatcttttcccatgtttattattcattccttattgctctctgaaaagcttgtttcatgtcttttg

SEQ ID NO: 124827 - DNA, 402 bp, Homo sapiens
aaatattctgaaccctattgagctcccagttgtatctcctgttccttacctcacatgcatacactgcttggtgtttagctgaagacttaagggaaacccaatattctgccctgcaaatcttaccttggctcccctaaattctctacccagggaggttcccttccctagccttagtgccacagcttagaaaccccatgtagaagcttgcgcaattatagggctttctttgttttccatctctgtgcccatatgttctcattatttggctcccacttaataagtgaaaacatgtggtatttggtttcctgttcctgtgttcatttgctggggataagggcctccagctccatccatgtcctgaaagggatacgacctcgttctttttgtggccgcgcagatatt

SEQ ID NO: 124828 - DNA, 600 bp, Homo sapiens
gggttagtgccagaactgaattgcagtataccaattgatgttggaatatagtccctcaaacactaaaggcaaatgaaccaaagttcactccttctaccttttggtttataactagttcatgaaacagaaaagaaagtttagccaaaagctttctagttaatagatttattaataactggattgacaactgtggcttagatctaagggagaatggaagcttctagtcttctcatacttctagatcagcactactcaaaagaaatataagcctcaaatctgaaccacctatgtaattttaagtttttcagtaatcaccgttaacaaattcaaaagggtaaagctaatgttccttatatattttatgtaaccaactatgtcttagatattagcctaagttataatcaacactaaaaaattattaatgattttactttttcacattaatttatgaaaatgtagtgtgcatttcacacttataacacatctcaaattcgactaaccacatttcaagtgctatcaataaccacagtggtaagtggccaccatattggatgcatagttctaaacatttgaaactaccttggggaaaaatagaccaac

SEQ ID NO: 124829 - DNA, 713 bp, Homo sapiens
tactcaaaaatgggtaagatggcaaattctatattaatatatatttcgctacagttttaaaaataaataatattatgttccaaaaaccactgaattgtacacttcaaatgggtgaattgtatgtgaattatacctcaataaagcttttcaaaaaataaacagggtaacaattttctcacccaccattttgttttataaactgttttgtcaaattgaaaagtcctgaaatatccttttgctttactagtataactgaaaaagtaattaaaagattttttaaaaggtgaatagagagttcataatgacctgttttgctatcaggaaccttgatcaatgtgttacatagcagtatttcccattcttaatctaatgtactttgatccaaacaaacaaaaagctaccaggagatccattctaagggctctgtattgccagttatccatgttctatgcctgccacatatggaaagcatacagcagattgattatcttgggggctcttggggcagtattattgatctttacttttcttaatacctggtagttaaccatttattattatagactagattaatttctcctcctatttttaaagttttttttaatgtggcaaatacacataacatagaatttattatctttatcatttttaggagtacagtttagtgtatttaaatgcatttataatgtgcaattctcaccatcatccatctc

SEQ ID NO: 124830 - DNA, 1008 bp, Homo sapiens
tgatatgctgtctccaaaaaaaaaaagaaaaatattaaatgcagttgtgttgccagacaggctgtttacatatagtttcatctgagagacagctaaaaaatgaactaattagtatatagagttcctacaaagcagtaaggaaaaactcattaggaaaagggcaaaggatatacactcaccaacatggtgaaaccccttctctagtaaaaatacagaaattagcccagtgtggcggcatgtgcctgtaatcccagctactcaggaggctgaggcaggataatggcgtgaacctgagtggcggaggttgcagtgagccgatatcacaccactgcactccaggctgggcaacagagcgagactccgtctcaaaaaatatacacacacacacacagacagatgttcacctgcatttatgataaggaaaaatgctaataaaactgtagtaaggtatttttcacccattagattggaaaaggttttttatttttatttttatttttatttttattttagtagagacggggtttcaccgtgtttcccaggctggtcacaaactcctgagctcaggcagtctgcctgccttggcctcccaaagtgctgggattacaggcatgagccaccaagcctggccggaaaaggtgtttaaagtttgttacacactgggttcagaaagatgttgagaaatgggaacatttatgcattgctagtgggagtataaattgaaattaactccaggaaggacagtttaacaatttatcttgtggatcaagtgtacatttggtgcatagttggaaataccaagattggaagcagcttaagtgttcctcagaggaagctaaataaataattagggtgcccatacagtagaatactgtacatatagtgttatatatagaatgaggcagctattaaatatatggacatggaattatctcagagcgcttactaaatggaaaagctaaggtgtagaataatgtgtagtgtgctaacatgagggagaggggaaca

SEQ ID NO: 124831 - DNA, 305 bp, Homo sapiens
cgcctgtccgagagtcagtatcaaaaaaatgttgtcaagtatgctgaaaaatcttagaatataaaagtgtacatttggtgcatagttggaaataccaagattggaagcagcttaagtgttcctcagaggaagctaaataaataattagggtgcccatacagtagaatactgtacatatagtgttatatatagaatgaggcagctattaaatatatggacatggaattatctcagagcgcttactaaatggaaaagctaaggtgtagaataatgtgtagtgtgctaacatgagggagaggggaaca

SEQ ID NO: 124832 - DNA, 189 bp, Homo sapiens
gagctaatagttaaaccaagatttttctgacactgtttttgaactcacaaaggtgagacaactatttttggcatatccttttccattaaaaagttatgaggctgggcacagtggctcacgcctgtaatcccaacactttgggaggctgaggcgggcagatcacgaggtcaggagatcgagaccatcctc

SEQ ID NO: 124833 - DNA, 158 bp, Homo sapiens
tcaacaagggagttaagagtggggaaaaccaagtgtctaatttcaagctgaggaacaaaaactttcattatctaactcaagaacaaataatataaacaccattttaaacatagatatgttatacttttcaggaactttccaatccattgcctcgttga

SEQ ID NO: 124834 - DNA, 258 bp, Homo sapiens
aaatatccaaatgatataagcacgcaaaagacatgacattattcttaaaccagcaattgctcaagaaaaactatatgaataattgaaatatgaggtgtgcctacaatgacataaggtcaaattctttttaaaggaatgtatcacatcttctatatctaaacggttgtttgttcctatcaaagtatttgccttgagaaaccgaagttatttccacatctacttctattgctcaggcttgtttcgaagtccacttcgtgc

SEQ ID NO: 124835 - DNA, 674 bp, Homo sapiens
tcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctgggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggt

SEQ ID NO: 124836 - DNA, 759 bp, Homo sapiens
catggtggtacgaacctgtaatcccagctactcgggaagctgaggcaggagtattgcttaagcctaagaggcgaagttgcagtgagtgaggatcacaccactgcactccagcctgggcaacaaagcgaggctgtctcaaaaaaaaccacaaagaaacaaaaaaatatgtacacaatcaagtactgggtggtaatgtgagcaaataaaaatatagctttgatgagattatgggcaatctgttatttcaatattatttttgcaataaaataatgtcttaaaaagctaaggaaagtatttgcccaagttctcattcacagttgagaaaatgaggcccagatttgacaaggatcacgtaccaacactgagggaatcagctacaatatttagtcaacattttacttacagaggagtaatagattataaaaaacacagctttcaactccaccaaaagctacagttgagctattttgccattctcaaaagcacaaattagtattaggttaaggggaaagatttttttacatgctttagaatgaaaagcattggggcaattcaacaaacacttattgatcaacttataactataaaactcttgttctaaatgctacgtaacatgcagagacaactagtacatgggctgttcttcaagaatttacaatttattgaggaagaactcttatgataagctagaatgaaataaaagcatgaacaactaattctaacttgggacacaaaagaaaaggtcatagataaaatatt

SEQ ID NO: 124837 - DNA, 732 bp, Homo sapiens
tcttccaaatgctggcattaggaaaacagagcctgtgtctctctagaagaggcacactcttttctggactttatatttctccagtctgcaaaatatccagtaatttgcacctcctccccaactgccttgtgtgtgtgctgtgtttgtgctgttcagttaagagcatttgtagaaagaggggtgttgggattatctttcccagatggaaggaaagaagcagagaggagactcctgttgtttaagcctcacagaatctgacacttttaggaaagaatgattctctaaaaaccctattcatcttccccagataccactgcaatcaaagaggcttcactgcccaggaactaaatagctcttccaagtaaattaggagcttctttcagatttccagtttaccaccatgggcttggacatcttaggtttctgacagtaaatcaaattgaattgaaatttctctcctaatttgcctcgtatctattgacctatgtctgaaagagacacaagtggaaatttcttccacagcagctacatatattatctaaactttgacagcagctggttgcagtcccaaagcaacaggatgtttctgttcttagcactacacagacacataatgggaaaaagagacatacatcacagcattgactcaagttcagctcacagtcagctaaatactttttcctcattaaaaaagcagactgtggctattccattaagaatagcctgttcatg

SEQ ID NO: 124838 - DNA, 311 bp, Homo sapiens
atcctgtgcctactccaccttctgctaacttgcttttcttacttaatacgttgtgactctgtcaaaaaatacaggactgtatgatcacgtttatggcttcactatattcccttgtatatagatggactataatttaattcctttaatgctggatatatgggttgtttctattttttgctatcataaacagtgttagtacttactgatttattgtggattaaaacagagaaaggggttttaaaacccacttctaccaccctaacctgtatgattccagtgattttacatatgcttaaaaacaaacatgtggt

SEQ ID NO: 124839 - DNA, 287 bp, Homo sapiens
atgtataatgaaaggatcaacaatggatgagcaaaaggctgaggacagctgttctctgtaaagtcaccacaggaacttcttaacaattaaataaggtagtattcatgaaaaatacttcagaaaactgtaaaataacttataatgggaatgaaaattccagttgcttttatgataagtgctctactttggggctctaatatactctaatattatttctattacagtacgtaaatgccacacctggccaaattccaataacttatcactcctacccatggttattctaa

SEQ ID NO: 124840 - DNA, 481 bp, Homo sapiens
agaagtgacttggcacagagagaaagctagcagctgggtttcagaaggggtggaagctaacaataagtaagtctttgacctgctcgactctgagaaggtccagtactttggaggcacaaagtactacagagagtaaagggttaaaaaagaagagattggctgaaagtttatatttagaatgattagctactcctgtcccccactaggtgatatctcctaccctggtagccaagcaactatcccattactgcttcctttcaccttgcctgtcctgccagccgactggagatctattctctgaagacatcaagaggatcaaggctgggccaggggagaaagggcagaggctgaggcttgcctccatttcctgtccctattccatgcttacatattgcaggcaggagactactgaattcctctttggaaaaatggaatggcctaaaagaaataccatcagagagtgacgtttgggagttccata

SEQ ID NO: 124841 - DNA, 129 bp, Homo sapiens
tgtatgagagttctggtttgtccatgtctttgatatgtccacatctcgatgtggtcagtctctaattttagacactctcatgtctgtagtggtatctcattacaattttaatttgtatttccttaatga

SEQ ID NO: 124842 - DNA, 727 bp, Homo sapiens
ggtaatgtatataaaatacatattaacatagtacctgacacatggtaagcatcaaaaaatgttaactacttttattactattattattacgtatttttaaataattagagagcagtatcaaaaattagctgggcgtagtggcatgcacctatagttccagctactcaggaggctgaagctggaggattgcatgagcctgggaattaaaggctgcagtgagccgtgttcatgcccctgcactccagccttggtgacagagcaagaccctgtcttgaacaattaaagaaggcattatgccgcaacgttagcttagaaatgatccacatatatcaccagtaactgtcaacaggattggaaccctagttttgggtattatgatcacaaggtattattaatagcttattaataataaagcgttggctaggcacggcgactcacatctgtaatcccagcactttgggaggccgaggtgggtggatcacctgaggtcaggagtttgagaccagcctgaccaacatggagaaaccccatctctactaaaaatacaaaattagccgggcgtggtggtgcatgcctgtaatcccagctacttaggaggctgaggcaggaaaatctcttgaacccgggaggcagaggttgcagtgagctgagatcgcaccattgcactccagcctgggcaacaagagcaaaactccgtctcaaaaatataattataataaataaataa

SEQ ID NO: 124843 - DNA, 343 bp, Homo sapiens
gccgtttgtgaaactattagagccagttaagtgctattattcattagaagttaaagaggttagaatgttgcctggcatatagtaagtgctcagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatacttt

SEQ ID NO: 124844 - DNA, 1700 bp, Homo sapiens
aatgagacaccatctctacaaaaaatgcaaaaattagctgagcatggtggcacgcacctgtagtcccagctacctgggatgctgaggtgggaggatcacttgagcccgggaagtcacagctgcagtgagccatgatcgcaccactgcactccagcctgaacaacagtgtgagaccctgttttttattttttatttttatttatttattttttaaagacataggtagctagagtaatacagagatgaaagggagagtattcacacacgcttcttaaaatagaaattactaaattttattttacttaaaataaaatttagctgtgaggattctccacaaggctgctcatgacatggcagatggcttccccttgggtggaatgacaggagggcgagggccaaggtgagggtggtacggagagagaaaaaactaccaagatgaaagctgcagtgccttttataacctaatcttggaagggacatatcactacttgtgccttatcctttcagtcacacagaccaaccctgatatgttatggatagggacttggagactgctccaaagaccaggaggtgacgatcactggggtcctctgggagactggccaccacagttgccttttccttttcaggtcacttacaagggtctttgtgctatggaggtggatgtgggcataatcaaagggtacatgttgtacaggcctttattatacaaacctctacaataaaacaatgaataacacatcactgccaagacagttatacagtgttaaattggaatggaaaggaaggaatcagaatttcatgtgatagaacacttaaaagtctgcctgtgcacatgtatgaatatgcattagggagaagtaaaagagtgacctgaaaatcttcctaaagtaatattatctagaaagtttgagaggtttaactgtggctaacaagatttcctgaagataaaatgttcctggggccttaatagttacaagaactttaccaaatcaagaaagcaaatatataggagtctaaaaattatttagttttgcatattcatttcagagtaccaattatgattttatttctttttaatttttaaaagtttagaaaaacaaacgagaaccaattacaatgttaaaaggaaacaggaaggatagacttggggccaattatattaccgtttgggtttttgttactataaaaatggaaatattaaagattttaaaaaatgagtggtaatagagtacaaatctgcaaatgatgaatcagcaattatatttttataccaaatggtatgtttgtgatattgatatagtattaatgcactgtgaatttatttatttattttgagatggaatcttgctctgtcgtgcagactggtgtgcagtggtgcgatctcagctcactgcaacctctgatatggtttagctgtgtccccacccaaatctcatcttgaattcctatgtgttgtgggagggacctggtggaaggtccatgaatgatgggggcaatcaattctttcctgtgctgttcttatgatagtaaataagtctcacaagatctgattgttcggcaccggtgtttccccgggtcgcagaattcccactctttgcgcccgggctggtcgtgaaagctggggccaatcgtccgctaccttggcggacttcgggcttgcccgggatgccggtggacctgtccggtctaaggctcca

SEQ ID NO: 124845 - DNA, 170 bp, Homo sapiens
tactggagttaattaaaacaaaaattgaaagtagtccctctatacgaaaggacaatactcatgataattttggctttcttgtactctctttccaagaacagatgacattatgaaaaacaaaggaagaaagccaaacttattcacatctcatgaaaaatcatagaaagata

SEQ ID NO: 124846 - DNA, 130 bp, Homo sapiens
ccttctcacatttgtatgcatgcatatatgtttatagtcgtggtttttaatttagcattggtgatatcatactgtacgtgttatagtgtgtttttctttttcatttaatggtgcattttgggggctgttg

SEQ ID NO: 124847 - DNA, 655 bp, Homo sapiens
aaccccacaaccagaaagataactattaacatttttaaaaatatttacctctagtaactctgctatgtgaatctctttatctacacacatggatgcaccatagttgggtttttggtttttttacccattcctttatatatagttataaggttatttccagtctctgctattttaaattatgctgaaatgatcagaaattgatcacttccttaaggaatattcctaacagtaaaatttgggggtgaaataatatgaacattttgaggttttcgacacatattaccagactgctttctagagttctatccatttacttttctaccagtaaaatatgaagtacctgtctcattacaacttcaccttagaatagttttctcaaactttagcagaattacctagaaggattgttatatttgagttctgggcccctactacaaatttctgattttagactgtggtggggcttgagaatttgcacgtaattaatttccagatgaggctgatgctgccagtctagggaccacactgtgaaccactggcttaaaatattattgcttttaatctttagccatactgataggtaaaaagttgcatcttgtttattttgtgtttctttaacagtgaaattgaacagtttttcacatatttagacact

SEQ ID NO: 124848 - DNA, 631 bp, Homo sapiens
cgcggtggctcacacatgtaatcctagcactttaggaggccgaggcgggcggatcacgaggtcaggagatcaagaccatcctggctcacacggtgaaaccccgcctctactaaaaatacaaaaaaattagccaggctttgtggcgggagcctgtagtctccgctactcgggaggctgaggcaggagaatggcgtgaaccctggaggcagagtttgcagtgagccgagatcacaccactgcactccagcctgggcgacagagcgagaccctgtctcaaaaaataaataaataaataaaaataattggaactagacaatgaagactcatgctggattttcagtttgttagaattcaaggaaaaaaatactgaacaattggaggattttagtattgtaatttgaatgtaataatctacagtctttttaagactcaaaggcaaataacttcctgattgttgattctaatttaaaaggctctgtggaggaggaccagttgtaaatgatgtaaaatgaaataggaatattactaatcacaggaaacatattaatatgaaccaaatgctaaatgatcttttaaaattaattattttaaactaatttttagttcacatgtttccattctacagtatata

SEQ ID NO: 124849 - DNA, 329 bp, Homo sapiens
cagtcttaaagttttcagtttctcaactttcctttttgtctggacccattctagggtcttttatttgttggtggttttgttttagaggcccaggtgtggcctttacccatactccgggccttgctcccagtctcgaactcctgacctcaggtgatctgcccacctcggcctcccaaagtgctgggattacaggcatgaggcaccatgcccagctgaatgccttaattttaacaagagggggactgttgatggtacccacttcacagcgttgtcctggggattaaatggcagaccagagcatactgcctggaatataagaagggctcaat

SEQ ID NO: 124850 - DNA, 415 bp, Homo sapiens
caagctttccctctccaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgtggtgctcatcaacaacaacctaggatggcccaatggactgactgttgacaaggccagctcccaact

SEQ ID NO: 124851 - DNA, 523 bp, Homo sapiens
gaccactgagagatttatctttggcaaggggataatttttggtaccatcttaaatcacatgcaatatgtaaccctctatgtatagagcttccctaaattctgaagttgaggaactcccacaatcacctgggatgcattttctaaaatagagatttttcaaggaacttaacagaggattttattcactaggttatggcagattggcatcctgtactttaaaagagatcactccttcccccagaagatctaatgcccagtcactttgtgactagtgctatcaactcattgatttgacctttgacctccaaaagctgaggacttaatcttcatggtgaggatttttgttttttccttgcagtgacatgtacaacttgataactcacctcataatgcttctgcattgaaagactttttttgataataaaaagaataattattaacttgctttaaaagaagttgctccattatgaaaggactgaaaaaaaatgtagttattctattagatctacccttcatccctgaa

SEQ ID NO: 124852 - DNA, 260 bp, Homo sapiens
gtcaaaactagaagctataactttggagcacagagaatagtattgattcagttggggtgggtgtgtgggctggtcagaaaatattccacagagtaggtaactaggaggcctctccgaatcatagtctctacagtcagtgccatctgttatttcctctcagagtcattttcttcttagcacttatgacaatgtgtaagtaaatatttatttctatttgtttattgtctgtctttcctgtgagggcagggagcatgtctgtt

SEQ ID NO: 124853 - DNA, 110 bp, Homo sapiens
cttccccatctgtaaaagagggataataatagcatctaacttacagggtgctgtgagaactgaaggggtttaatatgtataaagtgctagaacagtgcctggtatatagt

SEQ ID NO: 124854 - DNA, 202 bp, Homo sapiens
tatgcagttgtcgtgaggcaccatgtgagaacatttgttcattgtctgtctcccacctttacaagtacagagaccttatatgtcctatttaccacaatatcaccgacacctagagtgccaagttcctaggaagtgccaagagcctgaaatccagcaagtcttctaatgacccagtgcaggggcagctcacgacaactgcagc

SEQ ID NO: 124855 - DNA, 378 bp, Homo sapiens
cctatcctgcaggttgtcaaagacaaagccacagagtcagatgaactattcaggatggaacaagggaaaacatacaaagtgggcttgcttttttaatggtttccaaaagagcagacattcaggagagattaattctgtgggtgaagtctcagctactacaaagagagtaacacctcccctgctcccaccctgttccatctcctgctggggttgtggcaatagcttcccaaagggtctctctgcttccactttatccctcaatgacatacctattctctagccagaagacagagagatcctattgagtcataattgttatctttgtgttcctgtgtctgagaccctgacatggcttcatagccatggcctaagtctagt

SEQ ID NO: 124856 - DNA, 440 bp, Homo sapiens
gttcttctgtaaaatgggggcaaaagaataactatcttcaaagggctgtggtgaggaataagtgatatcatgcctgtaaagtctcagcacagtccctggcacagagtgattcctcaataaacattagctataattattagggtctaaggcccttgctggatgacagtgctgtggcctccgcccttatgaatcaaaggagcagcaagaaatagggcaacactatggttttggctgaataggagtagcagccatgggtgggcacagtggagggggctggtggggagccttgcaggtacctggctctctcaaagggctcctctgcctgcaataaagttagaaatggaggatgtggtttttggttccactgagccaggccacaggcagcatgttgtagccacaaaaggccagatgctgtgatctcctgctgtagggaagaaggg

SEQ ID NO: 124857 - DNA, 378 bp, Homo sapiens
taaaacatacatgagacaaaatctcacaaaacggaaagggggcacaaatccacaaagagtggcagactttaacacacctcctacaggaaaggaaggacttcaggcacaggactgagatggtgggttctgcattgagatcacggctgcttctgccttactggagaaggactgagggcagagactaaacccaaggagaccaagaggaagccgccgaacaagctcaggtgggaatgatggcagcctggaggtcaacaggaagaagcgaagccacttgtgaaacagacgcaacaggacctggccactcacaaaagcagagacagggaacgaacaccaagtgtgggttttctggcctacacaagagcagcaagcaaagcacca

SEQ ID NO: 124858 - DNA, 313 bp, Homo sapiens
ggcgaaagtggaaatacagtgggaacaggtgactgccgatagcagaccaggcctgtttggaatgtggcatctgcaatgacctaaatcttaagtctgcttttactttcttttaaaattttaagtttttaaaaataataaaaagtggtcaggcctggtggctcacgcctgtaatcccagcactttgggaggccgaggtgggtggatcacaagatcaggagtttgagaccagcctggctaacatggtgaaacaccgtctccgctaaaaatacaaaaattagctgggcgtggtggcgcacgcctgtaatcccagcta

SEQ ID NO: 124859 - DNA, 725 bp, Homo sapiens
gatgctggctattttaggctgcatggctttctgactactgttttagactccttcccccacacctacccagttcatttttgcttggttttcttttgagcttggcatcttccttaaaggggattcttcaaatatatgcagagaggctgctgattgaaactactctcccaccttattctcttcctctgctttccaggggcgaccttttaagttcccttcctttgcctctgtctgccttctctgaattttcagggagccatttttggcagtttccatgtcttttttgcagccctgggagataccaacctcaaagatcagtttcaaaaactcagcagcagtgctttgggtaccctttctgtgcatggtgctctcagagtagtagtgtttgtcattttaaagttcagaaagttctcaatgaaaaatgcactcagaggtcagatggcctggacacacaaaaaaagtgtttgaaactgagtctgccatgatattttaaagggagctatgtcaaaatgtggtttattaaagggtatacgagagagagtaagagagagagagaaagacatcatggtaagtaggtttccaaggaggaaaaaaccaaatgttcatagaactgcctggagggctccctgacaaaacaaaagagactcttaaaaggaaaaggtatctttagagaaggtacaaaaggaggccgggcgcggtggctcacgcctgtaatcccagcaatttgg

SEQ ID NO: 124860 - DNA, 421 bp, Homo sapiens
gacctgaagagcgaggggcactctgcatggctggccagggcagccccgcccagggaggccttggtgagcaggagagaggccatgtggctgggcctaagggtgttggggagggtggcaggatctgacctggggctgggatgtggcagtcaacgtgtctgatgggtgttttaaatggatgctctggctgctttgtggaatattctggagggtgggtttggaggagcagaagtaggggaggctcatgcaatgagcaagtgagagctggtggtgtctcaatgaggatgatagagaagacatggtgagaagtggttggatttggctgtatttgaaggtagaacacagaattttctgaagaacggaccgtgggatgtgacagaaatgcagacgggggcaaggttttgggttgagtgtccgggtagct

SEQ ID NO: 124861 - DNA, 701 bp, Homo sapiens
ggggactcggttaagcttattagcagctttagaaacttcactatatcagtaaatcagcatcaactagatacttagagctaacttacaatatcatgataaccaaataaaaagagttttcaccatggacaagattcatcaacagtgactgcgctatttaagctcttaactaaggcacgagctctacctggtttcagaatcctcgggaagctggattcgtcatctggagggttgcttgcagaggatgacattatgtgaaaggagctgcattattctaaagggtatttcatgttggcctttccaccaagattaggttcattttctcaaatgtgctacctgcagctctcttcttccttcaaaaccatgtcaacatgaaacacaatgaaagatatataaatcgcaaatggcaaaaaaccattcacaagcttcaatattttaacttttattggtgccagattacctggaaaacaccttacaaatgatcccaaagtgctgggattacaggcgcgagccatcacgcctggccaaatcagcatcataatttaaacataaatatataatttctttaccatatacaacagcagtaaaaatgttgcttaaaaagttggtacaggttcacatttttcttcagtgaactttttctggtttctgtaattagtcctattaagacgtcagcccattgtccctaattatcatttcctttc

SEQ ID NO: 124862 - DNA, 159 bp, Homo sapiens
aatctccctcaaatgtaatgtctcactgagccctgcgcctttaaaacacacggacacatactcatgcatcaagctgctaacagctaataaaaatgaactattaacattccagactctgctaggtgcctgtaatcctaacactttgggaagctgaggtgg

SEQ ID NO: 124863 - DNA, 130 bp, Homo sapiens
atgtctttgtgctctgaaaacttcttcatcttcttggaaattaggaagtgtggccagacaccctactaagggctagtaaatcacagctggctttttacagtgttccacactggagagatcctacatcatg

SEQ ID NO: 124864 - DNA, 136 bp, Homo sapiens
tggggaacaatttttttttgttttctttgtgcatggaaaagttctttagtggtgatttctgagatttgttgtacttgccatccaaacagtatacactgtatccaatgtgtagtccttttttttttttttttttttt

SEQ ID NO: 124865 - DNA, 388 bp, Homo sapiens
ttcccatgtgcatttccaaatgtgaatagctggaattccaaaaattcattaatttaattttcatttcagttgaccctcgaacaacaaaagtttgaactgtgtgggtccacttatatgtagggcttttttcaataaacatattggaaaatttttttgggaattgtgacaatatgaaaaaactagcagatgaaccatgtagcctagaaacataaaaaaaaaaaaatcaagaaaaggttaggtatgtcatgaatgcatagaatatatgtagatactagtttaagtatgggattaatcaattatttatgttatcaataaggttaccagtcaacagtaggctattagcagttaagttttgggggaatcaaaagttgtacttgggctgggcagg

SEQ ID NO: 124866 - DNA, 486 bp, Homo sapiens
atgctctttgaccagtcaaggatccccacacctcggcccactattcatccaaaccccttaaaatccctacttccaaactccttggggagatggagttgaggtttccttctgtctcctcatttggttgctttaccatgaaacctctttctcagctgcaactgggtgacttagcgtattgccttgctgtgcatcgtgaaacaaacttggtcctgttacatgggttctccttgagtaaaaccaaggacagaggaggcagggaagcatggcttagtgaaggaaattcatcaggggccccaactgattcaaatcagggcttagactatctgaagaaatagattaactgagtagtttttaaagagcctttctgaagtggctacgttgtctggggtaaatacccggggtttgttctctcagtcctctcactccaggaaaatttaggacaaggacactcatgaggagtttaggagtggaggtttaataggcaga

SEQ ID NO: 124867 - DNA, 574 bp, Homo sapiens
aggacaggaaattaacataacctggtgaggctcatgaatctttcagccttagtatcagaactactcggtaacctgtaatttaacccatggcagtacttggagggcaggaagttagggtttgtgcctggtctgagaaagcctattttcacctttttatgagacttgtgctcttaaaagacagagaatgaaattatctaagacatttgacaaccatcaatttagtcattttcttccttctgtcaaataaattgtactattcttttaaacattttagagccctgttgaaaatttgcaccttttttatatagtaaaacatcaatggatggaaaatcctgttttctggggtagccctctttattgaacttctctaacacccacagatcccgtttataaagaagaggcacatttagtatgtttaaacaatagtgaactctttccttctgtgaatttctcaggatgtgttaatggtgtctaaagtttaatgctgctaaacccacacaggaattttcactggttttaaatgccacaaaaacagtttttttttaaccctttttttttgggtttgaatagctgg

SEQ ID NO: 124868 - DNA, 338 bp, Homo sapiens
gttgcaggaaacaggaaatcattaaaatatttttgagtggggagcaaggattggcctttgagggcaggcagcttgggtttggggtgctgccaagaacagatcaggatttcttggagagtgcaaggccctggatctctggccggcattcttgtttttgtcattctcatgctgtggccagcctccaccccagtgcggagccaagcagggctcctcaggaactgcacgatcattccagtcagggtaatttcctgcctctcagcctctcctgcctacttcttggctgagaagggagaaagaaggaggccagagacaccaaaacaggcaaaaaggcctgtctt

SEQ ID NO: 124869 - DNA, 286 bp, Homo sapiens
aagagtgaaactccgtctcaaacaacaataataacgacgacgacaacaacacctttgctgtcaaaaataaccaaagtcaaaagattgacatcaaattggaaaaaataccaataacatcagaaaggactattttcctcaacatataaagagcttccataaataagtaaagctcagcctggaagaaaaatgagcagagggtatgagcaaacaattcacagacaaggaagtacagatgattcttaaatttgaaaggacgctgagccttgctaatgatagattaaaacaa

SEQ ID NO: 124870 - DNA, 289 bp, Homo sapiens
agctctatgttgcttgttttttagttgttgagttgcagtagtctttatatattttggatattaaccagttgttaaatatatgatttgcaaatatttttttcctttccatggattgcctttttactctgtgattattctttttggtacacagaagttactgagttttgagattttttttttttttttttaacgtattcaggatacagattctttatcaggtattattttgtaagtatttttttcccattctgtgatttgccttttctttctcttaatgacagtgtctttt

SEQ ID NO: 124871 - DNA, 328 bp, Homo sapiens
atcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccacagagagagcgtcccccacagagagagcgtccccacagagagagcgtcgacggggaggagtgcccccacagagagagcgt

SEQ ID NO: 124872 - DNA, 258 bp, Homo sapiens
aaagtcctgatgctgaggtgatctaaggatcccgggcagtacggatgtggacatatgtaattgaagggttcctggaagctcaaatccccatggccaggcaagtcctagagcccgaacttctgtatctctggctggcttcccaggccatccagtgtgagaagacctctcactctcaccaagaccaccctctgggggcagggtgggcagtgacacctgtgagccctggattttccccaccccccacatcgagcagggcag

SEQ ID NO: 124873 - DNA, 811 bp, Homo sapiens
ctcccaagtagctgggactacaggcgcccgcatctacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacatttcacttcttaagtcttctgtgtttttgggtcatcaaatattcccggagagatgctcttgaggatctaagatccagctgtgggatgaggtgtacttcccaccctgccacaatcactgggcctgcccatacgggcagaggccctgtgcgccccacctgcctctctcacggtgtgacctcatggcgtgagctcaggaagcttgcggatgggaggtggtggccgtcgatgcttggcgtccttgcatgttgtgtccatgggccagcggttcatgtcacgcaacaagcgcaagggctggacccaggggaggttccttttgacagatgcggatcggggcctctcgtgaccaagctgtccttggtgtggacgggctcgtcggctaacgtggcagtgagggtcactcccaccgttgcgagccatgtttcccatcttgtggacggcttccaactaggggccttggtccgcccccttcaattggccccccgaattctttccccaagaataaggacctcgtgggggcttctgggtagagacactcttcttcataaaccgttacaaccacgaggcttgacccttgctgtttggtcggggcgatagtgggcagggagtactttggcggaggggaccttggg

SEQ ID NO: 124874 - DNA, 350 bp, Homo sapiens
aaatatgtacgtgccgaggcttttcctccccacacctacctcaactctttctgccgacacactgcacttttcaagggaacccaagtttgggttcggcaagaattgtacgttgcacaccgtgtgtgataattccagggaatttcaatcgcatcttgtcttccttcctaagcaaattcggtgggaacctggtgtggtgtgatagaaaaagccccgagttctctgtggtagaccacatcaatttcatgtgccagtctctcagactccggcttgcctctctcaaggaagggaacaatggtttgcttggcttcactcctctctttccccccaatttccacatgggtatctggcta

SEQ ID NO: 124875 - DNA, 959 bp, Homo sapiens
gcacagagtcagattgtccaaaagttttaccctgtcaaccttcaggagtgctatggggttctcccatgcactctgtcctgagaaaatgccactaacccactttagatttgcacctaattcttctggtggacacttggcctttcactgtgaattttgtcataaggaaaataacgacttgaatgtatttaacggacaatcagtgtgactacatagtatatgtttagagctggagagggatatcagagagatccggtataggctcccaaactaaagagctgagtttcactagggagagagagacctgtacatgaacagcacaaatcacagaatcccaagtttctcctatgtgccacttccataagactgagtccactggagtgggaatgattcctaatttatactgaattattcttttgattattttcatggctatcacatatggtacatatcctaggccatttaaggttgctcaattatattggctgcctatttttaacatagccatttatgtaactcaagagtcaggaagctacctttgaacactgtaaattgtcaaatggtttttgatttcctaggttccttatcacttggcaaatatgtacagcagaccttttccagagaatgagtgcactgggacttatcccccagacattccttctctttgttaaacccacagtctcaggcagggactccagcaaccctttcctcgggaggaagaagcctctagatttcaggagtgccctccagtggctgctctgctaactaatcctctactgatctccccaaggctgactggggcagcacttcttgcagagctaaagcccagctgaaaactgaggtaggatcttctcacttagaaatatccagcagtaggaaaaggcctcgatcattgcatagacaggctaaaattgacgagtgctttctgtcagaaagtttgtggggtttggtgcatttttttt

SEQ ID NO: 124876 - DNA, 655 bp, Homo sapiens
ggatgtgcttaatgtctccagcgatgaacgttttctgccagagaaactcatctgagcctaggaatgcagggtttttatgggagccagttacataggcacattggcctagccaaattgcagccctccagaagaaaggcaagttttcagcataaaccacattgtttgtacagacagtttaggcatagtacatgacccttatcagatagggaatggtgggaacacaccgaaaatccaaggttgcaagcacaagccaggggccaaacttgtaacaggcctttctaaggatagcagtctcagcctgctatggtatctcttttatgcacactgctaatagagacaaaacaaatcttttaaaaagctaagaaatgggctgggcgcggtggctcacgcctgtaatcccagcgctttgggaggccgaggcgggcggatcacgaggtcaggagattgagaccatcctggctaacacggtgaaaccccgtctctactaaaaatacaaaaaattagccgggcgtgatggcaggtgcctgtagtcccagctgctcgggaggctgaggcaggagaacggcatgaacccgggaggcggagcttgcagtgagctgagattgcgccactgcactccagcctgggcgacagagtgagactccatctcaaaaaa

SEQ ID NO: 124877 - DNA, 613 bp, Homo sapiens
ctgtcttggcctcccaaagtgctgggactacaggtgcaagccactgcgcccagcccttgaggagttttcaaagtatccacagcacccaaggctgagaactgctacagcagctgaaagccataagtgtctttgactttccttttgtcctggtaaaccccttcattccttccttccttccttcctacactcattcaatcaaacactggttgaacaccaacaagtcccagcactgtgggctccaccctggcctctggggagtgggggagggacccccgatttggagattgtaggtgccaagaggaacgggcaagatgccctcctattcattcatttattccttcagggcctctccaagggcacagggtcttttcttgttggcatctgggttttcctctcctgtaagctgggaaggagatttctccctcaaggagctgttggccagatcaaagactaaaataatgctaaacagagcttccgtttcctgataaatgtatcaggagccaagcacttaaaatatattatcccgttgaatccccaagtaggattaaaacctcaaagcagagattgctcttatcctcacatgacagatgaggaaactgaggatcaaagaagt

SEQ ID NO: 124878 - DNA, 504 bp, Homo sapiens
gccggaacgagctcatagcaaaaccaaaaatctgcagacatttccaaccaaaccaaatgagaaggtatccctttgaaccctgaaaatagaagcaggcaagaataaataattgatagtcacaagacctgcatggcatcctcatctgggcaggagaaagcagaggagagtaatgaggcatttaacaaacctgagaacaggaaacccctaaaatatactacaggtattcactggaaggctcagcaggccaattttggaagagtagctgaaacggttttgcctattccaatttgctggtgagagcagtggggagcccttcagtgaggtctgaaaggtatggagaagtccggcccctgtgaactctcaaaacccaccaggtaggaatctcttttaggacaggtttgttccctaaagatactactgggactagaattaaaattgaacagaataggcattacagagatgaaggaaagaaggtagacaaaagtgatgagaatctccaggaaa

SEQ ID NO: 124879 - DNA, 418 bp, Homo sapiens
gctcaatgagaggtaaaggaactcagagatgctagagagctcatatggcagagctagaattcattctaagcctgtctccaaagtctgcacccttttctactacgttatactgcttttcaccatgctctatcagcagcagcttcttcatcttatgagaaagtcaaaaggcatgtttccaaagcagtttactatgattgactttccactgattagggttcctaaaactttttattgaagtatactaacacaaaagtctacatgtcaaagtgcacagacaaaaaaaaaaaaaattcacaattcacacaaattgaacacacccaatgtaactagtagccagataaagaaacaacatcggtccaggcatgtggctcacacctgtagtcccagcactttgggaagccaagacaggaagatcatt

SEQ ID NO: 124880 - DNA, 230 bp, Homo sapiens
aggccccaggtgaccccaccctgttgtctaggcagcctggccctgagacagccttgtgctgaggccctggagtgggacgttccactgggcgagggggacatgggtgccaggccctgtgctagacggtttcccctggctcctaccaccgggcgcaaagcgggctggggattgaggctaagaggcagcctgcatgaatgtgggagggactggccaggcccttgatgctctgc

SEQ ID NO: 124881 - DNA, 634 bp, Homo sapiens
gactaacctggttttgatcaaggtgtttttttttgctttttgtcccttgtaaaagttaagagaagctgtaactagtaattaaaatagtaagccagcttctcattcatgtcaattctttcatattataggtacagttaaacctatagctgcaggttacgcacatacaaaatcggcaaggctagtcttctcttagaacagtcatgggtatgaattcaaacaaaagatctttgcttttggttaatataatagattgacaaactgctgaggagagttaagaaattcacaggctagtatgtaggctaaatgttcttttcgtactgctcccaggaatgttctgccttttagaactagaggctgatttcttttcttgacattttaaatccaaaggattcagcctttagattgggtttttaagctctgtgaaatcaccaactgtatctagttttagtttcctttctacctaatgaaaatgaaatttactcagtttcatttttagggggaaaggcaggagagcagtagctttgagcatatcactagggatgaattcaaaatcgatttttcttgaggcagtgacttatggcagatagttgacaagagaaaaattaagttttgagcttatatctcaaatactgaa

SEQ ID NO: 124882 - DNA, 140 bp, Homo sapiens
gtagtgatattaatagctggttttcattgagcaccaattatatgccaggtatgttaataactatggctaacatttattcactgcatttattggatacactttacatgtattcctatttctcatttttccctcatagcaat

SEQ ID NO: 124883 - DNA, 592 bp, Homo sapiens
catacatccgcttggggatgaaaacaagggcagacaggctggttaactcttgaaaaggcttagattcactgcgtcctgttaggcttccaaggaatgccaaatattccccctgtcgtgagagacacaaggtaaaattgacattgttacttggaggccaaatagctctggagggctgacccacagagcctgtaacttctgggaatagtaacgagagactggcatgccttattgccccgggctgtggggtcttggaagagagctgctatgcagttcatattctgtgggtcggaggaccatccaagtggaaaggggacgatttgggtctctgctctgcctgttgcaaaagcgcaacaatcgcttttatttaaggtgtgagcggaatatttaatccatttcagccaggcatttatatcttggtacccagttgttatggctaaagtttgttttaaatccttgacttttattataactactttggttttgtcattgggcatgaaatggtagatggtttgattggatgggcttggggaaggggtaacaatagaggatagcggggaagaaacaaagcgcatttcaaagaagcctgtagagt

SEQ ID NO: 124884 - DNA, 595 bp, Homo sapiens
attttagttgttgcctaccataattacattgttgtatactgggtaaaattgtttcccttttacagattaggaagtgaaggagcaaagaagttaaattatttgtttcaagccctgggcactagcacacaatataactggtttttcagcttggatcttcttcatccaagaagactatctgaaactctgaggtcaaagcaaatgctagaatgtaagctgcatgaaggagatgttcattgtaatcatatcaccctgcatagtgccaggaatgtaataagtatttcataattattacaaaaagagatggtacaaactaatgaacatttaaattaaaaaagttcattagcttggcttatttattttattgcaacttgtttaaagatggttgctctgttttcctaagactcaagactaaagtgatataacaaatttgacaaagtagttgtaattaaaatttgttcatttctgaaaaagatgtaaaaaacaatttatctatctacctaaatatccatgttgcctaagaaatagaattcaatctttaatgcaagctgagagagaataacatcgttttcctaatttttttttgttgccagttctt

SEQ ID NO: 124885 - DNA, 487 bp, Homo sapiens
ctctaagtggagatagcagacaaccttgtttatgtggcgccagcatccattcctgttctgggtataacaccttgattttcctctaggaaaaccacctttcgtccactctcagtccacgtggcgtgggtggaaataacactcccaacactgcaagggaaagcacgtactgcaggcccggccagtgcattccatctccccggccatgtgatggttcagggataggtgtgcttcccaagctatgcctcccaaggaccctcctggaaaagtccttatctctcctcctctacaattactagtgatatgagccagggctactagggaagggaggaagacgtcatttcttcacacacaaaggaaggagtcattttaccaactttttaggttcacaattatgagcaaccttaaatgttccatggaaaaatctgcccaagatgccaggcacgatggctcatgcctataatcccagcacttccggaggctgaggtgg

SEQ ID NO: 124886 - DNA, 299 bp, Homo sapiens
aagacacggtctttctgtcacctaggccagagtgcagtggtgcaatcacagctcactgcagcctccgcctcccaggcttagatgatcctcctacctctcagcctcctgagcagctgggactacaggcatgcgccactgcacccgagtaattttttatcttttttgtagagacaggctctcaatatgttacccaggctagtcttgaactcctgtcctcaagctgaggatcctcccacctcgactgatttttgttttttgtgtttgtttgtttgtctgtttgtttgacagagtcttgctct

SEQ ID NO: 124887 - DNA, 220 bp, Homo sapiens
tatgtatgcatggagcatcttttatgtgacaggcagtgttctgggtgctggtgatataataataagacagaaacccctgcctttaaagaattggggttgaggggagagacaagcaataaacagatcctcctccaagcagaggaggagtgatgtgttctgttaagtctttaggaagatcactttgggccaggtgtggtggctcatgcctgtaatcccagca

SEQ ID NO: 124888 - DNA, 416 bp, Homo sapiens
ggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaa

SEQ ID NO: 124889 - DNA, 120 bp, Homo sapiens
ttaacaagggcttgtaagagaagaattgcagccatggaactggtgaccactggaagaaatgacagtagtgcccctaaaacatggtggtaacatccagcgatggcaaagccagttttagga

SEQ ID NO: 124890 - DNA, 230 bp, Homo sapiens
taatgagcttcggtaccgtctgagcaagctgggaacagctaaataggttgttgttgttggttaaaaaatagtagagggatgatgctaataattaggccggcctggggcaggcgggtgtaacccatctctccagtacagtgtgtgctttactcagaggagcgtgaaattttaaaaatcagaacagtcacttaaaatttcagttaggatgttgctacagttaaaccataata

SEQ ID NO: 124891 - DNA, 676 bp, Homo sapiens
tacttcgtcctttacagaaaaatgtgtttgtccccttatagcctaggatattaaagcaaaaatttcaaattcaaagtcaaataaagcccccattgtatataatctctggaatttctatctctagtatttctcccccaataactaagttgtgtattcacatatagacttatgtaaatgaatatataattacagaaatataggtatagcaaaagtaattattgctttggaaactaggagtattccaatgccatgtccttttagcacatagcaaacaggatgacctttccatcctaggaaaatatttttatgtttaacctcattgcactcaaccagacgtttccttgcacagattttcaagtgaaatatttcaatcctgcattcatcttgggggccacgtgtcttatccaagttaaatatttccagaaaataaatgtctagacaccgtctcatataaattaagcacccggtttttaaaagattcctagcagacctcctttctggtgtgtgggtgaatataattttactcctgtgaaaaatgctgggtaaaacctgatgtgcctaagtcagtgcacctgcaggtgactaatgagtgctgctccgtcattagtggacaatgcatgtgtgtacttgtgtgtgcgtgcatgtgtttgcctctgtgtgtgtgtgtgtgtgtgta

SEQ ID NO: 124892 - DNA, 380 bp, Homo sapiens
gtttaaatcaagatccacataaagtccacaagtacatgtttttctttgcaaattatttgttgaaaaaacagttctttatcttacaaagtttcttaccatttgaattttactaattggtgtagttttaataactcgtcagccctctgtatatagtcagcaagaaccccttcaagttggctcctaggtccttttaacatggtcctagaaaccagtgacagcttccttgttacctggtacgaggctcattttgttcacctcttgtcaaagagtcagaattagccatttctccaaaaagccttggctctttattgagaaaggctgcttgaaaaccataacctgggcactaagtttggttattactaaaatggtcacagtggagg

SEQ ID NO: 124893 - DNA, 222 bp, Homo sapiens
ggagtgggaataaatggagcctccagagttacttgtccccaggctccagaatgtactcactgatcctagtgaggcccaaacctgtggcctggagtggcttgtgtgaactgggttctacactggcaaaatccaatccatttgacagcagtgaaattggagtgggatggagaaggtcatcgtatcctttcatcaatcccaaagcctgttgctactggctttttt

SEQ ID NO: 124894 - DNA, 196 bp, Homo sapiens
tgggtccagaaggctccattaccctgaggaccagaggtggctcccagtgctctgagtctgtaagggagtaaccgggagggtgatggatgggcaggtacttcaaggcctgaggctgagcctgatggtccccgaagttagcaacatccttgtcctgccaaggcctcttcctgggctgagccgggggtgggcactgcca

SEQ ID NO: 124895 - DNA, 441 bp, Homo sapiens
gtgtgtgcaccatacacacacacccgaagtggtgcggactggagccctccaggctggcctcgggcttgaaggcagaaagaccatggggtttctttagttttctgggtcaggattccccatttgttgggaccacatcaagcatcaatctgacaatagctgtttccttagtgcttactgtgtcccgccactgtgatcagcacatttcacagccacagaaccaccctctggagctgttcctggttagggatggcacgaaccatctctgtgtggccaggcctgctggggctgccctaggcggtggccatgctggggctgcgcttgtggcctcctggcactgtcgtctggcctggcattctcttggggcccaggtgttcctgggtaaagcagggcctggggtcaggagctgggcttccatccgaggtgggtgccagatgctcagct

SEQ ID NO: 124896 - DNA, 413 bp, Homo sapiens
agatccattgcgggtggtcctagagtgcagcagttaaacacatgattttagaatcagtcagaactgagtttgagtcccagcctggcctcgtacaggctgtgtgactttgggcaaatgactaaacctctctgagcctctgtgtgcccagagggataatggtatttatctcagagtgctgggtaaatctccaggtacttgaaaggacttgatatatggcaagtgttatttttgaaggtataagggcagtttatcctccaaagagttggtactcagaagagcatctctttgtactgtgaagaagctgtctttagtaatcacattttagtggttattattattataaaaatttaatctaaaaatgtatagtagagacagagtctgcctatgttgacctttaggctggtcttgaaata

SEQ ID NO: 124897 - DNA, 648 bp, Homo sapiens
tagaaaatcaaaaggattcattgaaagttgagacaaaattgtgaagtaggaagatgtcttcctccgtaagaggagaaagattgttagaggaagtacatggaggctttggtgacacatccctatgaggaagtgatctgcttccacgggaaggagagaacagatgatagatgactcctagatgctcctgcgtcatgttcagtacaaaatcagagccgcatcagcaaaccggataccctgggaaggaacattgggataactccttggccataaacaaaagttttgctctggccttatgactaagtggattaatagagattagttgttcaatatccttccatctaatggatccatattgttaaaacttaagaaacaccaaagggggagagtgtgagaatctactgccattttctccattgcttcattcaagacttctgtgtccaccttggcatgggattatcatttgcccttttatactcaccttaaactacaaagatcatttgtttgcctttctgaagaaaggaaggtggataaattttgcaggagactttaaaaattcagctcaactcctggcattaaagacaataaaggtggtgattcagaggtccccatggcagtttccccaaatattacgtttaactaagatcatct

SEQ ID NO: 124898 - DNA, 666 bp, Homo sapiens
cgtggtcggcggctgctgggctccgcgccggggtccgagtcccacgaagccccggcccgagccgccggatgcccgcgcgcagcggggcccagtttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgctgggaccgccaccactccgggcccataccgcagcatctatttctcaagcccaaagggccaccttacccgactggggtggagttcttcgaccagccggcagtccccctggcccgggcatttctgggacaggtcctagtcgggcgattcctaatggcacagaactccgaggccgcatcgtggagaccgaggcatacctggggccagaggatgaagccgccactcaaggggtggcggcagacccccgaaatcgaggcatgttcatgaagcggggaccctgtacgtgtccatcatttacggcatgtacttctgcatgaacatctccaggcagggggacggggctcgcgtcttgctggagcactggagcccctggaaggtccggagaccattgcgtcggcttcgaagacacctcggaaggaccgcagccgtgtcct

SEQ ID NO: 124899 - DNA, 555 bp, Homo sapiens
aatcatagggggtcaaagcttgtcttcttgtgctgagtcagttattgggtgggagggccacaggaccagatgagccagttttgtaaggtctgggtggcaccagctggtcatcagaatacagggtctgaaaaatacttcaattcctatctttggttcaaagaaccaaaggaaaaatacttcagttcctatctataggagcaattgaggaggttaagaatcttgtgatccctgactgcatgactcctgcaccgtaatttctagtcttgtggctaatgtgttagttttacaaaggtggtctggtccccatgcaaggagggggtttgtttggggaaggggctgttacctgtttcaaagttaaactataaattccttccttagttagcttgacctgtgcccaggagtgaacaaggtagcctggaggttagaagtaagatggagttgcttaggtcagatttctttcactgccataacttcctatgtcagatttttcactgtcatgatttttgcaaaggcagtttcagtctgtctgcttctacttgtttgatccacgcttct

SEQ ID NO: 124900 - DNA, 143 bp, Homo sapiens
atgcttgggctggagggcaaagtggaattcaccagcatgcagggtggaagtacaaccctagcagacggaacagcactggcaaaggttcagaggcaagaagctttacatgtgaaaggatacatttttagaacactaaacattct

SEQ ID NO: 124901 - DNA, 1132 bp, Homo sapiens
atcagcattgtgaatagtcatttctagaaaaaatgatctcatttactagtctattgaattaaagaaggtaatgtaggatcttgaaagttggggttcttattttcaagattttttataaagttgagtatctagactgcaaaatgtgtcagtggttttagagggaagaattagcttttcattctttgcagagtctggtgagagtgcttgaatccatgtctaaaaaaagggctttgcttactaaagctttatgtagttacttaaaaaataagtgtgctcctacttctttttttcctgaatccttcaggcttatacagtttaggaaccattaatttgaatcagttatttgggcaacttacctgtaatattttcattatgtaggttacttagcatatgctatcctgtattgtcacatgttaatgcacacgtcttaattttacaactagatcataagacccagcagcagggagctagtttgattatatatttgttctctagcacctaactaaattatccttattacaccaataaatactaaaggataatggtctgtgtcaggttccacatttgacggctactgaatacgttatgaggtgattcactagctgactactaaatatgctagggctgttatacagaatacccgtagacttacatggcttcagccaacagaaaatatgggatgactttacaatatctgggaaaattggccaggttggacaaaatccaaggcaaccggcaaggtatcctctcctacgttatcttggcagaatggcacaccttgtcggcatggtgacacaaagtaagctttaacctactgcaagtaaacttcctgatttctccttaccattaaacgctcgccagttccgtaattggaattttaggagaaccccagagtactgtgatcattgtaaccactaatacactgtgtttaagagcctgtttacgaaaaataagaacataagggcaaatttgggaatcacatttgaaattttacaggtgacaaatattagaccgtctaaacagaatccctgaacaggaagaagccacggtaataatatataaaaatacagcaatgattatagaacaacacgattcgttagagattgtaaagagatgtgaccagtatagcaaa

SEQ ID NO: 124902 - DNA, 221 bp, Homo sapiens
agtgaactctagtcagaagtcagagtggtgttttgtttttaatttgaatgcctttaggcaggtgtgttctccagttcattaccatttgcgcattcccctgtgccctctagtctcctgcctggcccctggcccctgtgggaatttgcagccctgcatctggttggtgtctaccgtttctttcgatttagacaatctagagggcagtgagaaattggaaaggg

SEQ ID NO: 124903 - DNA, 114 bp, Homo sapiens
aaaggagaggctatttcaaatcttgatggaaaatcagctagagaatgtgagggaaaagagattaaaatattctaacaatagtggtataaagaaatgtctaggaattacgaactg

SEQ ID NO: 124904 - DNA, 621 bp, Homo sapiens
agaggatccccgagctctctctgtgggggacgctggatattttacttggtgtattatttctatccaggttttatttggtcatacttctaaaaagtcaggatgggaataaaaagctaatttaattggaaaaatagctcatataaagagaggtaaaatgaatagagcatttatcctatagaagagatgactaaaaggtaatatgaactttttactctttttctttttattattattctttaagttttaggggacatgtgcacatggtgcaggttagttacatacgtatacatgtgccaggctggtgtgctgcacccactaactcgtcatctagcattaggtatatctcccaaggctatcccttccccctccccacagagagagcgtcgacgctctctctgtggatctccacagtgtgatcccgaatcccctacttcacccaaactggcttaatcataatcccttacttcttttgagttcctcctatctggaactcacttcccccactctccattattcaaggtctacttcaaattcctatgtctccaccaaatacacaaagatcttccccacaaagtacacagtgatctatctctgaaatctctgagaccatcccttatatgt

SEQ ID NO: 124905 - DNA, 322 bp, Homo sapiens
cagtaggttgtcccttatctctataggacacgtaacagtttctgatgtattctcttatgaaagtgtttccagaagtcaccaatttgaacatatttttgaattctaataaaaagctttgttgttgttgtctacttaagtatttctgtatttatgttgagatcagaattatgtaacagctggatagagacatcagtaagatactctatttgaatagacctaggagcacaggtcctgggagtagataaacaagaaagactaacaccctgggagttactccagttgtgaacactgttttcactaatactattctaatagcagtttt

SEQ ID NO: 124906 - DNA, 706 bp, Homo sapiens
gcctataggcaacattgtaatatcatgggaactattgaggttttcctataaaatatcttcatcatatttcctccatggctgaaatctgaccattggagatttactgtttggggtagaacatcgattagtcccttattacagtataaatgccatgaaactcagaagttgtaagcctgtgcaacagtagagttaaatggctctgtggccaggtggcaggaaagggtgagaagatagctgaatgtactgtgggtaagtggcatatgagataatcttcgtaactgccttgggtgagcccgctgagggtcccagtggaaggtgctgagtgggcaggcaggactcaagctgctgtcttcccatagtgccttgcagttcctgccctggatttctggtgggaagtccagaaggccctgggagggaaagcagcaattaacaatatgggaagcattagaggaaatctcctccattgcctcctctcctggctcgacatgctgcctacataatacccatgtatttgccaaaggttgagccaagccagggccctttcttttcacagacttatacagctgtttcactatagagccaggctaaataaacaattctttttcatttcctgcctttctcctgaggacttggtgctgtagatgacagtttctttctttcctatagtgtcttcacagggctaaatatgggaataggcattgtgttc

SEQ ID NO: 124907 - DNA, 497 bp, Homo sapiens
gctttggcgaaatgtctatttagatcatttgcccattttaaaaattgaattatttgtttttttcttattgagttgtttgagttccttatatattctgtttagtaatcacttttcagatagatgctttgcaaatattttcttccattctgtaggttgtctcttaactttatagattgttttctttgctacgtaaaacatttttagcttgatgtaatccaacttgtctatatccaggttttattgtgtgtgcttttgaggtcttaccccatacatctttgcccacaccaatgtcctgaagtgattcctcgctgttttcttttagtaatttcatagtgtcaggtcttatttttaaatcttttatccctttatatttggtattggaatattgtgaaggatagaaatctaattttatttttctgcatatggatatctagctttcccatgtattgaagagattgttctttccccaaagtatgttcttggcacctttgtcaaaa

SEQ ID NO: 124908 - DNA, 386 bp, Homo sapiens
cactgtttgcatatgcagacaggttgtgtttcttctgtgagaattccgttcctgtgcgtggatcatgacaggcacctgtgctaatgaacttctgcccttgctcacgtcagagctgctgataaggggtgtttctatgggttgagtacgagtcattctattgacacactgttaaaaacattctttgcattctgctgttccataaaggaacaattttaggtttaatggaaatcttgcgatctcttttcctagagaagatttgtgataataatcatacacgtatttggaatgcatgtacttatgcttgtatgatcaatttccaaatgattctaaatatctgcaggcagaatttcttaagattagcattctgtgctgtacccaaaaagata

SEQ ID NO: 124909 - DNA, 206 bp, Homo sapiens
gtgccccaatccctgtgttgttcaatagtcaactgtactattttgattacaatgtaggtcaagaaattgattaatttaatgtttgcgcttcattgtaatactttctacaacagatcataactcatgtgcattttacttgggcagtgccctgaatagaaacacaactggagggccgggcgcggtggctcacgcctgtaatcccagca

SEQ ID NO: 124910 - DNA, 847 bp, Homo sapiens
gttcaactaggtttttgttttgtgatgtttgagatagggttgagacccaggttggagtgcagtggcacaatcttggctcactgcaacctccaccttctaggcccaagcggtcctcccacctcagccccccaagtagctgggaataacggcgtgcgccaccatgctcagctaattttttggtagagtggggtttctccacgttatcccggctggtctcaaactcataggctcaagtgatcctcccaccttggcttcccaatgtcctgggattacaggtgtgagctactgtgcctggcataggttgtttttaatacagaaaaatattttaaaaaccagaagcagcccataatcctagtagccttgataactcttatttaacatttaaatttaaaatgaaataatatctttgcatctttaagaaattttcaggaagaataaaaaaaatgcgaaagctttccctcatagtccctctcctcaaaggtgtctcgacagtttcttaagtacttcccaggaagtatgagaaagtgagtgtctatttttttttgaatctagataaaagaaacactatattacacaaaaatatgctatactttacttctttacttaatttaaatggaaactctccttatcagcattgtagataatcttatcctttgtaaaaactgcatggattgtttccattgattggataagtcatagcctgtttaacaagtcaatctcaggatggtttacagttttctctagtatgaaaaatgctgaccaggtgcagtgcctattatcccagcactttgggaggctgaggcgggtggattacctaggtcaggagttcgagaccagcctggccacc

SEQ ID NO: 124911 - DNA, 440 bp, Homo sapiens
ctttagtggtggctgtgccttcactggggctaggacgtttctggacccacaactgcagtgtgatgcaaagaccttcaacatgacacaagagaacatattttaaaaagagatctagacttgaaaactggtctccatgagcacagtaaagttaactggaactctcacaccacgtgtttgggaagtgggactcgctgagaaaatgttagaataattttcaaatatatgaagagttacaaagagcaatgattgcaacttcaaagaaagggagagccgggcatggtgtctcatgcccgtaatccagcactttgagatgcagaggcaggaggatggcttgagaccagttcgagaccaacctgggcaacatggtgaatcccaatctctgctaaaaaatacaaaaattagccgggtatggtggtgcatgacagtagccccagctattc

SEQ ID NO: 124912 - DNA, 733 bp, Homo sapiens
tacagatttctttcttttgttttgttttgtttttgtttttgagatggagtctcactctgccaccaggctggagtgtagtggcgcaatctcaggctcactgcaacctccgcctcctgggttcaggcaattctcctgcctcagcctcccaagtagctgggactacaggcacgcaccaccatgcccagctaatttttttttgtattttcagtagagatggggtttcaccatgttggccaggatgtctcgatctcttgacctcgtgatccacccgcctcagcctcccaaagtgctgggattacaggcctgagccaccgtgcctggccaaacctacaaatttcttattatgtaactagcattttatgtacatgtacacagatacacatatgcctagatacatagataattagaaggctcctttgttaacattcaagaatatttatctcaaatcaacaatcaatgctattcttaatggtgaatttctacagataccacatccttgtaactattaattagcattattttaaaacttttagccaggttattagccaaaataaaatatgtttatatattggaaaggagacagtgttactttgtagatggtatcttatatatagaaaaactctgaagcgaaaaccaacttaattttaggtagaaggactatgtgaaaacacagatttgacagatttttgtgtttcaacaataatcagtaattagaaaaagcaatactatttta

SEQ ID NO: 124913 - DNA, 552 bp, Homo sapiens
ctttagaggatcccgtctgagcaacctgggaatagtggggactatatcagcatttgacagatgaggaaacaatgtcggcgaaggacccaatttgtttttagtccctgaagatcagagactgctacctgggaccaaagctcaggcccctcttagtgtgttctaggccttcagggactcttgtattgtgactggactgagtaggggggtagtggggatcaggccactttttgttcaatcctggaagtgggaagggtcaggggaagaaaaggggctgcagaggagtcgaaggtctcccaaaggtgtgcctcagaaggagactctctgacccagaaagccagccattcagctttgcccccctactcctctccccagtttcctgagagctctggttactctccggctctgtgtctccagagtgcctgctgcccagttgtaagtggttagtgggcataaggatggggattccaaatctgtatcgttacacccaggggcttgccagagactaaaggtggggaatggagggcagagattgggagagttgccttctaacgg

SEQ ID NO: 124914 - DNA, 382 bp, Homo sapiens
tcctgacagaatctctaacacatcttctgagggtgggagaactgtcacagaagcaacctgcaggtgtgagatggactccagggccttggcactcatcagaagaaagcttgacctcctcacctgcatggggttggggaacaaagcaaattaagcatcagagaaagacctggcggtatgacacgattaagccataatggcaccagggcacagctgccaagcaggttgtcagaagggcagacagagtgatggagttttttgttggggtactgtcatatagttatttgatgaagccatctctctgtttttgactacattcttgctttcattggattttttcctacatcttgacccctaacctcctgcaacaggtatgggtgggagt

SEQ ID NO: 124915 - DNA, 174 bp, Homo sapiens
ctgtgtgaacccacttgcatgaggagcctagaagagacaaattcatagagacagaaagtagaacagaagttggcagggcctggcaggatggggaatacagagttattgcttgatggacacagattttctgtctggttgatgaaaaagttctggagagagattgtagtgatagtt

SEQ ID NO: 124916 - DNA, 505 bp, Homo sapiens
gtcacccaggctggagtgcagtagcagatctcagctcactgtaatctctgcccactgcaatctctgccttccgggaagagaaggtgagggttaaagaaagacacacacacacacacagaggagaaagaaagagagaggagacagagctagagagcgcgagcttgacagcaaatgcggctttatgtgcagcacaaaacctacagaagtaggggaccagcctaatgccacagcccactgctaagtcttacaggctaagggtacttataggtatgggcgggaggggtctgggcagcatggcttgttgccctgcaagatatcgataagatgttcccatgatttgtattgatttgtacaataagggttctggcccttattcaggtggatgtcatcatggtgttccttggacgtttgcccaagaagtcatgagagggaagtttcttcagataagcctctgttggccttgcggtcaagtggttaggaaggatgtttctcaccgcctaaaccc

SEQ ID NO: 124917 - DNA, 625 bp, Homo sapiens
cctagttgtttataaaccatgggaaagaatgaaatcattgaccaaatgagacagggtaacagtcttccctgggagtaaagagactagcagtctctattgacatatattttaggcctggcctccaaaataaatttacccaaagaagtgatgtatttgtgtccagggctaccgagcctaatctttggctgcctctgtgttattctaagttgtaattttccatgtcatctaaatttgtaataattctttaatatgatagtgtttcagtgaacaaacattctgcttgctgcatttcttctgagtgagtaattccctgacaactaccagatcttggcagaagcaaagttggtcataagttatgctccactctcagtgctggtgaaacgtatgatgcgtaacacagtgtttttgaattcagtgctgattttcctaaaggacatttggaaggaaaaaagaaaaggaaaggaaatacccaaattcaggaatagaacttacatattattataagacttaaaaaatacatgaacactaatgatgaactcatttcttcgaagtaaaaggccttatgctattttttcccatttccctatgtggcttgattgtggcgaaagtggctgtgtgagtttcc

SEQ ID NO: 124918 - DNA, 668 bp, Homo sapiens
tctgcctcagcctcccaaaatgctgggattgcaggtgtgaggcactacacccagctgacggaaatgtgctgcatcttgatagtcatggtggtttcctgggtgtaaccaattgtcaccactgatcagtgatacacttgaaatagatgcagtttattgttcttaacttattcctcaatgaagttgataacttaaagagaaaaggaaaaataggggtccttagcagtgtcaagggacctggctgggggcactggacgtgccaatgaggagagtcttgatgattctgagggctgcctgggtagaatttcagtgggcagaaaagtcagcattccacgcactctattcttcctttcctccttcccctcctctttcttctttttttccctgctttgcctccttcttaaattcttcttttctaatttataagacagctagaataggagggagatactgagggctctggagatttttattgtccccttgggaagaggctacgggcagaactggaggaaaaggttcgtcgtactcaggggagaatttccagtctagctgtggacactgacctttgcatgtctttcgtccctcctcccatactggaaaatgaaaggattgttgtgtttatcataacacatttttggtcattttagtttagtttgtaattagactataat

SEQ ID NO: 124919 - DNA, 449 bp, Homo sapiens
gaacaagtccagctagaggcacgcagagcatccctaggccttcccttccagttggctcgagacatagaaatgctctgtgtacatttcttccttctttggctgctgctgttcaaatgtttgaaggccaagttgacgccaggccaggaaagtgtaaggccagcccggggtgtttcatgcagatggctaacaaactctgtccaagctgtgggtaatcttagtgtctgacccagtgttgcatgcattgacaacagtccatactaacttaaacaaagttgtgcatttgagaggggcaaggaatgagactcttgacccctacaaaccaggagcaaaagtcgtcccctggctatttatgtgggggggagcccagtgggagacaggcatttgctgatggaactgagccccaatatggtcatagctaaacacagaggcctccacatctctataaagaa

SEQ ID NO: 124920 - DNA, 236 bp, Homo sapiens
tcactatgttgcttaagctggtctagaactcaagccagtctctcacttcagcctcttgagtcgttgggattacagaagccaccatgtccaactgctgatcttgaactcctgggctcaagtgatcctcccacctcggcctcccaatgtgttgggattacaggcgtgagttgcggcgcccagctgatatgtatacttttctataggtatattacacttcaataaaaagtttgaaacag

SEQ ID NO: 124921 - DNA, 258 bp, Homo sapiens
gaaacagatgatttctgcattttactggaaaaaaaagactaaaatgtacagctagtattgaattggggtaataatctgccacttttttgcccttcaatgctgtcgtgatcttttagggaagtgaggtcatggtagacccgcttgttaatcatttctgcgttttcagctcagtttggtcatgaatacttgacttgctacctatagtcttgcttctgtttgcctctttgcatgcagctccttaaattgtttaaattacca

SEQ ID NO: 124922 - DNA, 493 bp, Homo sapiens
gaccctgggaactaaagaaaaatgagcagggaacttccacccatgctcttagaaaagttctccagaaaaccatttcaggatctacttttgttatctgagatattttcctggacagctctttatgtctcccgtggcacctcctttatgaaactttttcttatcctcccttgcgtttgtgcctcccgtgtgtgtagaacacattcttaccacttacctctctcagaatcagttcattcgggtaggaacagggctgacttcaaatctaatccccaaaccttaccgtgttgctgtaagtgtgcactgtgaggctggaaagtcacaagggctgtagaatgcagtggctgtggcacaggatggggagggctaggttggctggggaacgatcgggcagggcttgaatgccaagttaagggaatctggtcagtagttcccaaatgaatttctgaatctctagggaaaaacagtaaaatacacacttccccagcctcacaca

SEQ ID NO: 124923 - DNA, 299 bp, Homo sapiens
ttaacttttatgagtttattgtcaagggagaaacttgaaaagataatcatttctcaaacagtcctcatggacttcctaaggctttcctggaaattctagggtaaagaatagaaataaaccggtagggcttggtacccttaggcccagatacaagcagagctactcctttccatttgttttccatttgaatttctgtgtgttcatttgagggaagggtcctgcactaaaaatgtttgaaaccgctgtattagaatgctctgtcacctacaacagtcttgttgttcatgtgggtagatact

SEQ ID NO: 124924 - DNA, 239 bp, Homo sapiens
aacagctccagctctgagcagccctgcctagcctgtgctgtgactcagggtataggagtggcccaaccctttcccaagtgagaaaacttaagccctcccaactccagtccctaaacctatatttctccactgctattgaattatggcaagttttagcttcagtcgtccaagtcatgaggggggagccaggaaacccaggacaactccccaagttaagaggtctgtgatgcgcatgccgg

SEQ ID NO: 124925 - DNA, 705 bp, Homo sapiens
ggtcgaggctgcagtgaactgcactccagcctgggtggcagagtaagactctgtctcttagaaaaggaaaaaaaaaaaaaacagaaataggttcaaataactaagaagtccaagggcttcaagcacaattgcacctaggagcccaggcagtgccctcagaggctggggaggcctctgttttctgtcacgttgctctgctctcagcagtggcaaaataattaagagcagctcctgccccttttccagcccctcagcaatcctagaagagcgtactcctctctcttccagctccacacaaacatcagaacagggccttgtgggatccctctggggcacttgacacccctgagccaatcaccatggactggcaagggcagtgctctgatggacaggcctggctcaaatgatcagccctgtgctggggttgaaatcagagtcctcctgaaccatatggcctggagatgggagggaagattccccagaggaaaacccaagaagaagcagggagtggacttcgggtacttcaagttttcaagagaatcccaagaaccctcccagcactttgggaggtcgagtcaggcagatggcttgaggtcaggagttcgagaccagcctggccaaaatggcaaaaccccgtctctactaagaatacaaaaattaaccaggcatggtggcacatgcctgtaatcccagctactcagtagg

SEQ ID NO: 124926 - DNA, 498 bp, Homo sapiens
gatgaaggacaggggagctgcccatcttgggggatgtgtttttacaagcaggtattccctgatggccatagaaaggatacacagagacaggcaaacagatactgggcccagtgaaggaaccacttctcggagctcattgaggaaagagagaacaatgacccctttgacaacaatgaagaagaggttgtcacctttgagctgggtgagatgttgcttatgcttttggcagatggggacgatgaactgacagactttgaaaatgagtgggacttgttccatgatgatctggaagatttttatgacttggctcagtagccaccttgcgtggcatgtgaactggcctgctgacctcagacagcagcagtcccctgtggtggtgtgacagtgcccatgtttctctcctaggcaggcctatcaactccaggtgctgtcttaataatttttacctagggcctgtcttctcaatctgtgacctttccccaaggagtgtgttatttt

SEQ ID NO: 124927 - DNA, 344 bp, Homo sapiens
ctattttatcaccacaagctgctgaaatcagcctgttgtacgctatggcaaagatttcccagccatctggaaaagggttttttgtgaggcttccctcctatattttggtttgaaatgacactgctgaagacttttttcatctgagcctcagtggttatccctctattgcttgcctagttccagtgcctgttctcttttatagtctaagacttcggtgctggactcatctaggttcatgggatgcttggcaaacttggcatattctcttcaaactcaaagaatgataaatatttgaatgccaacttgtgaatttacaattttctataaaactaccaagtaaacca

SEQ ID NO: 124928 - DNA, 507 bp, Homo sapiens
gagccgcttttgtttttgaagaataactagggacatgtgcctccagcattggccttgggtggaaacctacaccccctaaaaggaacgggctgtctcagtcctccccctccccagcctgggggtctcaacctggggtccatggatgcccaaggggccaatggatacaattcagggggcctgtgaacttgaatggaaaaaaacacacagacttattttcactaatagaaatttagcactttcttcagttatgcttggaggccaaaaaatcacacactgtcaactacacctggtcattgtcacaaaaaatcaggtttttctccttgcctaacaatttgttaaatatcaattttgctcagctctacttatgaaacttactagccttgctgccacatcttgttatttgatgtgttaataaagaagcacatgagctgggcgcggtggctcacacctgtaatcccagcactttgagaggccaatgcgggtggatcatgaggtcaggagttcgag

SEQ ID NO: 124929 - DNA, 1047 bp, Homo sapiens
gaacagtgtttgttggaacacagccagactcactcattcacctgtagttcgcggctgcttttgtgctagagcagcacagccagagcggcctggtggccacaaagcccgactgtctctgcagcactggttttttatatggcgtttctagttgtttttagtagtaggggtgatttgccacaagctgtttcatttatagctgcaagtggaaatcctttattgtgcatttgttacataagttatagctgtttctttctcaattattgtaacatctaaaaattatgtaacagttactaagtctttttttatgaaaaatttacaattagtccagaatttaaaacaagtttagtattaaatcctagggaatttctcacataactaatttggagaaataatataatactgttcaggcatggtggctcacacttataatcctaataacactttgggaggctcaacattgcttgagcctaggaggtcaagaccagcctgagcaacatagtgagacccatctctaccaaaaaaattttaaaaattagctgggtgctatgacatatgcctgtagtcccagctgtttgggaggctgaggtaggaggttggcttgaactcaagaagttgaggctgcagtgagctatgatcacaccactgtaccccagtgttggtgacagagtgagaccttttctctaaaaacaaaaagaaaaaattcagtattgtacttattctcaattttgaaataagtcaatgtcatgggagtgttgacgaaatacagtcttttctagctactggaagtgcatactaaaagccaaagtttctcattttttagaagaacaggtatacactttccacctttgttccgcagtacgtatgtttatgtttcttattctgccattatttatagtagtcgaaattcacaaaataatcttttcatttgtattttaagtaggtgtgtttatagattatatcagaaaacaatcataagctttcaggttacaatcagtagaaatactgagtggcattctcttctgtgtgaggtttaaattatggatagtc

SEQ ID NO: 124930 - DNA, 770 bp, Homo sapiens
gcaagcaaaacaatattctttcttatcatgttttcaaatagaacaaacgaccacaaatcaaggcttatataaaaaggcccaattccaatataataaatctttacctggctgtcatcctcatttaattctcagccaataggattatataacacacacacacacacacacacacacacacacacacacacgtacgtatatgtaggatatgttatatattatatataacatatcttacacatacataatataaaatatattttatgactatgagtaaaatggctaaaaattgtagtgaacagagtagttcacatgcatactttcattaatgaggaaaattgttcttatttcattctccttgtgccagtgtctttgtgtgcatgagtgggtttgtgggaggtgaagagcagagggagaaaaagagagagaagaggagggtgagagagaggaacagaagacctggctgtactcctgaataacactgagtaagtaatttcattttctttgtttcctcacataattttattctcttagtttccaaacctataaaagaaggctaataatacatattctgcccattttctacattttttggtgacaatcaaatcaatctattcatccatccatccatccattatgccatgcacttttctagacgtgaaggctgtaaagcagaaagataaagtccctgctctcctgtagcctacatactcgtggcagaaaggccattataaataaataatcaagtaaatggtatgtcagttggtgataag

SEQ ID NO: 124931 - DNA, 223 bp, Homo sapiens
  misc_feature (148)..(148): n is a, c, g, or t
  misc_feature (191)..(191): n is a, c, g, or t
agatatttgggatgagacagcatgctggtccctcagcagcatccttatcacgtcagctgtgagagaaataaaactgtgagactgtgaagtgtataaaggattctaccgctctcccggggctcggagacccacagattggagaaacccncttgccatgtgctaccttttgccatgttatgaaggggcaaganggccctaaccagatgcagcccctcgaactggg

SEQ ID NO: 124932 - DNA, 632 bp, Homo sapiens
ctgaagctaatggatgtgcagggtatacaggctcaggagccaaactaaggtgttgcctttctgttagtaaacaccaaataaagtgtttatttggcctcctcaaggcacagattggaagaggaaagaggagtcagacctcctggcacacacattctgagtgaatcacatggtcagcccaaagaaacaagaaagaagtgcaaaaaggaggaggcaggaggtgaggaaggacaaattattgctggtgacaagagaatagttggatgtatgtgggctgccaaaagtgattcctactttccagccctgcctctgtcactcctgaatatttccaacctgacaatctttgctccaccccagaactacaccagagtctccatgggtttccatctcattcctgtggtctgagaaagaacacacagctcccagaggatggggaggtgagcagctaatggtgccacctgggtcagtcaaagcctcatccactgcattgtctccctgagatgcaaaggaccaggaagagaatcttttacagtaaatgaaaattggggaatgaggagaggaaaggcagtaacaggtgccaggcactgaagctggagtgtggtgaataggataatcacaggccattcttacagaaa

SEQ ID NO: 124933 - DNA, 475 bp, Homo sapiens
caactgtgtctcaggaagggactttaagtaggaagaggaaagccatcaagaagccaggcatcccctcagtgtgcttgctgcgacgtgcactctgtgcagagtggctgtccctgcttccagaccacccagaaggcaagaaagggccagcctgagacccccagtttgtaatccccttcattcaagagaacagccaaggccgggtgtggtggctcatggctcatccaagcactttgggaggccgtggtgggaggatcatttgagcccaggaatttgagaccagcctgggcaacatagtgagaccccacctctacaaaaaatacaaaaaatttagctaagcatggtggcacatgcctgtagttccagctactcgagaggctgaggtgggaggattgcttgagcctgggaagtcagaggctgcagtgagcagtgagtgtgccaatgcactccagcctgggtgatggagcaagaccatctc

SEQ ID NO: 124934 - DNA, 528 bp, Homo sapiens
gactttatcccagggctatggaactgtaacaactttgtcctgtttctgaagaatccagtgaggagtgatggcaattcctctgattatgtctttatcctgtcatctatatctcagaggcactttttttttaatttaaaataaacaaaaagttaaagtaatccttagaggttctctgcagtccccagatattagaactcagtttctgcttcaatatcccattaactccaaactaggaaagacagcttaaagtcatttccaagggcatcaagagatactgtaggataggcttttagagtgaagcttctaacagccgtccacatcacaaaaatgacctaactagagcccaaaacagaaggaagagccttttcctctccaattttcacagtcattttgtttcttccaacagaaaagtcattctagatgctttcacttgcagcagttcctcaggttagtaactaggacccttcccatgattgacttctggcaaggaacaaatgagccccaggcaaagcacatgggtcagcaaac

SEQ ID NO: 124935 - DNA, 235 bp, Homo sapiens
gcacctcacaggaggggtctggggccatgtcccctgtttaggggaacagaaagggtctcttgcctctgcccttctgacccctctgttctcctcgtccctctgcaggacagccagagcctagacctgcagttgccatagcaacgacagagccagagagagtacaaggcagggcatccctgtggctccagagaagcagctacctcttctagacagcaaagtggggaaacagctataa

SEQ ID NO: 124936 - DNA, 391 bp, Homo sapiens
agacaggactctcacagttgtttggagcaggcagtgacccctggcatctggccattcacgggctgcctggtggtgggtgagggggctgaggccagcagcccctgtgaggtcacagcatcccctctgggaacgcagtgacgagctcttcctggtctgtccaggacgtcctggtgttagcaccaaaggtctggcagtctgggaatgcctccattcacccggggggagcggggtgggggcactgccttgtctcagcccagagctgggcacagaacgagtgcttagtagaccctggttccatgactgaatgacaaccaggtgagggaaaacagggagacaggctgtcggtgctcccccagagaaatgtgaggcctccatactcctaggcctggcc

SEQ ID NO: 124937 - DNA, 111 bp, Homo sapiens
gtcctgagaagaaaaaaattaaatcaagattagatggtcccttggaaaattgtgttgggagaaggatggaggaggctgaaatgtttaatcaaggtacatggggaagacctg

SEQ ID NO: 124938 - DNA, 480 bp, Homo sapiens
aggggtggggggtggggaacaaagcatcctcagagcccacagctcctgcttagctccctgcagtgctctgtggggtccctcctccagcactgtgatggcaagtgtgcacctgccctgcctggtctaagcagctggggctggtctgagctggtctacaccatgctcagcaggttggagtgtgtcagacctggttttcaaccaccagaactacttatatgttcaccttgagagcatgtctggcaagctctgagaagacgagctggtttctctgcctgccttgtcagggcgtttcccagggccaggtgcccactcattttcctcttactctgtgcccctaggcggcagtggtcttgtacaatctctctctgtattctcaagtccccatctgtgagcatggctcctggaaataactgcagctgtatactgacttaaagatccaaaaatcccaggaaggaccccagagctgtgagccagaagccc

SEQ ID NO: 124939 - DNA, 688 bp, Homo sapiens
attgtttctatccattgtaatacatcatgtttatattgtttcaaattcaacaaaatttgtagaggcaagataattcttctcttttttggctcctaggtgttaccagacagtgatactgaggttggtattagaatttatggaaatctcagagaactttctagagcagtattgcacaataaaatctcagccgtcagccacatgtggctatttaacttaattaagataaattcccttccttagtcatactggtcacatgtcatgtgttcagtaaccacatacagctagtggctaccatttcagacagtgcaggtttccatcattgccaggttctactagacagcattgttttaaaaagtagaaagtaggacaccattctgtagttctccaggattgactagtttcttaagcctcaggcttttgcaggagttgcttagtctagtaaatgtatagggctttgttaaatagataatgatgtaaaaagaaaataattaacatcttgaaagtatgctttgaagccttcaggagaaagtacaagtcacaggactagctattgtctaaattagtccaagagacagctaagaaagcactgtgctaattgtgtgataatctttttttgtgttgattcaaggaaacactgtagaaggttgagagagtcataaaatgtagcatgtatgtatactgttctcgc

SEQ ID NO: 124940 - DNA, 478 bp, Homo sapiens
gtctctaaattggattacattcttactgtctgtgactttggctttagcattagtggattggtaatagatattctcaatttttaaatctggcttgaccatatggcaggccatgttattttgaaacccctatttagtgtaagtctcacaagacatggaacaaaaatttttataaaattttaaactggtttgaccgggcgtggtggctcacacctgtaatcccagcactttgggaggccgagtcaggcggatcatgaggtcaggagatcgagaccaccctggctaacacggtgaaaccccttctctactaaaattacttctctacaaaaaattagctgggcgtggtgctgggcacctgtaatcccagctactcaggaggctgaggcaggagaatggcaggaacccgggagggggagcttgcagtgagccaagatcggccactgcactccagcctgggcgacacagcgagactccgtctcaa

SEQ ID NO: 124941 - DNA, 249 bp, Homo sapiens
ctggcctcccaagcttctttccatttcgtatttctttgtctcaggcacaatccctggccttggccccattttccatgccaaggcctttgttgggtggaacaggaggtaaagtgatttttccttctttttttcctaaatgttgatgaacccttctcctgttcactcattggctagtttcagctttggaggcacggaggatggatgttccatcaagggaagctagcaaagctgaggtgaggatgctggtgg

SEQ ID NO: 124942 - DNA, 469 bp, Homo sapiens
agctgatgaaacagtgcaacatgtgtgtgaaatgtaaggtgttcatgctgggccagcttgctcgccctccctgctgtgccatcttccggaaagcagcccagcctggagagcaggggctagcagccgttcttccccactctcttggcctttcagctgcctgtccgtcaggagtcaggtgcacttccctgccaggcgttcaccctgacctggggcgctcagttcaccttctcaacctcgttatctggaaagggatccagccctggatttttatggaagtccccttttcaggttgttgttggttacagatgtgatcgttgtttctgatctagaaagtctgaggaagcagaaagagaaacatgagtctggagaggccgctcaagtcgaagtcagtgaggggacacggtggagaattttcttccagtcttccccggtcatggtttgctcatagttgaaacaactcagtaactgc

SEQ ID NO: 124943 - DNA, 592 bp, Homo sapiens
tgggcagccaaagagatcagcagtcaaggtctgagctttataatatagcagttgttcaaaaacaactcatgtgtgtgacatttcccagtttttgctttgtctgccataaaaagtgttgttgttccagtgatgtttgtgtaagtgctggatgaggtaagagaagagaaaagagatggagccttctcaggggttcaaggaattcttttctggcttagcttgagatgccagtggttatgaaaaggcagttaaaatcctgtatgtgttttcttcccataatcttaattgtctcccagttttaagaccagcttttctgaaacacaaaatggcaaatccaagggactgaaatcctgcatactcttctgaaatacaaatggaataatatttgtatataaaacagttcaacataatatccataattttccctaggtgttctaaaaaaagaagctattacatcatttgataactagatttttttactacacaattaggagtatgggatccaatttcaagtttaccattactgtttttcaacgttattcaaaatgtccatattttgtttcattatttaactagatatcataatattttaagt

SEQ ID NO: 124944 - DNA, 400 bp, Homo sapiens
atttatctgtctgtgtgtctattagagtcttgctgtgtcacccaggctggagtgcagttgcgtaatcgtagctcaccgtaacattgaactgggctcgagcttcccagagtgctgggattataggtgtgagctactgcgcacagcctacaattttttgatatgtagttttgggaggcagagtctcactcttgctctggctggagtgcagtggcatgatcataactcactgcatcctcgaactcctgggctcaagtgatcctctcctgcttcagcctcagctcagtagctgggactacaggtgcctgccaccatgcctggctacattgttaaattttttgtaaagacaaggtcttgctatgtttgccaggctggttggtcttgaactcctggcttcaagtga

SEQ ID NO: 124945 - DNA, 454 bp, Homo sapiens
aacaggcaatcccagtaaagaaatgcacatttaaaaatgacttccttctgcaattccaggtcttaacttgactacaggagcccttctctgtggttactgcccaagctctaggttctgttctcaaactgtgcaaaagagctcataagctactactcccttaaacgatgtcactgcctctgccctcatctcagatcactgcaacctccatgtcctgggttcaagtgattctcccttcacagaatctttcatcgactcttgttccttcaactccctttattctcctttgcttgttccgctgcagcgaaccaggcaaaagagaaataaggagaacatcatgtaaatttcccaactgttaaaaacagtcacaggacataaaagtgatagtactctgaaagtatgaactctgaagtcctgtatatgggtcctggctcccccaacagcatgacccgaaaac

SEQ ID NO: 124946 - DNA, 469 bp, Homo sapiens
taatccaggagtctcaaaatcccgggctacggactggtactggtccagagcctattaggactgggtcacacagcaggaggtaaatgatgggtgaacaagcattactgcctgagctctacctcctgtcggatcagtggtggcattagattctcataggagcacaaaccctattgtgaactgcacatgtgaaggatgtaggtcgaatctaactaacgcctgatgactgatctgaggtagaacagtttcatctggaaaccatcccttgtctgttcccctcatccccagggaaatattgcctcccacaaaatccctggtgctagatatttttggcacttctggtaccaaaaaggttggggatcactgctctaatccattaatatgaaatgtcttgggccaggcttggtggcttgcacctgtaatcccagcacattgggaggccgcagcaggtggatcgcttgagcccaggagt

SEQ ID NO: 124947 - DNA, 257 bp, Homo sapiens
tcccagctttgcgggctggcagggctctggggccctcccctgcctcccagcccaggccgcagagcgagagcgtttccatctgtgctgcgagcgggaagagcctctctgtgctccccggcacgtccagcgcgcgggcgggaacacgctctcctgtggggggcagctttcccagggaccttgcctaacgagggccaggcggctcccccgtgggccccgaatggctcctggcaggcagacccctatccctgtcgagagca

SEQ ID NO: 124948 - DNA, 467 bp, Homo sapiens
tctcttctggttttgaaattatcattaggaataaagaactcattgctttctcctagctaaccgtctatagcataatactaaataccctttcaaaatgatgcttctatttgcatttatgttacttcattctactaattttccctatgctttcactcaaaaagctatggatacctccacactgtgtttttcggtatttctccccgtgttcttctgctgggatttgaaagtatacacttgaacttgaaataaataatagtaattcatgcaatgtaaggaaatatgctgctattatagggatagggagagagataacttaggaaagacataatttgtaacaataaaagttttgaggtatttttccttcttgggctggacttcgttagtaactatcataggaagcattggacacttcatttttaaaggtacagtagtccccccttattctccagggatatattagaagaccc

SEQ ID NO: 124949 - DNA, 349 bp, Homo sapiens
tctaagccacccaggggagtgaaagaaagattaatgaatggtttaaaaggggcctgccccacagacctgtccccttcccttttttctcttctccttccacctaaagtgttgagctgcacatccagtctgacctccactgctgagacctcacgtctatcaggtggggcctagcagggatctgggtgggaggttcagtcagatgcaaacagcagccagctgtgtagaagccacgtgcaaagcagttcctcctgcgctgacatgacagccacgcgtttcaacaacaaccacaacaaatcgcataggggatcagaagaccatgctattccattttacactaaccacttaccag

SEQ ID NO: 124950 - DNA, 263 bp, Homo sapiens
cagtgtcgtccaggccacctgcatcagatcacctggggtccactgagaatgcaggttcctgggccctactccagagtgactgagtcagtatcctggtgggggtgactcagcaccctgcatttgaaacagacttcccaggtccctgtcaccacactggtgtttgaaaattgttgtcagtagtcctcaaactgaacttgggctctgcccttgttcagctgcaggcttcttcctgaatgtgcttctttggccctaattctttatat

SEQ ID NO: 124951 - DNA, 322 bp, Homo sapiens
tctacacagaacttgagatactgagtcagcctaaaagtctctgtaatactcttggcttatatttgactccatgctttttattatacttaacaaaagccacaaagttcatttaaatatgcaaacggaaagccaattctacagatgacagaatagtggaaactacaactattcttaaattaaaactcttaacattctttgacaaatgttattaatagtgttattaataacatgcatctatcactttataatcacatagttctttcataagacaaacttctaagatggggatatacaaacaggatacattctaacaataccaaat

SEQ ID NO: 124952 - DNA, 486 bp, Homo sapiens
ggtctgtacttgtcagatcattttacgcacggcccttggctgctgtccatgcctcagtttcccagatgtgcacacaggatcatgtacagcactccctgccacatgctcttgcttaaggataggttttatatagatgtcagatcttctaatgttcaaataagagatgcaatgtacttcactttcacttgtcagaaaacaaatattctctgaacatttatgttttagattcattgtgtctgtgcttttatttagtaagagaagatgttttacatataactcctaagcctgtggtctttgcacacatacacaggaagatacactgtaaggttcttaacaaagaacaaaagaaaaacagtttcagaaaaactgggatgctgtttcactaacgcactgggttctgccactggcttttacagtaatgctatgccttgataggtttattttctcgcttggaaaagtagctgctgtgctattgtgatggatgtt

SEQ ID NO: 124953 - DNA, 323 bp, Homo sapiens
acagacacaatgaatcaaaacataaatgtacacgagaatatttgttttctgacaagtgaaagtgaagatacattgcatcttttatttagtaagagaagatgttttacatataactcctaagcctgtggtctttgcacacatacacaggaagatacactgtaaggttcttaacaaagaacaaaagaaaaacagtttcagaaaaactgggatgctgtttcactaacgcactgggttctgccactggcttttacagtaatgctatgccttgataggtttattttctcgcttggaaaagtagctgctgtgctattgtgatggatgtt

SEQ ID NO: 124954 - DNA, 397 bp, Homo sapiens
ttcccatgggaagttttaactgatggacttaaagcaagcaggcctgagctccgtggggccacactgtgactgtcgggggactctgcagtgtggctgcacagtccatgttgggtgtggtatcagtggggctgcagggaagtcaccagggggcagttgcatagggtgggtgtctggatgggccagctcgaggaatgggggatgtggaactggaaactgtcagggcgacagccctgcttctggtgggagaaagtccagcttagatccagaatggatgccgaggcagcctaaaaccatgagcgttccctgcacactctggcgtctgatctctagcttccctttcttgtgcaagcttcattggatttttaaattttcctaatttttcaattcccgggaacat

SEQ ID NO: 124955 - DNA, 315 bp, Homo sapiens
ccttgcttatgtcatacatttctcttcctcatttgttagtaaagtcaaagtcatctaaaagtgattaacattagccttcattattttattaatttcttctggaatctagtttctgaagacataacaagggattgagatctaaaatttgcaagtccttgacatgcattttcatgtcaaataatcttgttgctgaagacatgaaaggaaattagtctgagtaaaactcttgccaatctccaaagatttttactattaaatttatttcagaaatgttttaatgttactcatagagttctcaaatttaatatggaagga

SEQ ID NO: 124956 - DNA, 372 bp, Homo sapiens
gagatgaatgtaattcagacactcttgttggcatacgggagaaggtgaagaagttctctgtagtatcctgatttctgaggactttctctgaagttttgagagcatgctgtttggcactcctggtctcatttttagaactgtatttttccgcatttcaattactcttttgctctaaaacagtatttccaatgacatgaagagttgtgttagcaagtaatactaagaatttgtactacttgattataactggttgaatgagacattttcagttgtcttttctgacgtcagtttccatttcatacttgaaaaaataagttgcaatgggtcttaagacaaaaggaagaaaattgaagcaacttacaatttttgtga

SEQ ID NO: 124957 - DNA, 593 bp, Homo sapiens
gagaagaaaaagcagaatcatataaaatactcaaaccaaagaaaacagaaagggggaagggcataaaaaaagaaagaaatgcccagtgcaatgaatagaaagcagttaaaatatggtagttattaatccagctatatcaataatcactttaaatgtgaatagcctaatacaccaattaaaagacaaagattattacattagataaaataacaagactaaaatattatacatgtttctacaagaaactcactttaaacataaagacacagctgggctaagagtaaaatgatgaagaaagatatgctaacactaatcaaaataaatctgatgttagctatattaatttcagacaaagcatactttgaacaaggaaaattatcagagataaacaggagtactacataataatgaagggattaattcaccaaggggacataatctttaatgtatatgcacataacaacagagcataaaaatacatgagacaaaactgatagaactgccaggaaacataggcatatccactattataattggagacttcaacacccctcttttagcaattattagataaagcaggcaaaaaattcata

SEQ ID NO: 124958 - DNA, 201 bp, Homo sapiens
  misc_feature (186)..(186): n is a, c, g, or t
  misc_feature (196)..(196): n is a, c, g, or t
cagggcagttcctataaaccaagagagatttaagcacgattgggagcaggaaagagccagtggagactgagcttgaagacatgagaagcagaggaaatattttttcattggactttcataaggcacaagatgtctctctattttcattcttttcttttttttcatcgcccttctaatctctttccnttcattgaangtgcc

SEQ ID NO: 124959 - DNA, 136 bp, Homo sapiens
ctcataactgaattcactcacctccatctcactttattttcttgttcacagtgccacagggcagtaagcatcctttcttccaaactgtgatgtcctgtgtccttccctccacccagatcatgggaaatttggcatt

SEQ ID NO: 124960 - DNA, 404 bp, Homo sapiens
ggggtccagggaccccgcattccctcccccgccctcaggcccctgcaggtgctgagccccaggcaggtctgcagtgcacggcactgccggggggacggggcatggacacacatacccagtggcccccaactacccacaagagcagggagtgtggcagctgcaggggtcctccccaccctgcccctctgggcacctccgggtgtgcacgcatgtttgagcgtgtgtggacgtgagtgtatctgtgcatgtgtgcgagcatgtgcgtgtgtgtgcacgtgtgcatgtgtggagtctatgaatgtgtgtgtgtgagcatgtgtacacacgtgtgaatggatgcatatgggcatacgtgaatgtggactgtatggatgtgtggcatgcgggtgtgggcgtgtgtgtgt

SEQ ID NO: 124961 - DNA, 287 bp, Homo sapiens
aacacaaaagatggattccctaacctagacttcaatgggtccaggaaggattcctagaagaaatgatgactagaatgagtaggaattaaccggaataggctcaggtaatcacatgttctaagggccagaggtgtaatctcaattctttctaaacagtaaatagtagggctgacactggctttaccctgacacgttgtgaggccaaagcgggagaattgtttgagcccgggagtttcaagaccagcctgggtaacatagcaaagacccagcaaagaccccaaaagggg

SEQ ID NO: 124962 - DNA, 335 bp, Homo sapiens
agaaaacttaacactttgcatataaagattaatggtcagtattccctgagaactgggcacttttctaattaatctaggattagagatgaatacaagttttctgaaaaacagagtgttaattttggttagtctgatttatagtttataatatataatgaacaattgaatattatcaattcatcggtgagttgtggctatagctttgtcttgtgtctaggttgagactaatttgtatatatttttataatcctatgtctaatttgtgttataacagaaatttcaaactagaggctaacatagagatcatctattctacttctctcgttttccaaatg

SEQ ID NO: 124963 - DNA, 1712 bp, Homo sapiens
gggatggctccacccgcgctggctccaaaatagcgagggggcggggcccgggccgtgggagcgcctgaggggcaggagtccagtgttttagccttcgaaggaccatggtgcttccacgtcatcgtgttgtggcgctcccggctatggcagtaccgtagttttcctctcttctgcctgcggtgaccattgggctgtagggtgccccgaggcctccctggccccctcacgccggcagaatggcctcagcccgaggggccaagcagtcttcgccccgggtggggaccaccccctacacagagacgtccacggtccgcgtggagacctcgtcccaccgcgtggagacgtcgtcccggcgggtggagacctcccagcgccgcagcgaggggccctccctctccccctcggggaagcggctccctcgcatcctcgaggcgtcctcccggcacgtggaatcctcctcgcagcgcacggaaacgacctcccgccacgtcagagcctcgtccctgagggtggagacgtctctgcactgcgcggagagcccgaccccgcggccaagccggccgcccgccagaacgaaaaaacggcccgatgagatgctgcttcccaaaggccaccaaggggccagggccctcagccaggacagaaaggcctccagttgccagccagccagccagctgccaggtggaccaatcattttcggtttcatggaaacaaaccataaatcaatgtaagaaacagccaagccgcagtttctgaacacagccaacgtttactgaccgtcctgcgtcttggaccagcctacttttgacccagtgaactattttcacttgaagccagcacagaaggttttcaggcccaggatgctgtctaaatcgggttgatggacaaagagaggctgtttgagcctctgagccaggtgagtttgggatccacagccctcagaaaaccttcaccccttaggaacagagaccaaactgaaataatgacctgtggaatgattccatgcctgctaaaaactcgagggacaaggaacagactcataaattattaattggcctttgtttatgtttcaaagtaaatggtcgttttctttatgctaagtctttgtacctggcacccccatccatacacttttttaaggtaggttagatgtggttaaaaatgacagtaaacccaccagcaagcaaaaataatcttagaaagtgagaggaggtcactgaaacctggcctgaggtttgaagaagatggagaagagttatatttattgagaaccggctctgtgccaggcactagatgttcctccacttacgatggggttacctcccgttgaaactattgtaagttgaaaatatggtaatttgaaaatgcacttaatacccctaacctactaaacatcatggcttagcctagcctaccttaaacatgctcagaacacctaaagttgagcaaaatcatctaacagaaagcctgttttataataaaatgttgaatatctcatgtaatttattgcatactgtactaaaagtgaaaaagaatggttgtaagagtacttaaagtactatttctactgaatgtcacttttgtaccattgtaaagtcgaaaaatcataagtcaaaccatcttaagttgggaactgtctgtattctgggaacttgggctatagcagtaaaaaaggcaaagtcccagctctagtggagcttacactctggtga

SEQ ID NO: 124964 - DNA, 667 bp, Homo sapiens
ctggtatcagtggaggtctagtagagaacatgtacttttagtcccacctcacaataatgaggtaacaccctactacccactggagtgtggtgctagaggaagtctgctaaaacacaagaattatattgctctacatagttgccagcaaaaacaaaaaccatagtactcaaaatgtccagatttcaaaatgaaaatcatttgccttacccagaatcaggaagatctcaaactgaatgagaaaagaatatcaatagacattaacaccaagaagacacaaatgtcagaattatttgacaaagattttaaagcatctgatacagttgaggtttgtgtccccgcccaaatctcatgtccatttgtaatccacaatgttggaagaggggccttgtgggaggtgattggattctgggggcagatttccccctttccatccttgttacattgagtaagttctcacaagttctggttgtttataaaagtgtgtagcacctccccctttgctctctgttactcctgctctggccatgtaagatgtatgtccttcctcttcaccttccctcatgattccaagtttcctgaggcctccacagctacgcttcctgtatagcctgtggatctgtgagtcaattaaacctcttttctttataaattacccagtctcaggtat

SEQ ID NO: 124965 - DNA, 259 bp, Homo sapiens
taactttgctatactactgtatatatagtaatggtacaaattatacatatagtaacaatacaaactatgtattcatataatactatatatacatgactgtgtatcctgtaaatttgttatactacaaattattttcagaatgcccattttgttgactttttcaaagtagaatctttggaactttcttgatagacagtcgtgttatctgcttaaaaaaaagacagtttttattcttccttccaatctgttatatatttgt

SEQ ID NO: 124966 - DNA, 193 bp, Homo sapiens
agcaaggccagctcccagttgcagagatccaaagtgagagctcactgttggcttttgtggctggagcagccagctctgagtgtgtaaacgtccactgcccaaccctgtcatgtgtccccttgtcactcctttccccaagacactgagagctttgactccagaacaggaaaagcagggtgccaattaggaaagc

SEQ ID NO: 124967 - DNA, 477 bp, Homo sapiens
accaggtgttggcccatgcgtatctgccgtaataacagctgtagttttgatcactaggttgttactagtggaaggatctggggggctgagtggagacacctgtggctcagaggccgagctgggtcttcatggacaaggcaccacctggtggcaggacatggactcttagtttcaacacaccagggttgtattgtgttcgcgacccccgccccctgccagctttttgggggaggattgataaatcttcgtgaagtggcagaaaatatgaaagccagccaattggaatcttgcttattctgatctgttatctcaggggttagattcgcgtgctgaagtggtctacgtaacttccatagcgattgggaggtgttctctggtggggtagcagttctgtgttatgacatcacaaatggaattcacggggaggaaagctgggtataggcattaagtgcccagtagagcaggtgggaatatagg

SEQ ID NO: 124968 - DNA, 217 bp, Homo sapiens
acggtagttcttttgctgtgcagaagctctttagtttaattagatcccatttgtcaagacatttctaaccagcaacaggtccaatatcggagtgagtatgttctgatgcacagggcagcagtgtttaaggatatattctcttcatggagtaacatccaactcaaactttaatggtaacgctttaaatcttgccaagctctgaaagcaatttcttctg

SEQ ID NO: 124969 - DNA, 222 bp, Homo sapiens
ttattctgcagtctccaggaatttactaaatgtgagcagaccagtagcatggtaaaaacagtgtttcaagaggaattcaaagtactttacaatcccacaatgctcctatcaaatctctcgggtggcatataaacctagcttccccactgataaacaaaaatattctgcaaagaacataatacattttaacaagatgctgtgatggaatggaacattttattt

SEQ ID NO: 124970 - DNA, 384 bp, Homo sapiens
ggggtgactctagcggatccttcgctggccaatggcacatactctgagtatcacccttctcaaagtcatcccagggtctcccagagaagagccttctctggatctaactcctggtcttgctacaagtcctggtcaccacactgcctctctctcagctcggcaggaatagtgcctcgtggcacagtaaaaaattcatggggcagggagtccaggccctgggctctaggtggttctgccacagataagctgtgtgatcttggataagtcaccagccctctctgggccatagtgtccttgtctgtaaaatgaggggttttaaacctcttcctgcctctgcggaatctggcacactcatcaggtagggcctgccaccagccagcggag

SEQ ID NO: 124971 - DNA, 530 bp, Homo sapiens
atcttttcaggagatgaggggcagaaagggagctgtccatggggtacgctctagccagtgatgcctcagcttttttcatggcccctgagctgtccccacttgaccaggccaggacctacacggagaaggggcaaggctggctcacctgccaccaggcagtgccccactggcctcatcccacatcatcctgagcctcaaccccttctcaaagtcatcccagggtctcccagagaagagccttctctggatctaactcctggtcttgctacaagtcctggtcaccacactgcctctctctcagctcggcaggaatagtgcctcgtggcacagtaaaaaattcatggggcagggagtccaggccctgggctctaggtggttctgccacagataagctgtgtgatcttggataagtcaccagccctctctgggccatagtgtccttgtctgtaaaatgaggggttttaaacctcttcctgcctctgcggaatctggcacactcatcaggtagggcctgccaccagccagcggag

SEQ ID NO: 124972 - DNA, 217 bp, Homo sapiens
gtttattaggtaagcatgtaaactgatacagagacatctcttaaaatgttattctgagttaagtaaactgcaaaatatcttactatttatcatgcactgggcacaggggtgatgatgagaaagagaatagggcacttgtacatttgcctttgtcttatgggtcagcactagatgctactttatttcctcctaggtgttatttctggtattgttgaag

SEQ ID NO: 124973 - DNA, 264 bp, Homo sapiens
caagcataaaccttgaaagcattatgcgaagtgaaagaagccagacacaaaagactagatattatatgatcccatttatatggcacacacatgcgtatacgtatacttgcagtcccacttcttttttgtaacacaaaagcatgcttctgttcgtaagttcccctgataaattccaatgtaccaacaaactggatttgcctgccttgtcctttggtttctcagctcctttggcctttgagggactgctttgcttacaccaccctt

SEQ ID NO: 124974 - DNA, 106 bp, Homo sapiens
taagtttcaacagggttttgggttaaggttttatagcccttaacattccccaccccccttaaaaaaagtcaaccctaaagaagtattattttatattaagccatat

SEQ ID NO: 124975 - DNA, 531 bp, Homo sapiens
agtacctgggactataagcacaccccaccacatccaactaattttttattttttgtagagacggggttttgccatgttggccaggctggtcttgaactcctgacctcaggtgttccgcctgccttggcctcccaaagtgctgggattacagtcatgagccactgcgcccagccaaaaaatgtctttgatcagtcagtcccttattgagggaccttctgatggtctctggtcatttgctactgcaaacagtactgcagtggctatactgaacatatatacctttagggtaagtgggagtagttggtaggatccactcccagaggtaggactgttgtacacattctattgttttttaagagtcaaggtcttcacattctgttgtttttcaagagccaaggtcttgctctgttgcccaggctggagtgcagtggcagaatctcagcttactgcagcctcgaactcctcgctcaagcaatcgtcccacctcagcctccagagtagctgggactacaggcgtgcgccactggaccc

SEQ ID NO: 124976 - DNA, 534 bp, Homo sapiens
aagtccagtggtctggctgcttctgaggcagcctcattaaggaagatgtgtgagtgctaggattggtctggggtcagaagtccattatcggtctcagtctgtgtccctagacctactttgactttccttacactgggaagtcaggtcaaatttcaagtctctttagacaacagaaggtttctctaatccttcttgctttcaagaatcatacataatgtacacaaagtagatgagaatcttaagttgcatcgaagaattttaaattacctataattgtaagtactttgttaaatactgcttagtctccttttcttgttagctctgcatttgtgtttagttggatacaagcactagctgtgccatgctaagtgatttatacattttcttaaagtaattatgaaaattctgtcccaggaggaaaacactctaacgtccagattggcagtgcaataacttgtaatgccaatattttcttgctaatttaacatctttagccattttataatatgcatacctgcttttgtatctattttt

SEQ ID NO: 124977 - DNA, 512 bp, Homo sapiens
tgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactcctgcctgtggaaaagta

SEQ ID NO: 124978 - DNA, 218 bp, Homo sapiens
tttaagtagcaaatacagtaatcacagtagcatggagacacaggctggcctatatttggtttcacaaaggccttgtgaaagatctggccttaaagtccctttttaatgctgaaattatgcaagtggaaagttaatttgaggatcactgaggcacgctttattcatgaagaatgtgagcaaaacataaatacaaagtctggaggctctgttctacgctg

SEQ ID NO: 124979 - DNA, 351 bp, Homo sapiens
agggcaaatgtcattagattttcagatgttagaataatcctctttggcttgatgccctgccctgtgggctccgtagggtggtgatcctgccctgttacctaggaggaggcagccccacctgccggacctgtgccctctgggtttgtgttggcagtggcagccctgccttcttttgagcctcctgaagggtcgttcttcccttttcttgaaggataacttgtgttcacaactggatggttttattggccctgtcctatagaatcctggaagtccaacagccttccttaattttgtccccatctcggtcccttcagtccaagctggcagtgtttctgttgcttgtatccgctg

SEQ ID NO: 124980 - DNA, 752 bp, Homo sapiens
gaaactggccttttataagtaaatcattatgtagtttcttcctttggagggcagctctgtgtgactgcttgggcctctgtggttagatctgtttggttaacgggcttttgggctttcacacaaagctatactctccacaaacttctgtgagataaaaaggtgatatctgtcttagtcctctgaatattttttctttgttcagaacctgagaaagatgaatgaaatttagtgtttcccatccccgagagacacccagcatccacaacttcacactctgatgccattgtgtatttatgcaagaaataccataactaaggtaatgtcttgagattttttggttcaataatgtccttaaattctatgttgtttttaaagcctaaaagaaattccccctcctcactcccccgtctctccctacaacctggtgagacaattctctcattttctcctcccagtttccaatgctattgttatgatctattagaataattgctattatttttttgccttatctgaccctagaagtgatttacagggaaaaaaattactaaccaattgattagtgaactgaatataaagtgcagctcttatggtttattcacagacaagaatatatatagtacttaatgtgatagtattttgttgttgatgtggaacagtgttagtctataatacaggctttcaggcagacaagacctagtttaccttgacctctggacttctgaaaggttgagtaagttattttaagagaa

SEQ ID NO: 124981 - DNA, 302 bp, Homo sapiens
cctgccggcgagtctatagagaatcccttttggggtctttgctggcagagtagacaagcatttaaaaaaaagaatttttttttaagagacaggggtcttgctatgttgcccaggctggtcttaaacttgggacctccagtgatccttctggctagggagattctgcactggaaacaaggcccaaggatgctcaggttgctggtctaagaaccacatgtcaaacactttaaggatccccgtcttattactttacatctaatgctatgttctttgtgtgtgtgtgtgtgtgtgtgttttttttt

SEQ ID NO: 124982 - DNA, 669 bp, Homo sapiens
aaatgtaaacggtgactggatatttgcttatcttaaagaattactattcttaggtatcatcatggtagcgtgactacttaaaaaaaaaaagtcctggccgggcttggtggctcacgcatgtaatcccccagcacttggggaggccgagatgggcagatcacccgaggttagggattccagaccagcctggccaacatggtgaaaccccatctctacaaaaaatacaaaaattagccaggcatggtggctcatgcctgtaatcccagctacttgggaggctgagacaagagaatcacttgaacccaggaggcagaggttgcagtgagcagagatcgtgccattgcactccagcctgggcgacaagagtgaaactatgtctcaaaaaaaaaaaaaaaaggaaaaaaaaggtccttattttaaaagatatttcgggaaattttcctagtggaaatttgctatcgggaaaatggggtcacaggcgttttggtacaaaggaattggtgcagaatttttttggtttgcacaccactggttggaccattgaacgtgggtatatggctcgaaacatggaagtgaggagcacatgggattcttgaaaaaccactacacaccggttgggggggttttaaattttcctgtgaaaaaatgcttaacacaggtcggggccag

SEQ ID NO: 124983 - DNA, 422 bp, Homo sapiens
ccctggagagctttactgcagctgagctgaaactcagagactcagatccaagaataagaccacatttttctttttttcctttttaagtaactctgctaatcatggcaaaatcagcctcactcgtatctacctgaggctggaacatatcccagctcaggagagcgagcttttatgagccttcacccacacaaggagtgtctcattaacaattctttagtggcttactacctcccacacctgacccacatcggctctctctttaatagagccttcacccacatggagcaaaaagtctgtcttcctccttaacatcaagttaatagattgctagctcacataattgactaaccttgagcttctaactagccagacctatcagagtcccattattcctagcaaagacctccaaagggggaccgagc

SEQ ID NO: 124984 - DNA, 210 bp, Homo sapiens
gtgtcttaggcagagtaagccatttgtgtcataggagaatactgagaaagaaagatgttttttccttgtgaaaagtttaggggtggcctcaggcaaaaacttaaactatgtgaagtttatcttaattgtccttgcatggcctttttggttatttttgtcttccacttgagcgccttagaccctccccatgactccttcccagaatctccc

SEQ ID NO: 124985 - DNA, 425 bp, Homo sapiens
tagactcaaaaatcctcaacgaaaatacctgaatccagcagcatgttaaaaggattatacattatgattaagtggcacttattctaggaatgcaagggtgattcaacatatgaaaagaaatcaatgtaatatatcactttatcaaaatgaagggaaaaaacccacaatcatctcaataaatatggaaaacgcatttgataaaatgcaacacactttcataataaaaacactcaacaggctgggccggtggctcatgcctgtaatcccagcactgtaggaggccaaggtggccagatcacctgaggtcaggagttcaagaccagcctgaccaacatggtgaaacctcatctctactaaaaattcaaaaattagcagggtgaggtggcacatgcctgtaatcccagctactcaggaggctgaggcag

SEQ ID NO: 124986 - DNA, 206 bp, Homo sapiens
gcactgtttctatataagctctgtgtttatgaattttagatattatcctgccaactttttcactgcagcattcctcaaatttaggttttgtgagtctttcctttttgagttcagtttcacctaagaagaatctttgtggtatcttctggggattatgaaactattggagctacgtggggacagagctaaagatctcaccactccca

SEQ ID NO: 124987 - DNA, 321 bp, Homo sapiens
gtgaaggcaaggggagcaaaatcattgtcattaaagaatggagatggctgtcatttcatctcacgccatgggtgtccctaacagtcttcctttaaacatcctgtgtccagcttgggcaacatgttgaaaccctgtctctacaaaaatacagaaattagccaggcgtgatgacacatgcctgtagtcccagctacttgggaggctgaggtgggaggaccacttgagcctgggaggcggcgggtgcagcgagctgagatcaccccactgcactacagtctgggcgacagagtgagacccgtttcaaaaataagtaagtaaatc

SEQ ID NO: 124988 - DNA, 138 bp, Homo sapiens
aaattatagagcaagcagctctaaaagacgaaagacacacctccaaacgcttcctaaggatcagggaacagacagcaactccaacttccctaagcacttcagcctgcatcgactgagattcaccaccaattcttcgct

SEQ ID NO: 124989 - DNA, 299 bp, Homo sapiens
agaagatttcttagaaggactcatttccctggacttaccttccccagccatatttctaagtgttgttttttaacactgcagaacctggcctatgaccagcctttttggctagcttgtgcccagaagatgggatatggtttgactttggaatttattggaaagataagttttactagttttcaactgtttcttggatttttgtttttatttacttttagaaaatatcctgtggttaggtaaaagctgattaggcagaaatagtttgtatctctgatagtggtacatttttaaaaactcat

SEQ ID NO: 124990 - DNA, 210 bp, Homo sapiens
ccgagatcacgcactgcactccacgctgggtgacagagtgagactccgtctccaaaagaaaagaaaggaaaattgaatgtatttttaaaacattcccacaatgatattttaagccaagtaactcatccaaacatttaaggaaaaaaataccactccaatatgacacttccagagaataaaagtggaacaaatacttctcagctcatttca

SEQ ID NO: 124991 - DNA, 379 bp, Homo sapiens
cactccctgcgctggtggctggacatagcctccctatcccacctcatcttcccccatccccgacagaggaggttgtgaatctacaggcccttgacgttgaggcgtcggagggcgcacctttgtaattgcggcctcccttcgccccttaagtgccgcttctgggcgcctaggctggatatgaaagccccgttcctaatcctctgctctggtcccctcctctggactgctgggactctaagctaggccctccccaggttccatcactgcggcgccaacccgcggctgggctgtccgcaagagggagttgaaggcgcgcggaatcccgaggtgcagctgaccctcctctcaacgccgactctgccgctcccgcccggccacc

SEQ ID NO: 124992 - DNA, 532 bp, Homo sapiens
catgagttcatggtgggaacctggactgttgggggtcactcacttacccttttcctccactggggagccagcctctccaggttctcagccaatgctagccaagcaggcagcctcacttccccttccttttttgttttggttgtgtcctgtcacttatctgttgaattctaatgttctttcataaatgatctattcaaagtgtgatcatctattcactgtttttgttcttctctgtgtaagagacacgtagcagatgcctctagtcagccaccttgcaacccctctgccatgcagttaatacatgattttttctacttttggatggaattagataaggcccaagctaagaactccatacagcccattttgtaatatgatccagacacagagatgcactgttcagatcctcgttcaaaaaacgacccaccgcatagctgagagggatgtggtcagctgatgcctccagctgttagatccttcaggatctgtctcagttttcaaaccaaggttacgctcttctctcagtgatctc

SEQ ID NO: 124993 - DNA, 533 bp, Homo sapiens
tggtgtttggacttaatcctggggcatagggagccattaaagggttattaaacccaggcaattatgggatgagatttgtcttttagaaagattactttctgcagtgtggacaataaatttgtaggtgatgctggcagatagactatgctcaagactacaaaatcattatcagttagaagataactggcagtgttcctggaagactcacggcaggaaaggggctgtagaggaagggcactgatagaaggacctgaaggctatagactctagacaaattggttaccaatcctttaagaggactgtagggagaataaagcaaggagaagcccagagtgagttccaagaaacttgggatacataactgggtaaatagtattgctgttggcaaaaatacagaatctaaaggtgaacagcaaattctgaggaaagtatcttcaatccactaactccaggccctcatttgttctgtgaggtaggtggcatggacattattatccccattttatgactaattggtgtattagtccattctc

SEQ ID NO: 124994 - DNA, 348 bp, Homo sapiens
tttgaatgaatattcatttactcatttactgagcacctattatgtgccaagttctgtgtaagcactggctatacaaaggagaataaaacactgttctattttataccccatacatggaagtcattggaggcttctgagaagtctccagaagtcacccacaggaaatagaagtaggatgcaaaggacaccttgaggtttttagggtactgagtcatagttgttctaacagagtaatagacctgggttaaaggaacatctagatgacctgcccaagctcacaaagagcacagctctttgagccccttccaaaggaggctacatctccatcacagcactagctgcctgacc

SEQ ID NO: 124995 - DNA, 615 bp, Homo sapiens
gtctttaagtttgggttggatggaaggaaggatccagtcagaaatgagagccatcatctctcctggcctggcaaacacctttgaatctcacttcctccttataccgcgtagtcagtttgtaatacaccagaacagcccactttttcaacataaattaaaatcagcaggacaactggccttctctctcacactccagtctccaccacagataatgcctcaccctcagatgcttacacagtaactgataggaaacacatctgtggctaggtagaacaccctgggtaatgaagggatcgcagcccatctttgctgagcaaagcaatatccctttttaatagcccagcccagggtactcccacgcccctccataaggaaacttccaatctccaatttcaattcccccaaacccaaatctttgttctcttgtattatacttttcttatctttcttaggcatttattctgtctcctctggctacttttctgtgcctcctcccgcagataccagtacatttttcacaaataagcagccctcccatccccagtgtaaacctggattttttttcccctcacctattatattcttttagtcaactctcttcacctcatctcactt

SEQ ID NO: 124996 - DNA, 408 bp, Homo sapiens
ccaccttgggggatatgggcaggaacttatgtgtgttaagagaacaagattattcatagaaagcaagtgagaggttctatcagaatttgggaaggaagttatgtggagtgtgtcatccttggctaggtcattgagaaagagagagcctgttttgtcagtggcaggcactccaaaatatttgttgacagactgagtggatgggtgcatgagtgaataatccacctccccacacatctctagtgcagacctcacaggtggaaggaggataggccccactggttgccatagtccttataaggaagggatttcaaagtcctggaatagaaggagccctggagatgatcttatcaacccaatcattgcatggatgtgagaatgaggtccagagagggcccatggcatatccaa

SEQ ID NO: 124997 - DNA, 679 bp, Homo sapiens
tgtttttacccttatagcgcagtggaatgttcttattaatgatgtaatctcatttttaaagttattactagtgatatcttaggaattgattttgttatatagttcagtaatgttctagagaggtaagggaaccatagtacttcataggtaagaacccatccccatattacttagctgaagacaggcgatgtgaaggttatatagaaaagggaggagtaggatagtaaagaaggacagagcaaagaataagaacccattggaaactgaatgaaagccgcaagtgaggagggtcaggaatcatagtggtcctcattcacccactacctgtagctcctccattatagaccagtggacacatgggtacctcaggctgaatgcagacaattgcttcaaaataataagttctccttggcatgaaatgtttcatctactaagtagaagaatgaattttgtgatatacgagggtattactggcttaggacaaggctttgcttcctaattgaaggtgctttgtgggactattagcataccagttgattcctcttgtgttgcactgcaaattgctgattaactgcttttatgtatgcagagctgacatgttgcctcatttagaaacaaagtgtagtgctctaaggaactagtcagaagttcaaactgacatttagaaattgtaaaccca

SEQ ID NO: 124998 - DNA, 550 bp, Homo sapiens
ccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatcta

SEQ ID NO: 124999 - DNA, 796 bp, Homo sapiens
ccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatctaacagaaaggctcttaaatcttaatttcaacctaagaagggagtgagaaacaacgagaaccatgaggggagagttaacggggaacttccccaccgtccggtacatggcaggcattccacaaatgttttctgaaagttgaaatagacatcttttcatgaactctgtaatatttgaaattattgataactcttacacaaaaacaaatattcaataaaatgatatttaatttcactgtgaaaaaaaaaaa

SEQ ID NO: 125000 - DNA, 525 bp, Homo sapiens
ccatcagctgatgaatgaataaacaaattgtggtatctccacacggcacaatagaatattcagccataaagagaaatgagggactgatacatgctaaagcatggatgagccttgagcgcatttttgccaagtgaaagaaggcagacacaaaaggcaacgtattgcatgagtgcatttatatgaaatatccaaaataggcaaatccatggagacagaaagcagataaatggttgtaagaagctgagagaaaggagtggggagagattgctaaaaaggagtttccttctagggtgatgaaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggagcgccggtctcccaatcagcgacgt

SEQ ID NO: 125001 - DNA, 550 bp, Homo sapiens
gatctcgctcctatacattgcctaaatatttaaacatttgcctaatcgataaaatgttctggaactacttattggggatgattgcacaacatggtgaaggtactcaatgtcactaatggtaaatttcacatacactttaccataatttttaaaaagctttattagctacattatgttatgatacttaaatgtcataacaatagcattctgtacgcttcactaggataaaaacttcggatttatatgcatctggaagagaaatttttcactgtaatttgcaaataaatgaatttctaaaaatctaacagaaaggctcttaaatcttaatttcaacctaagaagggagtgagaaacaacgagaaccatgaggggagagttaacggggaacttccccaccgtccggtacatggcaggcattccacaaatgttttctgaaagttgaaatagacatcttttcatgaactctgtaatatttgaaattattgataactcttacacaaaaacaaatattcaataaaatgatatttaatttcactgtgaaaaaaaaaaa

SEQ ID NO: 125002 - DNA, 548 bp, Homo sapiens
agcaaagggaaatggcgtattggttaggtaggcagcttacaacaagctaggttagactttttctttctaaatatttaaatatttaaattatcttaatactagctttttttcttttttcttttttttgagacagagtctcactccgtcgctcaggctggagtgcaatggcatgaactcggctcactgcaacctccgcctcccgggttcaagcgattcttctgcctcagcctcctgagtaactgggattacaggtgcatgccaccatgcccagctaattcttgtatttttagtagaaacagggtttcaccatgttggccaggatggtctcgatctcatgacctcgtgatccgcctgcctcggcctcccaaagtgttggggttacaagcatgagccactgtgcccacctttttttttttttttttttttaagagacaaggtctctcactgtcacccaggctaaagtgcagtagcatagtcatggttcacagcagcctctaactcctggccataaataatcttcccaccttgagtagctgggaccacaggtg

SEQ ID NO: 125003 - DNA, 125 bp, Homo sapiens
aatgaccccaagaggattgtgaggacaaatgagacaatgcctggaaactgagcacagtgcctggtgccaagagttcaataaatgttagcttgcgttagtattccaggtgataaaacaaagtcata

SEQ ID NO: 125004 - DNA, 365 bp, Homo sapiens
tcaacgctttatacttcagacttcgggaggctgtggcaggagaatcgcttgaacccaggaggtggaggttgcagtaagccgagatcgtgccattgcactccagtctgggcaacagagcaagactccgtctccaaaaaacgaataaaaataaaaatcaaaaagaaggaaaggctgatgaggtagaggaaaaaacaaacaggaaagtatgtggtgtcacagggccaaggagaaaaaaaaagcatcccaagtagagagttgtcatttatgttgaatatgttactgggaggtttagaaagatgaggacattgagtatgatttgtctgcatagatgtcactggtggcttttacaataattgcttgtgtgg

SEQ ID NO: 125005 - DNA, 566 bp, Homo sapiens
ctaatatttgtatttttattagagataaggtttcaccatgttggtcaggctggtctcaaactcctgacctcaggtgatccacccgccttggcctcccaaagtgctgggattacaggtgtgagccaccacgcccagccagaatcacatattttctattattattattttctattcaatatagagttggccctctgtatctacaggttccacatctaaccccaggctgaaaatattaagaaaataaaacaatacaacaaaaaatacaaataaaaaaaccaatacggtataacaactttttacacagcatttacattgtgttaggtattgcaagcaatccacagatgatttaaaatatgggaggatgtgtgttagttacgtgcaaataccacaccattttatataagggacttgggcacgcttggattttggtatgggcaggggggtcctggaaccaatcccctgtggacaccaagaaacaactgtattttttcaaatggagatacaaatgaaaccacagcttcaaattttctctaccaaataaatacctttacaggtttggctaggcc

SEQ ID NO: 125006 - DNA, 447 bp, Homo sapiens
attttcagcaagagagctagctggccactagagctaccctctgcagggtttccagaaggcctgagtgtagagcagtcacacaaaatacacctgacttaacaagcctcccaataacattttcaaagtgagtgttaactgatgatacaaatgtttaaattcatgtgaagttgctacacaaattagtcaggagagataacccagcaaagcctataggctgacagagggaaatcagactgatgttaaaaattgctactggtcagcagaaaccaagctttagaagaaaatagtgtttcctctgcacaggaaggcaaaaaagaaaaaaaaaaaaaggaaaaatataataaaaagcagaggctgggcacggtggctcacgcctgtagtcccagctacttgggaggctgaggcaagagaatcgcttgaacccgggaagcagaggttgcagtgggc

SEQ ID NO: 125007 - DNA, 427 bp, Homo sapiens
agggacacaggcgcaggctcccgcgtgctcgccggctgtgttgttaaacatcttcatgcaccagccctcccggcaggcccgggcgggcagagcagcggaggagtgctcgggttcagaccgagtcagggtcagcctgctggtcctcaacgccgttccgggttagttcaggttgattttcctctctgagggcaaggccacctctaaagttgggagggacaggggcggggacgaggctcgggctgtgctgggcggttcctctgtatcttgagacgctgcatttccccgcctgctgcagctcctcccagaaccgccagcaagaaaccgagagctgagctggccaaggccatcagggccgtccactgtgggtgggagacgcagccttgccacatggaagataaacgaggccgagcaggctctctcccctccc

SEQ ID NO: 125008 - DNA, 265 bp, Homo sapiens
tggggcgagagctcctaaggagccgcagtaaggttctgagcagtgcttccacctccagcgacgcaccaagcctcctgaggagtccactgggcaggctgagggcagtggtgccatccccagtttacacacgaggaaaacaaggcccgggaaatcaagtgtgacttgctcaagaccaccccgtgggatggtgacagagccaagaccactgcacaggcgccttacccgcaggagcgctctgctcgccacacccagctctctcccttct

SEQ ID NO: 125009 - DNA, 1045 bp, Homo sapiens
tgcagagactgaattcgttttatttctgaacagttcagcaggggctaatttgctaaattgatacgtgaatgttttctaccaagaagctatataatttaaaggggaaaaatattcataatacttaaaatagaattgtttaattgcgacatttcagtatcccagtattatatcagaaccacaagtaatcaactctgacaatattgtacacaacagtttctaaaatttagaccctcattctttcctgtgcttgtaaacttagcaagaatggagattacaccttatattccaattctggctactatccacatttaacattcttcttagtatcagtcttcgaatcctggggataaataagcacagcttgcttttaggctgaattttcagagcgccatttattatttaaagcactaaaaatgcctgatttatgcatgataatgtaaatttctttctttcttataatatattttaaaacaatttttggaagacacgaggtctcaccactcctgttcacccaggtttggaattgacatgggtaacgcgtcggcgggattcaaatgacaggcttacgatattcccaggctcatagctgatatctcccacctaagacgctcccagttggtggaacactaacagggcatgaaacaaccattgccaagctaatttgattaatagttaaagaaaaagggagccacacatgttgtgccccagacgttggtcttataaaaactatggggacccatctgtagttagtcaacccaaactatatggtcaccacaaaaggggcgagcaacatataaggggggagtagacaaactaaaaccccggtggcctataaattatctcatataaagtggggtggagaattttatattaccacacgatcgtagtgcacaataatataggtggacaaggaggaagagtatattagcagaatatctgaaaattctagtaaagatatttaccaggtgtaacaaaatattccatttggctcaatattatatataaacaagagttcataacaatagtgacagcactatgtatatag

SEQ ID NO: 125010 - DNA, 455 bp, Homo sapiens
atggttgggcctgcctcatgaggtcgttgggaagatcaaatgagataagcaaggaaaaacctgtgtgtagcaccttgcctgctgttcagtgggtgctgagtatacttgttattcctataattattacaactccagctctctctagccctggtggtccacaatgtgagttctagacccttccttgtgcatgttctctctgtctctttctctcagcttccacagctccatccaaatcttgtaggtactttggtgtgagcactgcaggactgggagcgggtaaccgcctgagcactcttgaaaaccaatctcccacccctcccaagttcctgagcctcatcgcgatgacatcaagacagaactaaagcatacttagtcctacttcatgctatgagaaacagaccatgggaacctcatattctgagccaaaagtcacgtcacattcacaagaaaaatct

SEQ ID NO: 125011 - DNA, 347 bp, Homo sapiens
tttctagcctgtcctcagctggcataagtcaaaaaggagatttttttattgactctggcgattgaaaagctgtggtaggactggtttcgggacaaagatctgataatgaatgtgccttatagggaattcctgtagggtcacgtgactgctttagattgcaggtcaggaaaggcctctgaagtggtggtgatgaagctgaagctggaatgagagggacctgagaggggaggagtgttggcaggcagagagcaggttctagggctggactgagcgagatatatggaggaacaggaaggaggtcatggtggcaaagtcgggggaaccatggtgtacagtctggggtgatt

SEQ ID NO: 125012 - DNA, 405 bp, Homo sapiens
tcatagctgactctagaggataaaactaatgtcctgacccacgctactgagggccctccatatggcgggtgttttgggaagtaggtactaatttaagacagcttttggtctgaagttgcatatagtatggctggggagccagacaaggaaacccgttaagtgctatgtagtgttaagaagtgcactgaatccaaccaagagagtcaaggaaggcttcttggagcagggatggcttttccccaacctttcctattattctgcagagtctgcctttagtgagtgacttgctttttataaaaacttgaaaaaaaattctgtcatgggttcttttccccttttattcattcactgtcatgacagttcccacacagtatgccccagttatggcttctgcattctcaaaaa

SEQ ID NO: 125013 - DNA, 769 bp, Homo sapiens
gatcctcggagaaatcaagtcagtcccttcccactgcttctcctcaatgcatttggttatctgtggctctcacctctcaaactcacaatcaccataaaggtgattggcaaaaaaatgaataagtatcacaatatatgcttactagatgtttggaacagcctcagatttatcttcttggtgtttctgaggccttaggccacacagtgattgttttcttttaggaagtgttcaaaaccttgtaatgagtcagtttggttcaaactgccgggaacacagggcagttcaccgtccctgcatgaagaggccttaggatgcacagatctgaagactgggcttggctcttgtctctgcagttgatggtgactctgcagccctgacccctttacttccttctatttttttctttcatcttggaactcctaacagttcttgctgccttcatcccacctggtgtaggtaatgagtatcaaatgtccgcatcttctcagaaaaaagtactgtgaatgtgaggtgtgattttaaggcattgttatatttcttcttatttgtgagtgttttaaaattttgtatttcttttaaactttttattttagaaaaatttccaacatatatagaagtagactattgtaaggaacccttatgtaccctccaccagcttcaacaactatcaacaaaagtttgatcttgttttaaccacattcctttccaatttttgtgtttacccccagattattttgaagcaaattcctgacctcataacattttcaaa

SEQ ID NO: 125014 - DNA, 174 bp, Homo sapiens
cctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtatacccc

SEQ ID NO: 125015 - DNA, 325 bp, Homo sapiens
tggggctagggagtgttatctgaactcaggctttctaaggtgacctgacttgtcccagctggggtgtcttctctgtgggtcattcagctttggtttctcagggcttggagaaggacagaagctcagagccctcacacaacactggagtgaatgtggctctgactaaccccatctggctagaccagggtcagggagacagcttgggagaccccactcttaaaccaggagaagagacaggaggccaggggatgagtggaccatatggccatggccacccacaaacactcgcagtgcacccacgcttacatgctcagcatacacacat

SEQ ID NO: 125016 - DNA, 289 bp, Homo sapiens
tctgagatgtggcacatgctcaatatacatgtattaagtaagttaataaatgttatcaacaagtagctgtataatttggggcaattcatcgtctctggaggagctcgcctttcttcagccctaacgtggtgatttggttaaacctgtggttttcatactggctcacccctaccccattctcatcttgggccctttctgcaatccctgccgtattagtccattttcacgctgctgataaagacatacccgagactgggaagaaaaagaggtttaatggacttacagttcc

SEQ ID NO: 125017 - DNA, 394 bp, Homo sapiens
tacgagtgtgtgtgcatgtgtgtgctagtgtgtctgtgtgcatgcatatgcatgtgcaagtgtgggtgtggtctgtgtgcatgtgtgtgagtgtggtctatgtgcatatgtgtgtgcgtgtgtgcatgtgtgtgtgtctgtgtgcatatgcgaatgtgtgtgtgtggcctgtgtgcatttgtgtgcatgtatgtgtggtctgtgtggatgtgtgtgagtttgtgtgtgcatgtgtgtgtgtctgtgtgcatgtgtgcctctgaatgtgtgtggtctatgtgtatgtgtgtctgtgtgcgtgtgtgaatgtatgtgtgcatgagtgtgagtctgtgtgcatgtgtatgtgggaatgtggtctgtgtgagtgtgtgtgtgtgggggggaatgtggt

SEQ ID NO: 125018 - DNA, 591 bp, Homo sapiens
atggcacgtgcctgtagtcccagctactcaggaggctgaggcaggaggatcgcttgagcctgggaggtcaaggctgcagtgagccatgattgcaccactgtactcctgcctgggctacagagactggtctcaaaataaataaataaataaataaagatacaaagaactgcagattcattatgatggtcacttgtcaaataaggctgtgaatatataatgcccctaagaggaaatctgaatgttcactgaagtaggaaaaagtgcacaatttcagttaaaaaataatgtaatgcaatttcacactcatattgacccagaagtggggagggaaaatggctaacaacaaatactaaatattgaagaggaacaagagtgatggcaactcatacactgcctgtgtactttggagagtgtatcagtttgctgtataacaaactattccaaaatgcagtggcttaaaatagtacttattactccttacaagccaaggtcaacttctggtgtcagctggactattcagatgtctgcagctagctctgagttgagtaggcaactctgctgatcttggctatgctctcacacagtttggag

SEQ ID NO: 125019 - DNA, 228 bp, Homo sapiens
aaagatttctttctttatttacataaaggggacaggggtcagtctgtgtattggaagatgtgcccatatttggtcacatattggaagagtacaaaattgcccaaataagggatatttattgccttcctgactgcagactcaaggaggcaggaactttgacattttctccaatgcctatctgtatccacattgcctgtaacatagtatatgctcaataaatattgattg

SEQ ID NO: 125020 - DNA, 171 bp, Homo sapiens
gaagggagaggtaaagaagaaaatagaataagctaattgatcactgtctaggcaataagtggctgttaaaggataccaataagaactagttaaccagatagtaaaggcttgaataataaaacagaggactaaggacattaaaatggtataagaaaaaagaagactactagc

SEQ ID NO: 125021 - DNA, 190 bp, Homo sapiens
ggcccccacaggtatgtaccctcaagcacctttgcacttccattccttaggggtgtgtatcagaaccccctactccacgggtgagattatgagacacttctgtgcctgtctgctgttgtgcccaggcagtcatttcttcttctctttggttttgcttacatttgtaccatttataataatttattattat

SEQ ID NO: 125022 - DNA, 710 bp, Homo sapiens
agcacagtacgccctgcccgggaggtcccatcgcagtacctgtggatgtgagttaataaggtcagcttaattcacatcactccttttgatatattttaacacagttgaaaacactgtctatgcatacagaagtatgtgtgtttgtgtataaacacatatggatggttgataaatttgagaaagaaatgggttgtgtacacgtggcccacagtttcagtactggctgcttccacaactaaaatgtacacatgaattgataatgctctgtgttttctccgttgatcttattctttctaaattattgtcctaacttcttatttttttttctttttttaaaaaaaggaatggactcttactgaaatggtgtttgatcagagaaagtgggttatataaactaaaattgtgtaatttctgaagtgtataaaattaagccaggcaggtggtacgtgcctgtggtcccagctactcagaggctgaaagaggaggatcacttgagccaaggagttcaagtccagcctggacaacataatgtgacccatctctaaataaattgattgatcagatagataaccagacagacagacctacttctcaaatacagaaaatcacatatgatgactgagtcactgttccctctgtaaggaagatggcaccatctccgtgtgttgccttgcagtggggccaccgcagtgaaaacacagacttcttac

SEQ ID NO: 125023 - DNA, 469 bp, Homo sapiens
ctgatttctagtaatagtttaattctgttgtggtatgagagcatactttgtattatctatcccttaaaatttttaaaggtgtattttaaggctcaggatatggtctaccttggtgaatgttctttgtgagtttgagaagagtatgtattgtgctgttgttggatgaaatatactataatgtcagatccatttgattgttgatgctgttcagctcgactatgttattggatttctacttgctgggtgtgtcagctacctataaagaggtgtgaggtctcccagtataatagtggatttgtctgttactctttggagttcaatttttgcttcacatattttggtgtaatgcaactcttaatctttgttctgaagtggtttttatgtttccttattttgaaaactgctttgtctgtaattaacatagctactctagctttcttttgattagtgttggcatggtatgtttttc

SEQ ID NO: 125024 - DNA, 445 bp, Homo sapiens
ccccatctctacaaaaagtacaaaaattagccaggcatggtggcacacacctgtagtcccagctactcgggaggctgaggtgggaggattgcttgagcctaggtggtcaaggctgcagtgaatcaagatcgtgtcactgtacttcaacctgggtgacagaatgagaccctgtctcaaaaaaagaaaaaagaaaatttacctaataactacttctgtcatgttgagcattctttgttaacaagttgaggatggggttttttgcatcattaattggatatttaaagataggttgtgggaagggtgtgtgggacaagtgggtattttactaatgaaaggttgtaactggcatcttaaagttgagaggtgctttataataattgcagatttcttggcaaaatagtgtaatgcttgatttgttaataggtataaagcaatccagtcattt

SEQ ID NO: 125025 - DNA, 417 bp, Homo sapiens
cttgatgggaacatggaagattccagtaatacaatgtttgctttatcattgttactatttataatagaaccaattaatcaggataaggtccttttgtctgtctggaatgttcttgtccccaggttgcatgtccttagaacgatctttcctgacccctatctgtcacttcataaggcaacatcactcaccttgcttgagtgtttccatggcacttagggcaacttatagaaccttaaattacaggacacacccctctctttgtttattgattgtctgctgctggaacataaacttctgggcagggacatgactgtctctccagtatcctatccttacccttagcagaatgctgtccagccattggcagccagtagcttctcatttcatatgttcattgacagatgactgtattttcat

SEQ ID NO: 125026 - DNA, 691 bp, Homo sapiens
gagtcagtagttatcacagaggttagttgtgctacaacaagatttcagaaatcctttgataggctgacagtgaacttgttccttgcccacagacatttctcttctcttaccttttttccagactgactacacaactgtttgtctgataataataataaatttagaacttaaacatttcattattaaatcaaaatgtaggcctaatggcagtcctaatgtttgctctcttgtccttcagtctggcactccttccccagttttcatttgtgaaaaatcagaaggtggtaggtatttgcttgagcaaaggaactcttctttgtttaggtaaatagctttgccaattgaagcccttagggtttcaaaatcattttgctttttaggatagactgtcatttacagacacttgtaactgacctaaaattttgatttgcattatttgtaattatttcatcaactcaaaactatgaacactgcatgggttttttttctattaatattcatatgaaaagaatatactatagtagtcttttcacagtatgtttcagtcaattctctgctaaggtctattttttatgcctatttttaaatgtctcttttaaagtttctcttcagcctttcatttttttttactgacctacttgacatttggaatgtacctgcattggcaggaagtccctactatttaagaaaa

SEQ ID NO: 125027 - DNA, 629 bp, Homo sapiens
gtggctctgtagaatgcccccttagcagataatataggcatgttaaacaccatgatggacaccttatcaaaattgcaaaaaaacccaaaaaacaaaaaacaaacttaatctaacatgttacagaaagaaggaacaatagcaagagttaagtttgaaagagttagtacattattctctgggttccatatctttttctgcatcagtcacaggcaccagtaagtgacagttggaagatccttgctttgaactcacacaaacccagctctatcttatttctttgttcaaaaagagttaagcagatgtgatttctccctttgttgaacttgcagtttagcagggaagtcatatataaaatattaattatgcaaataactatttaagtgggcttgtactagatactttaaagaagaatacagatgcatatgagagaagacctaacccggcccacctatagaagtacacctaagccaaaactttgagagaggtttgccatgtataggcagggcagagtggctcatgcctgtaatcccagcactttgggaggccgaggctggcagatcatttgaggtcaggagtttgagacaaacttggtcaacatagtgaaatcccatctctactaaaaatacaaa

SEQ ID NO: 125028 - DNA, 566 bp, Homo sapiens
  misc_feature (462)..(462): n is a, c, g, or t
  misc_feature (464)..(464): n is a, c, g, or t
aaagtgatagatgggtatggaacaagactttcagtgaatcagctctggacaggagtaaagggaaataaactctggaactttcgaggaaaaaagtctctgggactctcaaggaataaaatgccaaccaccagaaactacagaacaggctttgggataatctaatggtgctcaccacaaggctgggattcaacctccattaaagggtgacagtgccttttaactcaatacaaccactttaaattgagggacacttcaggtgaaagaccagcttaaatctttatgcccccctcattcaagaaatattcattgagagcctgctgtgtgccaggtactggaaatagacaatgggaggacaaggcacccggaccctgttatctagtggggaaggcagctaagaaacaagataagcacatacataagggtcatttcttttttcttttttttttttttttgggaaaaagntncccgtttggtggccccccagggggttccctaaaaagcaacccgggggctttgaagttgggcacgggccggcggttaaacaagctcgggagggaccccggggg

SEQ ID NO: 125029 - DNA, 177 bp, Homo sapiens
cagagcctggattgaactcagcatccagggccaagggggaagcactggcttggccattgatgctcagttcctccttcttgctggtcctgcctttggggaagtttacaaaaactgctgaacacatcatttgcccaaaccccacaacagacaggagggttgccgctgggtgctgtgtca

SEQ ID NO: 125030 - DNA, 440 bp, Homo sapiens
tttttttctttcccttactgtagagaatgctgggtaagttcttttggctttgcttctatagccctgtgcacttctttcagcaggctttatattgggctgtacagtttgtcctataagcctatagatggcacttatatgtaacagttagctatagccaaggaggctaggtatatacttaatccttgtttactatcagctctctgttgcctcaggcattgggctgattggtagactgcgcagagatctgagatccctgcttagccctggtgggatgggagccatgaatggtggggccagactgggcaattccacctgctggtcccctgatggcagacacaagcaccagtgccaggggaaagtccagtgggtggccagcaggcctccagaggtttgcctgggcatggagctaggaaacctctttggctccaaatactctctgc

SEQ ID NO: 125031 - DNA, 168 bp, Homo sapiens
ggtgggcaacaacactgatcttgagtagggaatcttgagtccctccagagaaaggcaactctctggctccaggcccctcagactggttgaaaccagtctgacatttgcacaagcatcaaagtgtaactcagaccacagagacaatccaaacctgtggtgctcaacaat

SEQ ID NO: 125032 - DNA, 808 bp, Homo sapiens
  misc_feature (808)..(808): n is a, c, g, or t
ggaacacttctcattttatgaggatactgtgatcttggtaccaagattgaacaacaatagtgtaagaaaagagtattatagagtatagcctgggtaacgtagcaagactctatctctaccaaaaatttaaaaattagttgggcaaggtggtgcactcttgtaatcccagctactcaggaggctgaggtgggaggactgcttgattccaggagttcaaggtcacagtgagttatgattgtcactgcactccagcctgggcaacagaacaagaacttgtctcaaaaaaaaaaaaaaaaaaaaaaaagaacagagagaaagaaagacagaaaacacaattatttttgctgcgcacctcctccgttaaaaaaccgaggagaggaatataactctcctccaataaaatattatctccagcaacattacttcgcagaaattttcgccaaggcgataatttttatttagccccaagggtaaggggttttacttcccaggagaagtccagagggtgggtgttaaccttttttccaagaaacccatatttcttcccccatctattcatctcgcagatataaggggggaaaaagacgccttttagaggggggcggtgaacccttctcccaaaaaaggctccccgcgaaaaagtttttttcaagcccgccagttcttcataggatcgatgtttttagaaaaaggcgcctcttatataacttccaaaacttgggaacgcaagatacttttctcaacgtcgcgtgggctttaaacccgttgccggtcacacacattgtgggcgtcaccgtttatacacaan

SEQ ID NO: 125033 - DNA, 249 bp, Homo sapiens
catggatgcagaggagcccatggatgcagggggccaactatactatttcaggtagtttacaagtgaaataggcttttggaggttgacatagaaatctataacattattcctgtggggaagtatatttccaatttcaaacaagtaatttgttaagtaaactttcagaactaaagtttgtcgtggctatttttagaattttgctactggaagggtgctttgtcattataacctgtaaatgaattgaatcta

SEQ ID NO: 125034 - DNA, 425 bp, Homo sapiens
ctaggtttttagattaaactattgggtgaatgggtgctgcaattaatgatatatataaatagatttggggggaaattaaagctgctttttgcatcatataagtttcagacagctataaggcattcccattgagatgtcaaatagtagagtctatgcatatggagctcaagaatttgtcagtttacattttgctttaaagttgaggattgaatgagataacctagtgtatactagaagaggagaaggccaaaggctgaactctgttgcattcccaatatttagatatcagattccacagaaggaatcagcaaaagaagacagaagcaaaatagaaagataaatggaaacgtaatagccaaactgagatggtagtgtttttgctgctaaggtatagatgagcagaagtattcactgcatttaacatt

SEQ ID NO: 125035 - DNA, 380 bp, Homo sapiens
cccactgactcatttttaaagacttaattcaagcctcaacctctttcgtgaaatctttcacgaggcttcccccacctctcccactctgatctaatgcccagggagactgaccacttcttcttgtgtggtcctttagatagcatgtcactgtaagtcatttgctcatgggtttacattcccctttaaacctatgagctcctgggtgggagggaccatgtcttattcattccatcctcccactgccaggtggagtgccaagtataaagtaagggatcaataaatgttggatcaaacttctaaaatccacttacagtgacactccataatactgtggctccttctgtctccaggaccctaggacccaggatgctccaacatac

SEQ ID NO: 125036 - DNA, 348 bp, Homo sapiens
caggctcttgcccatccttcagatcccagcttaatatcactcctaatcaaaagtaggtaccctgttattctttcgtagcaccctttttcctccattgcatttatcacaatttacaatttgatacaaataattttatatttaacatctatgcccccactagactgtaagctgcacaagagcagggggacgacttttttccaccttgcaaactcagaatctggcacagtcgttttcaatacattgactgatacactaaaaataattagcaggatgggtgtggtggctcacgcctgtaatcccagcactttgggaggccgaggcaggcggatcgcctgaggtcaggagttc

SEQ ID NO: 125037 - DNA, 283 bp, Homo sapiens
aaatacctccctgggctcaagacgcccacccgcacacccttcactgaacaccacaaagtgccgcatcctataccacctagcactgaacttggcctgctgtgatgctcttcctgcttcgtgtaagcctgcattctgaatgacgaaatgactctccctgagcccagtggccgtgcggatttctgccatggtctggatatttgaggccccctccgaattcatgtgttgaaatggaagccccagtgtgagggtgttaggagctggggcctttgggaggtaatgaggt

SEQ ID NO: 125038 - DNA, 768 bp, Homo sapiens
agccagttctactcagaataggcagctgctttcattatgtggttttgtctctgaacatgttttgtccatctttccatccccactgctaccacccaaggccagatcttaataatctgtctctggcagcgttttaattatcaactcacttgccactccatgtccagtctttaccctgaaatataaccttttctctctccatagcttttaagacacagatcttattcctgtgacttccttgctcatgaaacctctaaaatctaatcttcttagaatgatatttgaggttctgcaaagacttttgcccttttctttccagtcctttctccaatcgtctcctcataccctgttccatgggggttcatactagtgggtaggaatattagagaaaccatctttgggacagtatgaaggttaggaaggattctttgttgtggggccatgttaagatttaatttgataaaactttgtgctcggcacagaagtaagtcttaggaataaggagtagccaaacacatggttaaggcttttggagcctgtagttgatgaagaaggacaggaaggtaaagtaagtaggctagagcgataatcactctgaatggaaacctggagagagtgctttaggagcttggaggggaccactacctgagagatgaaggaatacctcccagaagaggtaatatttgagttggacttcaaagatgaggcatttggtaattatgaaggggagactgtaacttccaagcagaaagaccagtgaggacagaggca

SEQ ID NO: 125039 - DNA, 206 bp, Homo sapiens
gttgggcaggcaaccagggcaaacaccaggagcttgtgtgaacacccagattccttctgctgtgttactccgtcatcctggagtgttgtccttgtcttcatggctgaagctacctcaccatccatgtgagcccacattccagcccaaggcaaggaggacagaggaagggaggacatgcagcttcctcataccaactgtcatcagga

SEQ ID NO: 125040 - DNA, 786 bp, Homo sapiens
gtaggtggatcacttgagcctaggagtttaagaccagcctgggcaacatggtgaaaccctgtctctacaaaaaaaattaaaaattagccaggcatggcagcatgcatctgtggttccagctacttgggactctgaggagggaggattgcttgagcccaggaggttgaggctgcagtgagccatgattgtgccactgcattccagcctgggtgacagagcaagaacttgtctcaaaaaaagaaaaaaaaaaattctagaacctcagaagcctagatccacataaacttagaaacatccaattcaagaatttactggaacaatcaaattctagaatcttagaagcctagagctaaagaagcatagaaacatcaaattctagaatcttgtatgtatagaatcctagaaccttggaatctgcagattctggaggtagagaagcctagaattgtagaaccctagaactgtcaaattttagagtttagatatataacaccctaaaatcttggacattaaagagtcttagaagtgttgactcatagatgtctagagttctagaaacttggacatcaaactctgaagccttagaaatacggaatcaggtcaggggcagtagctcacacctgtaatcccagcactttgggaggcttaggtgggtggattgcttgagcccaggagttcaagaccagcttgtacaacatggaaagaccccatctctacaaaaaatacgaaaaattagccaggcatggtagtgcgtgcctgtagtttcagctactcaggaggctgagg

SEQ ID NO: 125041 - DNA, 314 bp, Homo sapiens
cagcaaggcttctaacagctttgacctccaaggcttctcctggctttactggaagttatcttactttgagctcccttccttccacttaaggaattgtaaataacttcttggagggctatttgatttttgtttttgaagacaagatctggccctgttgtccaggctggagtgcagtggcacgaacatggctcactgcaacctcgacctcctgggcccaagtgacccttctgcctcagtctcccgtttagctgggaccataagcgcttgccaccacatccagctaacttttttatttttagtagacatgaggcccc

SEQ ID NO: 125042 - DNA, 437 bp, Homo sapiens
ggtgggtggaagaaaagcaaagggagtacatttgtaatggtgtctctattttattggttaaatagatggttagattctctgctctgagttgatgggtaggggagggattttgaagtagctggaaaggttctagatttttatggtagatgtaccttgatagagaacttaactggctctagaccagcagtctaatgatgttcagtaactccaatagctattattgtttagggttgttatagcttattgaacaaggtttgtaactaaccagtatagaagtgaatatagaacatgagcagatagctcacattagaagtgatatatgtagtaaagacttaagggacaggaagaggaagaaaaaggagccagtaaagaagactgagaaggaaccaccatcagaggtagaaggaacactaaagtagaggttctagaagctggcg

SEQ ID NO: 125043 - DNA, 720 bp, Homo sapiens
attcctttttatggctaaataatattttatcatatgtatataacattttatctattcatctgtagatggacattagggttgttcccaccttttgactgttgggaatagtacttcaatacacactagcatgtgagtacctgtttgagcctctgttttcaattattttggttatttacgtagaagtgacttgctgagtcatgtggtaattccatatgtagctttctgaggaacttccaaaccattttccatgacagctacccccttttacatttctaccagcaatatacgagggttccaatttctctacaccctcaccaacacttgtcgttttctgctattttgattatagccatcctaaagggtatggagtaatagctccttggggttgacctactcaaaatgtttaaattgataagaaagctattcataaatgccttctattaaaatgtagaagacaaaattgatggctcccacctgtaatcccagcactttgggaggccgaggtgggaggatcactagagctcgggagtacaaggacagcctatgcaacatggtgaaacctccatctctacaaaaaatccaaaaattagccaggtgtggtggtgtgtgcctgtggtcctagctacttgggaggctgaggtaggagaatcgcttgagcctgttatgtagaggttgcagtgagccaaaattgcaccactgcactccagcctgggtgacaga

SEQ ID NO: 125044 - DNA, 366 bp, Homo sapiens
gcgcagagaggagtgtaaactctagcggggctagagcaaacattggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaatt

SEQ ID NO: 125045 - DNA, 399 bp, Homo sapiens
gccggaccaggacagtcttaccactttcacctttctaatgtgccttttgagagaccgtccacctctctcctttcaactaccaaacttctggaaagaataaattttgattatatttttcaccatccatttattccctcaaatttgcttttgcttccaacattcaacttaaagccatttacttaagcgtcaccaatgttctttcctctgtcctcctcttctctgacctgagagaattgattattaactattaaaccttccttcttggaacttcttcttcccttggcttctgagacattttcaatttacccttctctgattgctcgttgtctattctattcttttcttttcttttcttttcttttcttttctttttcttaagactggtcctggggatcctct

SEQ ID NO: 125046 - DNA, 420 bp, Homo sapiens
gtgaagggttgagaccagaacccaggtcccttgactcataatccagtgttccttccactataacttcctcttgagcctttcatggcatgaaagacaaccaaggtgaggtatctcatacatttcagcagtaaaagttcgtagcagagttatgggaggggtaagagttgtggagaaggggtgataaacgctgttactcccaagtaagtttggatatgaagccaacctagaacatgggaaactggtattcctcaagcaagtcatctaaccatcatgtcaacttcatgcacattctacggactgcgtgtacattggtgcacatggaggaacagcatgcatctcacagcagaagacctggtttcctttttccctattttagctgtgggggtgggtaggtgggagtctaaggcaacacaatcctcc

SEQ ID NO: 125047 - DNA, 730 bp, Homo sapiens
atctgaatcatcaaagtgtcaggctgtagatctgaaggactttgtcctgggactcttagaggaccctcggggtgtagctaaccaccatggagggagttgaggatgcgcctggagtgtcactggcctttccagcgcgtggggcacctttctgagtgctttacattttgagctctcccacatctgacggagatggtattctcatttacagatagattaaccgagtcggagagaggcaacatcacttgaattatgtcccatggctacaagtggagaccccaaacccagccatctggttccagagccaagctcaactacaatttgaaaccacctaatcactgtgcccttgggttttagagagacttgcatgtacataactgttgtgtcccccaaatgagatgctgatggccagagagcagttttactgcagagagtgtgtgtaggatcatgggaagaacatgggcattgaatgccttcccatctaggtgttccttacctgggtgctgttagttactgagtggcagggcatgctgcccacagagtgaccagcttcctggcctgtaggggagctctgtgccccccacctgccacatgccgtgcgcgttacagaaggcagcatgtgttcccagtgaggatccaatggctgatggctgtggtggcgctggtgatgacagtggacgcttaatccgcgtcaggtgctcaagtcctcacaaaaacagacctagggaggcac

SEQ ID NO: 125048 - DNA, 534 bp, Homo sapiens
cttggaactctccaagtcacccctcttgcaactttcgtgttaaaatcattcagtattttagttatagcttgtgatttttcaccttaaaattagaccttgagctggactcagtggtgcacacctgtagttctggctcctgaatggctgaggccggaggatcccttgaggccaggagttagaggctgcagtgcactgcgattgtgcctgtgactagcctctgtactccagcctgggcaacatagtgagacaccatctgttagaaaaaaaattagaccttgtgattattactgtttttgtacagataattgttggtttagatttactttatatgttagaagtgtttgtttattcattattattctcacatctcagacctttcacctaggataattttccttctttctgaagcacatcttttgatgttcctctagtgacatctgttgatggcaaactcttagtttacatttatcaaaagtattttcaattcattctataaagttgattttatatgtacataattctaagttgaggtgt

SEQ ID NO: 125049 - DNA, 228 bp, Homo sapiens
gtactcagccactgtgtgacttagggcaggtctcagaacctctctgagcctcaatttcctcatgtataaattgggtgtggccaatacctatttttcagggtagttgtaagaaatagagatgagagaaagaatcgaagaacaagattttgtagtgtgtgtgtgtgtgtgcgtgtgtgtgtgtgtgtgtgtgtgtgtgtgtgtgtgtgtgtgtgtgttttaagcattggg

SEQ ID NO: 125050 - DNA, 398 bp, Homo sapiens
ttttaatgagataaagttatatagctttatttttaaaagtggcatatgtgtttacatgtatatagttgtctagaaaattactggaagtctaaagccaaatattaaaagagattaactggccaagtgcggtggctcatgcctgtaatcccagcaatttgggaagccaaggagtgagccaccgtgcccggcctcagggctgattctcagccagcagtggccacaacaggacttccttccatgacgtttctcacactgctggaagtgcaatcagctcagccctctgcccagaatcactcccggctctgggctacaccttggtgacgggctcctctctcctctgccccacagggtgtgccgaggacacccccagtgtcttccagtcttatccctcccatggc

SEQ ID NO: 125051 - DNA, 2036 bp, Homo sapiens
ggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctaatttttgtatttttagtagagatggggtttcaccacattggccaggctggtctcgaactcctgacctcaggtgatccacccactttggcctcccaaagtgctgggattacaggtgtgagccaccatgcccagcctctgattattttctaatttcctccctcagttcttctttgacccatggattatcagaagtgggttgtctgatcagcaaacatttgttttttttcctcttaatatcttcttgttgctgatttctactttaattccattgaggtcagaaaatatcctctttatgatttcaatcctcttagttttattgagactcgttttatgacccaatatgttgtctgtcatggtgagtgtaccatacacagtttaaaagaatgcgtattttaggccaggtgtggtggctcatgcctgtaatccagcatgagattacatgctgagattacagctgtaatctgtaatttgagaggctgaggtgggaggatcatttcgagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcacataaaaa

SEQ ID NO: 125052 - DNA, 1714 bp, Homo sapiens
ggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctaatttttgtatttttagtagagatggggtttcaccacattggccaggctggtctcgaactcctgacctcaggtgatccacccactttggctcatgcctgtaatccagcatgagattacatgctgagattacagctgtaatctgtaatttgagaggctgaggtgggaggatcatttcgagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcacataaaaa

SEQ ID NO: 125053 - DNA, 1236 bp, Homo sapiens
ggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcacataaaaa

SEQ ID NO: 125054 - DNA, 1455 bp, Homo sapiens
  misc_feature (1315)..(1315): n is a, c, g, or t
  misc_feature (1323)..(1323): n is a, c, g, or t
  misc_feature (1337)..(1337): n is a, c, g, or t
  misc_feature (1350)..(1350): n is a, c, g, or t
  misc_feature (1353)..(1353): n is a, c, g, or t
  misc_feature (1356)..(1356): n is a, c, g, or t
  misc_feature (1361)..(1361): n is a, c, g, or t
  misc_feature (1368)..(1368): n is a, c, g, or t
  misc_feature (1375)..(1375): n is a, c, g, or t
  misc_feature (1388)..(1388): n is a, c, g, or t
  misc_feature (1391)..(1391): n is a, c, g, or t
  misc_feature (1395)..(1395): n is a, c, g, or t
  misc_feature (1401)..(1402): n is a, c, g, or t
  misc_feature (1435)..(1435): n is a, c, g, or t
  misc_feature (1442)..(1442): n is a, c, g, or t
ggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctaatttttgtatttttagtagagatggggtttcaccacattggccaggctggtctcgaactcctgacctcaggtgatccacccactttggcctcccaaagtgctgggattacaggtgtgagccaccatgcccagcctctgattattttctaatttcctccctcagttcttctttgacccatggattatcagaagtgggttgtctgatcagcaaacatttgttttttttcctcttaatatcttcttgttgctgatttctactttaattccattgaggtcagaaaatatcctctttatgatttcaatcctcttagttttattgagactcgttttatgacccaatatgttgtctgtcatggtgagtgtaccatacacagtttaaaagaatacctggctaatttttgtatttttagtagagatggggtttcaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagccccaaaaaccnaatgcctncccaaaggaatggncccatttaaccantanggnaattnccccccnggccccngggaaatgggggntgnaaanccaccnnaacccaaagggggaaaaagccaccggaggcctnccaaagnctaagggggtcca

SEQ ID NO: 125055 - DNA, 670 bp, Homo sapiens
atagctgtttattgctatgtgatctgcaaattagcctttaagtcgtaatattaaatgttggctgccaaagagtctttactttcttttcagacctgtgtttgaatagatgaattcaggttattgccagacatcttccccctccacgtactcaattttgttctaaaatgccttgtctttttgttgtaggttccagatatctgctagatgccgtgaagttataggctgcatttttattaagtattgattatttatgtaatcatttatgattcagtgaataagatacatacggtttatatactgtagtcttcatatattgaaattatttagaagagaaagaaaatatgtgatttgtaactgtaggatagaactagaatcatcaagataatatgtgggtaacaagaccgtttataaaatatttacgtatttttctgaataaaaggccaaatgccagtttatatctttttcattccctaattacaaaaagggggggaattaaatttatagttatttgtaaatcagttgtttaaattctaggggaaactttactcacataaaatccagaagacacattagcaacttgggttagaatattatagtcccttagctctgtcatcacctcctttcacactgtttcctcaagaaacaacacaacaagtgtgtgtggcgtgtg

SEQ ID NO: 125056 - DNA, 497 bp, Homo sapiens
ttgttaaaatctatgtcttccctgctatataaaccctggttttagtcagtcagggagatggaattgagaccaagctcccatcttctcagctgccgcccctgattaaagccttcttccttggcaatactcattgtctcagtgattggctttctatgcagcaagcagcaggacctagactgaactcctggtgtatcagtaacaaactaatagctaaagaagacagtaactttcttaagctagttattaacagagcagaactaaggtactctgacttccagactggttttctttctactataccatgctgttgtcaagaactctgaagaacctaagattttaccctacatgcaagctaacatcagtctgccatagtttcatggacactgagagcaaacactgtacctacatacagtttgggcactgaagactgaaactacatgtcccctatactgagttaaataagtgtcctcccaaaatgtgtaacggctagaaatagg

SEQ ID NO: 125057 - DNA, 365 bp, Homo sapiens
aagatagaggatccctgtggagacggggtcttagctcagccccaactcacagagggctccgttgatctatggtcccaccctgtggttatttccaaattcctgagagtataataggaatagccatctatggcaactgacaaatctccacactggctctcccacccatggagtgagagaatcatggtggaaagggctaagggaaagtccctgtaacttccacttcctgtcaaggacagttaaccagagggctgggcgcactggcttacacctgtaatcccagcactttgggaggccaaggcaggcggatcacgaggtcaggagattgagaccatcctggctaacacggtgagaccccgtctccacat

SEQ ID NO: 125058 - DNA, 738 bp, Homo sapiens
tgttgttctcagagacacactgagacttttcacatctcactgtcacttcttggaagggctctctacctcgtctgcctgctgagcaacctcttggggagacacgggccctcttgagtcactgaacttgagctatttggtgttgactttcttcagtcacatctgaataaatcccttagagatgttggaatttctgatgaatctgcagtcagcattttgcatgaactgtgtgtggattcattgcctacattggatgatgaagacttgagtgttgctactaaggccatggtgtgtgatgttccccatcctgtgtccaagtgttctcatttttctgttcccacctatgagtgagaacatgtggtgtttggttttctgtccttgcaacagtttgctcagaatgatggtttccagcttcatccacgtctctacaaaggacatgaactcatcattttttatgctgcatagtattccatggtgttgtgtccccgagaaagtgtcagagcctttacgtggaccttctcatgaaacaaggaaacagaatagtcaatggacacaggaacagggcctcctgcaaaacatccttccttgaagcctagccgtgaagtggaagatcctgctgtgaacggagcagtacaaagaacagaatgtacagacattgagagcagaacaaacttaccgtggtttagaggaaagccagaacggtgtgaacgacgtgaccgaagcatcccggtcagcaggact

SEQ ID NO: 125059 - DNA, 394 bp, Homo sapiens
tagccataggctggttactgactacttgaaatgtggccagtgtgactgaggatctgattttttaaattgtatttagttaacttaaatgcaaactgtaggccggcgcggtggctcatgcctgaaatgccagcactttgggaggccaacgcaggtggatcacctgaggtcaggagttccacccatctcagcctcccaaagtgctgggattacaggtgcatgccaccacgctcggctagtttttgtatgtttcatagacagggtttggccatgttggccaggctggtctccaactcctgacctcaggtgatccacctgctttggcctcccagagtgttgggattacaggcatgagcccctgtgcctggcctagaaatgttcaagaagcaggaactgg

SEQ ID NO: 125060 - DNA, 274 bp, Homo sapiens
ctgagcccggggcagggaagagccgagggacagaggccctcacaggaaccaggccctcccgcacaccgcctgacagtccacgtcagcgtctctgtccagcctccacacacccctgcacgttctgaagagccctccccaagagtccaactctctctccttcctcctcagggccgcaccagctctctctccttcccctcctcagggccacaccaactgtggggttccagctatcactctgtgcaaaggactcctaacatgggtgtcctccgtctca

SEQ ID NO: 125061 - DNA, 516 bp, Homo sapiens
ctcacccaggtataaatggaaagatttctactgaaactttcttcagctcatcagaggcttctagaatcaaaatccaatgaacatttttcagtttattatgtccttgttatatctacgggccttggccctggtcgcacaagaccacaagcccctgctcccaccacttctttccctctggagggtcctttccatgttcttttctgtcttttcctctccggccatttatgatggtaaattttctgtgtcaatttcactggggtaagggttgcccagatagctggtaaaagattgcttctgagtgtgtctgtgagggggtttctagaagatattagagtttgaatcggcagactgagtgaaggatgctaatgtaaagcaaagctacaatatagaaacatttggatttacaaggaacgtgggtgactatttgctttacattagcattcttcactctacaaaacgattcacctactatgtatgatgttcctccagatcccagggagaggaaatggtgggggt

SEQ ID NO: 125062 - DNA, 436 bp, Homo sapiens
cgtcaagtttattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacgggtccaccacgttcaccacctcctcgtcctctacgcagagcgggggc

SEQ ID NO: 125063 - DNA, 433 bp, Homo sapiens
agtgctatttagctgaggagtgaagctccttgtagcccggctaattttttgtatttttagtagagacggggtttcaccatgttagccaggatggtctcaatctcctgacctcgtgatccacccgcctcggcttcccaaagtgctgggattacaggcatgagccaccgtgcccggcctcatgaacccttctttgagcttaatttgctaatgcacctctcaaaactcaggggagctgttacttacgtttaccagcttattagaaaggattttacaaaggaggcagatgaagacatgtgtagggtgagggatgtgggaaggggcacagagggttccgtgctctccccgggctgtgacgtctccaggaacctccacgcattcatctgtggggaagcttccatcccagtcctccgggttttacctcagcttcctcgca

SEQ ID NO: 125064 - DNA, 578 bp, Homo sapiens
agtttgagaccagtctgggcaacaagagtgagtcctcatttctacaaaaaataaaaaaaaaaagtttgctgggcatggtggtacacagtctgtaatcccagcactttgggaggctgaggcgggtggatcacgaggtcagaagatcgagaccatcctggctaacacagtgaaaccccgtctacactaaaaatacaaaaaattagctgggtggtggcaggcacctgtagtcccagctactcgggaggctgaggcaggagaatggcatgaacccgggaggcggagcttgcagtgagcctgggcgacagatggagactccgtctcaaaaaaaaaaaaaaaaaatcgatctatctatatatatctagatagatcgatctaaggtactgatcctacaaattcccctgaaagttcagtggacacaatgcccgtgaaggatgcaggtcttccatttcagctgaactgtggcaagtgtcaaatggtttgctaacccttgctcagccccacaacccactaggagctttaaaatacttaatataggatttggatttttttttttataaagctactcagataagtgtgaa

SEQ ID NO: 125065 - DNA, 222 bp, Homo sapiens
aataagtaaatataactatctagctgactactcagagttcttgggaagaacagacgagacaacttataaatgctttgtatctcagagcaccatagaaatgccattggtggctgggcgcgatggctcacgtctgtaattccagcactttaggatgccaaggtgggcagatcacaaggtcaggagatcgagaccatcctggctaacacagtgaaaccccgtctc

SEQ ID NO: 125066 - DNA, 701 bp, Homo sapiens
aggccttgtaggaaagagaggaggaggctggggacttctcactgatgggagacttcccagttttgtttgaacatctgtgttttcacattttttgtagcactactacaaatcattttaatatgctctcatagaaggaaatacattgagccagcagaataagatctactaaaataaattttgaaaaggaatacattcttactcagtgttttacaaatcaatttcaaacgattcacatttgggttgactttagagtctttatgctaggaagataaaatccttttgatagatgtacatggccttttcaataacagggaattaagcatatggtaaatacctagagccaatccaaatatataaaaatgatattgaagtgtagaggactaacgtatcatagtgtaaacaataaactcaatattgcagagtaaaaaggtgaaaggagactccatctttaatagcaacattacccgctgtatgcctttattcccactttgctctagtacaggaagatcttcactatggggacttattcagataagttcccaagatcatgatcttcaaaatttcatactctagcctattaatgatttcagtaacaaatacaaagtgcgtgaacaatttattttggtatttataattttggagatattttgctatgatttttattctaagacagctctttaattagtatatgcattagtttc

SEQ ID NO: 125067 - DNA, 965 bp, Homo sapiens
  misc_feature (481)..(481): n is a, c, g, or t
  misc_feature (682)..(682): n is a, c, g, or t
  misc_feature (959)..(959): n is a, c, g, or t
atttttcttgggtcttctctacagctgacaggccaactcaacctactgccaaccaagacctgactggcacgaggaaaggtgcaataatgaagagttttcttctagttgtcaatgccctggcattaaccctgccttttttggctgtggaggttcaaaaccagaaacaaccagcatgccatgagaatgatgaaagaccattctatcagaaaacagctccatatgtcccaatgtattatgtgccaaatagctatccttattatggaaccaatttgtaccaacgtagaccagctatagcaattaataatccatgtgtgcctcgcacatattatgcaaacccagctgtagttaggccacatgcccaaattcctcagcggcaatacctgccaaatagcgcaccaccactgtggtacgtcgcccaaacttgatccatcatttattggcatcccccaaagaaaattcaggataaacatatcagtcctancatcaataccattggtactgtttgtaacttataacaggttcctgacaatggaaccaacgggtggacagtggtgagtcactccagaagcttttcagagtccatcatcacggagaaccctgtgaggaaacacaagtggggttatcccacttcgggttaaaacccgggatatttctcgaaccaaagggggaggtggttggatcncaattataatataaaagtccttatgagcatgggttcgtgtgttacaaaaagtgtgtttccaagaagggttcccaacaatattaaggggcacaaataggtttgtgcaagacggcgtcccaacaaaaaaaactgtggggggcggggcagtaaaatacggggggggcagagaagtaacagcccaacgaggacaacagcgaactagtctgtctccccccctcctcctcctccctctctctccgcataaacgaagcaagcgaggaaaaaggtggtggggagncctacc

SEQ ID NO: 125068 - DNA, 326 bp, Homo sapiens
tgttgcataggatgactggtcacttatgtgatatataaaaacagtgtagccagctgaattagtccattcttacgctgctgtgaagaaaggcccaagacagcaatttataaagaaaagcagtttaattgagtcacagttccacatggctgggaaagcctcaggaaacttagaatcatggcaaaaggcacctcttcacaggacagcaggagagacaggagcaagcagtggaaatgccagacacttataaaaccatcaaatttcatgagaactcattcactgtcatgggaacagcacaggggaaaccatccaccatgatccagttacct

SEQ ID NO: 125069 - DNA, 345 bp, Homo sapiens
gaccattttagaataatgatctccccacctgctgccagtgtggaaaccagcaagggcttagaggttcatggatctggaacccaggaggatggttgtgtccctgcagtcccaggtatgaaggtaaggcctgtagagaaagttgaggagtggtgccagtagtggcacttggcaaatagttccaccagcaccaaaacaggtgtggatgtggagctgggaaggggcagacaggaagtgggtcgctgtgtccagggtaacctctcagtgtctgctcaaggacagtcccgccttacctgctccttctgaccatcttactgcccagggctcaggattccgctggaagaatct

SEQ ID NO: 125070 - DNA, 646 bp, Homo sapiens
atacatgaatagccatttcccttttcctcaaaattctggagcctgaaaactagccatatatttcagttctcaggcagttttcattttgttgtttttgtttttattgaggaattttccttgactgtatatccaatatatttatattttaggcaagtaaagtatcctttgtaaacataacaattgtgattgactaaataagtggcccctctatctttttttttatttttattttttgagacagagtttcactcttgttgcccaggctggagtgcactggcgtgatctcggctcactacatcctctgcctcccaggttcaagcaattctcctgccttagcctcctgagtagctgggattacaggcacctgcctctatgcctggccaattttttgtatttttagtagagatggggtttcaccatgttggccaagctggtctcgaacttctgacctcaggtgatccacaagcctcggcctcctaaagtgctgggattacaggtgtgagccgctgcacccagccccatatatcttttgactagtatctgatgatactgaagtactgtgtttttgtctgcatttaatctgtatgttattttagttttataatgaaatagggcaataatcagtcattgaatcatatatattatg

SEQ ID NO: 125071 - DNA, 263 bp, Homo sapiens
caaagtgctgtgattacaggcatgaggcacagcgcccagccctccctttggtgttcaagaacatggttacataaacaaagaaatagcaaagaaatagaggaagacttaaagggatgttgtttgaaaccatctgggctaggttattttttagcctctttggtaacaatgttgaaccctcaggcaaaaggcaagcacctggcatttgcagataagtaaagatgttcttttgtggcctaaaagagatgacctttttttcctggctt

SEQ ID NO: 125072 - DNA, 501 bp, Homo sapiens
agaactatggagacattctctcaagatagtgtgtgtgatagtatggtttttaagttcataccttctagaaataccagcaaaatatttacagataaactgataggatgtctggggtttacctcaaaattatccaggaacaagaggtgtgtaatgtaaaaagattgtccatgatgggtgttacttgttgaaattaggtgatgggtacatggagtccattatattatctctagtataatgaagatttagtttgaatctaaactttgctactagctatatatgtccttagcaagttactcttcctgagtctccatttcctaatctgtagaatgagaaaagtaaatactaaaatctatcacataggacggttgttattattcaattaaagtaagttacaggccaggtgtggtggctcacacctgtaatcccaacactttgggagactgaggcaggcagattgcttgagcccaggagtttgagaccagcctgggcaacatggtgaaa

SEQ ID NO: 125073 - DNA, 662 bp, Homo sapiens
ctgtgtcataattaagttcgaggggaggtagtatgcctggatgtgcacgtaggccagatttatgtttctctctgcccaaacatctcagtggagtaaaacataacaaagcagcattgctgccaacatgtcttgcctcccgccacagggcgttttttttcctatctcagaattgagcaaatgtacaatcgggttttataccgagacattccgttcccaggggcaggcaggagacagaggccttcctcttatctcaactgcaagaggccttcctcttttactaatcctcctcagcacagaccccttatgggtgtcgggctgggggacggtcaggactttctcatcccaagaggccatatttcagactatcacaggcggggagaaaccttggacaatacccggctttccaaggcagaggtcccagcagcttttcgcagtgcgttgtgcccctggtttattgagactagagaatggtgatgacttttaccaagcatactgcttgtaaacattttgttaacaaggcacgtcctgcacagccctagatcccttaaaccttgattccatacaacacatgtttttgtgagctcaaggttggggcaaagaggttggggcaaattggctggggcaaagttacagattaacagcatctcagggcaaagcaattg

SEQ ID NO: 125074 - DNA, 391 bp, Homo sapiens
ttctgtatttttggcttcaccagtctggagtttctgtttcagtgaagtgggaagagtgaggaagggagtgatcttttttcagatatcaaagactttactgaattttagatttttttttggactagatctttctttatttgatatattctcttaggactgtttccagaaaatttaaatgattggtttttcataattttcttcagttgctggggagcaggcttgtggatcacatggtagtcagtcaaaggttcaggagagaaaaattatagctaacatagttacaagtacgcatacacacacaaaagacatatttttaaaaaattacttgcctcttttgatcctaaattcatttctgtgactgcctaactataaaggtagaatcagttgatga

SEQ ID NO: 125075 - DNA, 428 bp, Homo sapiens
agtagtattactcataagagtaaaaaagtagaaacaatccaaatgttcattaatagatgaatgaattattttatatgtgaattttcttaagagacaaggtttccccatgttgcccaggctggtctgaaacccctgggctcacatgatccgcccacctcaacctctttagtagctgggactacaggcacatgccatggcagctggctttctttttctttcttgcatactcttccacattcatggtctcattttccttttattttccccacctatgccactggcacttacgagcttcatttcggccagctgataatattcagggacactagccatataattttgctgtgatacccttattttaataaagctttggaatataggatgtgaaatagtaagtgtaaacacactgaacacactgtcacttactc

SEQ ID NO: 125076 - DNA, 334 bp, Homo sapiens
tactccagcctgtgtgacagaatgagaccttatctcaaaaaaaaaaagtttaccaggctttaaatagtttattttgatggacattatttgtccataaaatagacctttataaaagctcggatttgaaaccaataaattagaactgtaatgtagtcttttctagctggttttaggccagttaaatctagcagagatcatgaaggcagaaagccaacttgaagccaaaataactattgagaacattctacattccattaataggtaatgaaattaaatctgttaaccgctaaattaaaatacatattctacttacttacatacaactttaggccta

SEQ ID NO: 125077 - DNA, 692 bp, Homo sapiens
ttcttttgtgttgcagaataggcaccttgaatggtgcctggcatgtagtaggtattcagtaaatatttgttgaatgactgagtgaacaaatatgtccccagatattggaaggagacagaagaaccctcagattccagttcctacatttgttcctccagtaattcatttgtcacgtagtcagccatgccagatgtttcttccgtgtctggtttatgcacacacagggcatgaaacttacatggatcttgatttagacaaactaatgtataagacaattgaaatgtgatcaccgtctagatatttgatatataatgaacaattttattgttgacttattttcagtgttataatggtgttttggttatgatttttaaaggaggaggaggtctggttaagatgttaaagtttatgttatgtgtattttaccacaataaaaaattgggggaataaaaagaccaccgcacccagcctatcttctctctactttctatgtgtttgaaattttctgtaataaaaagtttttttttgttgttgttgtttttgaggtggagtcttgcactgtcgcccaggctggcgtgcagtggtgcagtctcggctcactgcaacctctgcctcctgggttcaagtgattctccctcccgggttcaagtgagcctcccaagtagctgggactacaggtgcacgccactatg

SEQ ID NO: 125078 - DNA, 207 bp, Homo sapiens
ctgtctcggggatcccaaagtgctgggattatagatgtgattcgccgtgcctggccaattcatggccaatcttatttcaactaatctcctacctacttcctccctcattgggagaagcaaaaccaagacattatacattttcatctgtaaatagtgagtacaatgaaatgacttttagattgcatatcttatacctaaaatattaaa

SEQ ID NO: 125079 - DNA, 197 bp, Homo sapiens
ggagtttgaggttacggtgaccttgatcataccactgcacttcaacctgggcaacaaagtgaccctatctcaaataaataagtaaataagtaaattcacccttctaaagtatacgtttcagtggtttttagtatactcacagcatgatacagccgtcaccgcaatcaattttataacacttcatcatcccccagtag

SEQ ID NO: 125080 - DNA, 315 bp, Homo sapiens
caaggatccctccgtaatatgtaacacacatgcattatattcaacaggaatatataaatttataattataatttaggatcaacagatgacaaacctttagaaggttgtatttaaccttaaaatataattttttaaaaattggttataaaatttctaatactttcttttttgtgacctcaaggggaaaatataattcttataaaagttcaaatgatttacagaatacaaaaagtgaatagagatgatgaatgaattaaaggaaaggatattgctacatagatttggttacatattacggatgggatcgctctagag

SEQ ID NO: 125081 - DNA, 1178 bp, Homo sapiens
ctttgcctcttgtaacagattttcagtgcaaatctgttttgtttgcttataaatatagctaccttcactctcttttggttactatgtgcatggaataacttttttcatcactttattttcagcctgtatacaactttaaggctaaagtgggctgttgtaggcagcatattgttggatcttgtgattttttttttttttaatccacataaccactgtgtgtcttttgattgaataattcatttacatataaagtaattattgatatgtaaagatttactattcttatttttctaattgtttactgactgctttatagttctgttatttctttcttccaatctctctgtattcctttgtgatttatttaattcttatagtgatagattttaattcttctctccttatctgctttttacaagtgtaatgatcaaatcagagtaagtgggaaatatacactaaattattgttaaatatagtcactctatgttctactgaacactagatcttattccatctctctaacttaattttgaagtcaaaaccagagaagcacagtaagagagaaaaactgccggctatctatctcactagtaaccatacatgaataatctaaaataaaataatgacaaacgcaaaatgtcagtttagagcagggttcctcaagctacatggcactcaggccaaatgtcaccagtggagcctgtttttgaatggcctacaggctaagaatggttatattttttgagaattttttttaaaaaagaagatgccatgataccaaatgatacctacaaggcctaaagtatttatgatctaactttacagaaaaaattatcaatccctgatttaaataaaaattataaaagttatattcttgtacataattcagtattcttggagttcttataaaaagagaaatatttgatacagagacaggaacacaggtagaacaccttgcgaaaaggaaatcagagattgagtgatgcttttgcaagtctagaaacaccaaacaaagactgccaataaaccaccagaaaccaagggggaaacacatggaacaggttcttcctcacctccctcagaaagaaccaatcctaccatctgatctcagtcttctaacctctggatctaagacaattctcctcttaacaaacaaacaaacttcacaccaaagaaaa

SEQ ID NO: 125082 - DNA, 529 bp, Homo sapiens
attctactgcttgtatgtcctcctccccattttaatataatgtaaagaacattgatatccatctctgattttcttgttaagctatcttaatgtttactgaattctatgagtatgttccctgctgccttccccatttctctgcttaaatcagaaatggctttcctcctctccaaaggtggcactatataaatgacataaataggctcaggatttcagaaaatgattgtatgtcttcgcttctttctagatatctttgttgtagctctcagctcataagataatgatctgtgttcctatgcaacttctgttcccaaatttgagctccttgcagcaaggactttcctattcaactaggaatttctagaagaaactgcttctttcctgtgccagggtgtcccgaatgagttagaaaaagcatttagtgtagatgagcaattaggaatggacccagccgggcacagtagctcatgcctgcaatcctgaggcaggaggattggtttaggccagaattttgactttttaaagtatc

SEQ ID NO: 125083 - DNA, 268 bp, Homo sapiens
gcagggtctgcaaaatgtctcaagcattgatcttaggttttacaatagcggtgttactccccggagtaatttggagaggtccagactcttgcagccaaaggctgcacggcccccaaaccatgacatccaatcttgtagctaacttgtgagtactataaaggcagactggtccccaggcaagacagggatttttggcgaagggctattatctattttgtttcagagtttaaactataaactacattccttcccaaggctagtttggcct

SEQ ID NO: 125084 - DNA, 345 bp, Homo sapiens
cgctttcctcctttttgtggtcaaaaatatatgttcagctaggttcctcaggggtatttagtatttttttatttttttcttaagaatacatctgaaaatgctgtattaaaccagaagcttatttctataaagaccagactacttcgttttattctgtattatcacttatattatttagaaaattgaagtgatatttgttctgtatattttaaatggaaacataaaatacagataacttggaaattcaagtgcactatcaggattttacagagttataaataactctcattagttactgggcagtcttcatactacatgatatattttcaaatgcaaccatctttt

SEQ ID NO: 125085 - DNA, 258 bp, Homo sapiens
ttgcaggggcctttgcttgggagacggagatgaattagacactagcctgccattaggaggaggtcgggtgctgcagacttgtggtgggacagtggtggtggaggccagactgcatgctataggatggacaggacacgagtatgaaccagggggtggaggagtaccacagcgtgggggcagtttagtacagagggtcagcttctgctaagaggggacttcacacctgggatctgcatggccatggcaggtggggaagga

SEQ ID NO: 125086 - DNA, 284 bp, Homo sapiens
atccacccgcctcggcctcccaaagtgctgggattacaggcatgaaccaccgctcccagccgagactttgacttttgaacagacttcaacagttaagggaaggagagagcctgtcaaagggagcagtgagtgaaaggccttaagtcaagagggtgactgacatgttgaggaaaagcaaagaggtgagtctggctggagccgactggatgagagagaggagtataagagatgaggccagagaggtaacagggccggatcatgtagagccttctaggtcagcataa

SEQ ID NO: 125087 - DNA, 315 bp, Homo sapiens
tctgattttagtaattcgatctttctttccttagtccatctggctaaataaagctttgtcaattttgtttatcttttcaaagaagaaccaccttttggtttctttgacttttctctattgtttttctattctttatttcatttatctctaatctttattacttcctttagctttaggtttagtttgtcctttttctagttatttaagttgtaaggttaggttgttgattttaagtttctcttcttttgttaaagagactggtgtttgtttgttttttgacacagagtctcactttgttgccccggctggagtgca

SEQ ID NO: 125088 - DNA, 754 bp, Homo sapiens
taaatagaagttctataaaatcattacacaaagaaatatttttattatcagaatttatgaatgagaaaaatttcataaataatttaggtcatccaggcctatgacttaattaggtttatcttgatttttataggtatttcttttatctaatttttttgcttctatctttcatttttatttctctaaaaatagatacttagaagccacctccagcttagttgtttgaaattttatattttcccttccaaaactgggtcttccacatgttaatgacaccagcatatcatgctgatataataatggcaaatgtttattgagggcttactgtttaatagagctattaacagtgctgtacatgcattatctgaatcctcattacaattttatgaggtagtttattgtctgtattttataggtgagaaaactgaagcacagtaaggtctcacaacttgtaactggcgaagcttgttgcccagctagacgactgtaagctttgggctcttaaccactgtactgacagcctcttatttctatagtcgtatcagcttatgtgtcagggctgcctgtcacttattagcaaagcaaattactttgtcactctggactgcagttttcttatctgtataatggatatttacctcacagaacttgtagaacaattaaacagttaatgtgttacatgtctattatgctgcccaacatacaatatacacttgctaatgtttattatttctcaccgctataatccttaata

SEQ ID NO: 125089 - DNA, 533 bp, Homo sapiens
tacactctcaattagtttacataattgggagttcagtgtatttggacaaggtggaaagttgccgaagagctttgtgggtgttttaaacaaaatttaaaaaacattttctggctaagcgatctgagaagccctctcctgcacttcagactgctcaggggtgaattgatggcaacagtgctgacccccaggctgggctgagttcagtcccacatgtgtttagtacagcacccagtgtcttggcctgaatccctgattctccagggctctgacggcgatgcatccccttctcacgaggcccctgggtgcccccagtcaaggactggctttcctgctctttcctcagagcacgtgaggattccctgtcaggaccgtcccccaccctgttgtggtggctttggataaggtacgtcataggatgcacctggggctgaggccccaccatccccagctcctcctgtggggccggaatgactgagcgtcctcctgcctcgcaggctcggtgtccttttgcaccctgtggtgaatcccagatc

SEQ ID NO: 125090 - DNA, 546 bp, Homo sapiens
taacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggtta

SEQ ID NO: 125091 - DNA, 479 bp, Homo sapiens
ttttttacttttcacagggtaaatataagccccagaagaatgaggaatttgtcttattaatgtagcctcagattccacaacagtgcagataaatggtgagggttcaatgtacagatatacagttgtcattaagaatgaaaagcataatccttgccaggaatttccatttaagtgattcttttcagtctttgtatttgataaagtccctagggtccatctctattttactcttccatttcccttaatgtaggtttccccagagttctagtctcagtattctttcatttccctgtgctttatctcttggtaatagtattctttgtcaaatatcaactatcacatccaggtatgactcctaaattggtatctctcttgtcacactggttgctagacttttctatctggacaggatctcttttcatctcaagcgcagttatgtccaaacccaaattttgtatcaccaccccaagcttcccatc

SEQ ID NO: 125092 - DNA, 469 bp, Homo sapiens
gcttcccctgaggtcttctttctctctctcctcttcccattcctcctcttaagtctgtctcttgccccagccttagaacagaatccttgttaactaacccttcttctgtactatacaagagaggagttagagtacacgttgggctttgcaacgggtctgctttcatttgttaagcaattgttttttatttggatttcatttattcatttaaatatttatgaagccctactacttaccctcaggatgctaggcattctaaaggaatatcttgctagagaaacgtctccgtttagattgtaccttaagtttcagtcacagcacagaaaagggcttctttggaacctgtgacaggtgaccgtcttctccttttcctctgcagttagattcagggcgactgctttgggctaaattatgaaagacttaagcaggagtaaagagatttttctgaaagtaaaaatatctaaatacc

SEQ ID NO: 125093 - DNA, 526 bp, Homo sapiens
ttttcaacattatagctgctgctgagtgaagaaaggcatcatgactgcagatgctttctactgccttccagggacaagccacctggctttcaggtgcccttttaagtgtctttttatcacctgtctcctctctgtcctcaccattccatctttccgaagggcaagcacaacggagtgggggagtgacacacatcagacaaggttccaacgaaaatgaaaggcttgcgacattcaaatcacagggtgctttcacctattcattcactcctgttcattctatcagctgagtacccaagagcagcagttttttggagtagattttaagaatgctccaccttgtaggcagttctgcatcctacttttgtccctcaaggaaaagacctgggggtagttttaaagattgtatactgatgcataacaaaaagaaatacaaacatttttcccattaagttttttggggttttttgttgttgtttttcctgaaacagggtctctctctgcaatctcggctcactgcaccctctgc

SEQ ID NO: 125094 - DNA, 324 bp, Homo sapiens
ctactggggccactgactgaatacatttttgaaatctaaatagattcatttagattcaggactgccctatcttaacaataatcatattgttaaaattcagcatagaaattaaatccaatcttcagaaaaaacatttatgccaaatgagtaagactggggatatgtaaaattaagacacagtctgtgctaaaataacttgtcaaaaagaccttaaaagggctgggcgtggtggttcacgcctataatcctggcactttgggaggatgaggcaggttggtcacttgaggtcaggagtttgaaaccagcctgaccaacatggtgaaa

SEQ ID NO: 125095 - DNA, 492 bp, Homo sapiens
tcttcagggctaacgagggacccacctcccagtggatgtttctcctaccgtactggggctacaaaagcagtgacctgtaagtctgatgcagtcttctgaagttcgcttgtcatgacactccttgactgcaccccgccatgaatcactgaattacaaggatgatggtaataacaagaacaatgaatacttacagaatttttcttatgtgccaggtatggttctaagtgctttaacatacacacatatgaactaatggggatgaagttctctccctaactaaaccctaaacactggttggaatgtcactggtgttgaggctgcatgtgaatagagcagcctgctctgtgaaatgaacatctgtctttcatccttctaaaaattccattctacttccagagaaagactcaagagtctctcattaagaactcattcctggccaggcgcagtggctcacgcctgtaatcccagcactttgggaggccgaggtgggag

SEQ ID NO: 125096 - DNA, 236 bp, Homo sapiens
agaccataaaaaatcctttggagaaattaaaaatagagatgtgatgagtgcctaaggaagataggtccagatctatttagattttccatcagcatttatttaatttttttctttttttaagagacagggtcttaactgtgtcacccaggctcccaggctggagtacacatgcgatcatagctcaccgtaaccttgaactcctgggttcatgcgatactcctgcctcagccaagcca

SEQ ID NO: 125097 - DNA, 683 bp, Homo sapiens
cagaggctctaacgcagtctcctgctgactgaatcctcttctctgagcccgttcattcactgtctctgccagctgtttccaagtgtgaacccagtggagaccttttcaaactgtagccatgaagcaggttgcatgaggcagttccatctcctggcaactgtctccatagacacagcctggtttcggtccacatcccttacctaggattcttcctggctaaagaaacccataaaagtggaaaactcaaactccacagtgcaaatatctcttgagtctgcctgcactaccctttcttgaatgtgtattgataagactgcagttgacattttaagaaatttaaatttcaacctgaagtcaataaggacacctcagaagttttcaaaggaaggatggagtctgttgaaaagaaccggttggtaaaatgagaaaaaatggattgaaggaggacccaagtgaccacctggtaattacttcaacagcagagcgactcatacagccggcagtccactttgttcttctatagatcctgcctgtggtgttggatctaacagcttcttccctgacccaagattatgaaggatttctcctgtgttctcttctaaaaattttacatttaggtacataatccattttgagctaattcttttaaatagtgcaaagtatggattgaagttctttttttt

SEQ ID NO: 125098 - DNA, 495 bp, Homo sapiens
aagggaatggaaaggtctggtttgagatttgtgttctgtaatgagctacagcaagtgacaggattttataagggtgaaatttatcttaaaaataacttctttgggttcctaaccttagagtgatttgaggttttgggtttcagtaatccatggttgaggcaatttctcaaaatccatgggaaaagttggttagaaacaggagttctccacactttgagagttccaaacggagaagaaatttggtgaaccatgtagtagtataacaaagatggggattctttgtatttaaaaaataacaagaaaagttcaaggcatgcttgcagatgatcctagttatgtaacacttcaggctaattgtgagagaagtggcatgatcacgcaagcttgagaaggtatgattttgactaagacccttaggctccttgagactcagtttcctaatccaccaacaagagactgaacatatatgttctctgtcgcccttcccagcccagc

SEQ ID NO: 125099 - DNA, 259 bp, Homo sapiens
gggagaacagaagggcccagaatgataaagccttgtgaggaccacagaactcaggaatcctggctgggttttaaaaattttgtccctgataggccggacgcggtggctcccacctgtaatcccagcattttgggaggccaaggcgggcagatcacttgaggtcaggagttcgagaccagcctggccaacatggtgaaaccctgtgtctactaaaaatacaaaaattagccgggtgtggtggcgggcatctgtaatctca

SEQ ID NO: 125100 - DNA, 573 bp, Homo sapiens
cactccagcctgggtgacagagtgagaccttgtctcaaaaaacaaacaaaaaaaaacactcccgaatcacaaaattgtacatttggtataatttagatgtccttctaaatctttattaattaatcttgcattaactcaaaaactactgaactagaaattaatttcactatttgaaacagcacctataaagtggtacagcaacaaaagaagtccatctaatatagacttcagtaccaggttccaccagtcagtttagtatgccttttatctcctattcctttattgaatagtgtttgttttccagcaggagaaccagaatagagctggcccactaaatccagctaaacacatggacaaaatatccaattgtatggccacagtcatctagtagagtgtaaataataattgtgtatatatataatgtgtatattagtagataatatgtattcttacacgtataaaaatacggaagagggtatttagatttccttagaattttcattgcattatttcatctccaaatagatcacagttataactgaagatcaatctgctgcataagaaaagctgatc

SEQ ID NO: 125101 - DNA, 281 bp, Homo sapiens
gaagagtcatatcagctaaggcactgggcccattgataagtaacaatcctttctttgaacagggacctgggagaaagagtcacgttacctggatgatgaatacacagatagatcataaagcttcctgtaggcaggacccagcaaggagagttacataacctggatgttgcaaatggcaatatgtcacaatgacccatgaaggcagggcacaggtaggagagtcacataaccagggtgaggggcccagtgatatgtcacaatgtcccatgtgggcagtgcca

SEQ ID NO: 125102 - DNA, 353 bp, Homo sapiens
cccaacatgatgtggtaaacagctcaactgaaaccataaacatcaccttgcttgtgtggggtaaatagtggtataagtacatgtttaatgcattgataggtaaattcctagtagggcaaagataagatcttaattcattcacctatgcatactttgtgctgacgaaatttttaacacgagttccatccctcaaatgtttcaatatcaaaagtctaaaatgcataccatgcttttaccagctgctgggaagttggaatgtatcaaaacgtattcatttctcagttctgcccacactaacctccccattaacttaatattagggagacaagcaatgaatttctggatcagtaagt

SEQ ID NO: 125103 - DNA, 546 bp, Homo sapiens
gcgaatcccttaccccagcttcccaagtagctgggattacaggtgcccaccaccacgcccggctaatttttgtatttttagtagagacagggtttcaccatgttggccaggctggtcttgaactcctgacctcaagtgatctgcccacctaggcctcccaaagtgctgggattacaggcatgagccaccgctcccagccccagtggctttaataatgaccaaacctcatctgtgttttcctcatacacacccacactctctggtcctccccacattggaaaagtgcataataagtttcacccagtcatttctccagagtctcctgaacttatggatcaaaagcagcccatctgaagtatggccctggctaggaaaagccttcatggcaagtatagaacctgaacatgggctcttggtaaaaactttcggtccttagaaaatttaattcttaatgaaaagccaatgttcaaactatcattctctatggaaaataggaatctattctacaagattgactttttcctccatgattttttagttgtggga

SEQ ID NO: 125104 - DNA, 492 bp, Homo sapiens
ggggttcacagggtaggggaagaacaacccaaagaactcacaggagctaagaaaacataagaaaaacatgagcaagagaaagaagcgcctttttcccctcctttcctcttgttaaatgatgattgacacacccgggctcaatttccagttcattacgtaacactctgagcaagtcatttaccctctctgagctgaagtctttttggctgtacaatggggataattatactcagttcatagaggccttttgatataatgcctatgaaaatgctacatgaaagtgaagcatttatcatcaacacaattagctgaactggttagggttaatgaggtccaggttgtacctccgttcccattagactaattagccaccctcagacatagatgctacaggtaggtcagagattgcgcctctaatccagactattggcttagcagggatatttctatatatccaagacaggtcaccctggccaactgtgcagatgttac

SEQ ID NO: 125105 - DNA, 333 bp, Homo sapiens
tggtgggccaaaattaagatgtattcacctcaaaattatctccagagttggtgctacacatacatgatgaaacactgagcaccttcctgaactttcattgagagtcgtagtttccccctcaccactatcaccgagtcaagtcgactcctttgtgggcgtaactcaagttgttcctgtcagcatgctgaccagctggtcacctttggttcatatctgtttaaaaagattccagaaattctgtaggctttcatggtcaagcgcaatctctgtgacttcctgcgttaagtaccatagaatgctaatagcatcacagaatgttaaaactggagagcc

SEQ ID NO: 125106 - DNA, 547 bp, Homo sapiens
ggagaagcaacagtggctcacgatcaacagaatccttagcacgtgcagatgttcaacagagaaaaggcttctgtcactgccgcagcaggatgtggcttgctgcttcctaactcgtcattgaagaaaacagagactgtgatgtataagatgggctgggcagaacacatcaagaaggagcccatcttcatggggaaaactaggaagtgtccctgagagccttccagggctcagagtaccttctgtttaaattacatgtgactacacaatactgctagggaaacgtggaaagtgcttctagtgactttggcattctaaatcagaaactgtggacttaggggactgatgggcatatttatgttgtctagttgaaagaggagatgtcggaaggaaaagaagatgtgaaatgcaaacagcaggctccacagacagtgtcagagaacaggacgtgatatcttgagttgtggttaactggagagtgtgatcctcacaagggccttggtacatctcacaaaaataggctgattctgtctgactggaggggaaagaa

SEQ ID NO: 125107 - DNA, 445 bp, Homo sapiens
ggaggttgttctgtggccctccagcctgggttgacagcaataccttgtctccaaataataattaataatgaacctagtaaataacagcagcaacagaagtgatgatgatatttcccaagtctctaaaacaaaacatgtcctcatctttgggattgggatttgggcactgtgtgtgtttgtgtgtatgtgcatgtatgcacatgtgtgtattgtatacattttaaaagtctctccattgatttaaatgtgtaggtggacttaagaggcctatgctgtgtattacctaggacatggcagtagtcattgattcagtgatttcgctgtgttgtaaagcacatagtgcatttgataaaactagctgatgcatgttagggattatgtaggataacaggatgaagagagtcatcacctgggaagccttcattaaatcagtgggcttgagctg

SEQ ID NO: 125108 - DNA, 172 bp, Homo sapiens
ccctgcaagtaggatcatatcagatgagagaataaaaagagtaccttgcctttttacatattcaggattttggtctccgttgagaatgaatcttttttgttcttttgttggaaatgggctatttacaaatattttccagggttccagaaaactcagttctctgcaaccaact

SEQ ID NO: 125109 - DNA, 204 bp, Homo sapiens
ggataaaccatgttcaaaaagaaacaaactcagaaaggaagagggaagggtcatatgtatagaatatgaaagtggatttaatcacatgtatataaagaattgtccaaatggctagccagataaatacgtctcatattttacagttctggtgtgatgaaaagatgttcttttactaccttgataatcacacttatgacacataag

SEQ ID NO: 125110 - DNA, 339 bp, Homo sapiens
ccaggccacagccctccagaatgcagtacaaccactaggtatgacttatcagctacagtgaactccgggaggaaatcccaccgctgataccatcatttagtttcactttgcagattacaaaacattttatctggtggctcatgcctgtaatcccagcactttgggaggccagggcaggcggattacctgagctcaggagttagagaccagcctgggcaacatggcgagagcccatctctacaaagaatacaataattagccaggcatggtggcacactactcaggaggctgatgtgggaagatcatctgagtccaggaggtcgagcctgcagtgggcca

SEQ ID NO: 125111 - DNA, 246 bp, Homo sapiens
tcagtcttgccctccctattctattcaccacagtgctatgagactgaactttctaaaacgcaaaactaatattaccgctctccagtctaaaacccttcactgaagccagacacaaaaaggcacatattataaaatcccattcacatcaaagtccagaataggcaagtccacagagatagaaagtagattagtggttgccaagggctggaggtagagacataggaaatgacagtaaatgggtacagg

SEQ ID NO: 125112 - DNA, 257 bp, Homo sapiens
ggcctcaagtgatactcccagcttcacctcccaaagtcctagggttataggcatgaactactgctcctggcgtcattgtttctaaccctaaacttgagtgctcattttctcttctcacttgtccccccataccacattcatttctgaagcttgggaagataggagtcccatagaaaactgccatggttttttctcttcatagctgagttctagaaggcaatcagttgctatgccttctgagttagtacctaattcta

SEQ ID NO: 125113 - DNA, 144 bp, Homo sapiens
tgtattgtttttatcctcacaaccaccctacaaggtagacagggacccttacatgcatttagagatacggaaactatgcctatggtcaagagctagtaaaagtcagagtggggtttcacacccagacagtctgattcctagtac

SEQ ID NO: 125114 - DNA, 560 bp, Homo sapiens
gatcttacggatcagtaagaaaaagttgaatactttaggagaaaacaagtcaggttatcagtaggcaactcgcagaaggaccaaaaaatggtcaaaagtacggggaaagttcagctttacaaatggtcaaagaaatgtaaatcacattgcagatttgaataaaacgagcttgcccaaggttatgaaagggtctgcttttagagtataatttgatgacatgtatcaaaatcttttaaattttgtgtaataatagcatttactaccctctctgtgaggcataacattaaacattggacaaagattagctcatttaatcctcaaaattacccttttgtgcaaatgtggttatttccattttaatgatgagaaaataggaatgttggaggaataatgccaactttcccaaggtcatttagctagttaagagatagagacaggaccggccgggcgcagtggctcacgcttgtaatcccagcactttgggaggcggaggaaggcggatcacgaggtcaggagattgagaccacggtgaaaccccgtctctactaaaaatacaaaaa

SEQ ID NO: 125115 - DNA, 328 bp, Homo sapiens
gtaccgtgttcctcccaccctgtttgaattgggggaaaggagatttggggtggctttaaggctaagcctctgccctgtgatcaggactctctcaccactaatttgggacaaattgctcctcccactgtgaccctcggtttctttatctgtaaaatgaagatagtctctatagagtcctgtgaggattaaggataaaatcagaggagagaacacgggctaccacaggttcataagctaggggagtcccgggaagaaagttgcaaatatgaacccgaagactaggggtcacgaagctcagtggctggaggtcacattccctttgctctgg

SEQ ID NO: 125116 - DNA, 434 bp, Homo sapiens
gcttttttctacatttggctgaaagacagtattagggttttatccctttgggggctgtgttgtataagaggatagaatatggcaaaaaggagaataagaatattgttttatttgctgaaagttgaatcattctttggggacatttttagtggatggtatttgtctttgacattttatcaactcctcttttttcctctttgaatcctagtaaccttcttgccagttagaagcaatgcactgctgaacactagtttcttattgaaaatttaaactaaatctgctgtattccagagagtgccacattttgtatttttattgacctgtaccaccctccctttccaggttttcttaaaactctcatagctgaatctcaactattctaggatatgacaaaaagaaataaaaatgtatgagtaattgacatccctcttagt

SEQ ID NO: 125117 - DNA, 383 bp, Homo sapiens
tcgtggtacacgcaggaagaggctagaacaagggagacagccttcactttggatcctgttcttacctactgcccaactccgaggagctggtctttctccagacagtacttccactccagagatgtcctgcccaagactgacgcacagttgctctcccactgagccaggttcctcaggtcccaccgtcctcctgtcctcaaaagcacttaggatgtagcaaattgtcttattgttttactcccgactagcaaattctcctttctaattagtaagcctatatatgctaccttatacttatgtcaatttttttgcaacacattgcattttctacatacttcctctggatttggtctgatatggtcatctttgtgttctctcctttg

SEQ ID NO: 125118 - DNA, 384 bp, Homo sapiens
tataatgtgagggagggcttgaatacccaccactcccagtaggaactaggcagagcactatcatatcctccagagagaaagagggccagcaaaatcatctctcactttaataagataaaggggtaacttcatactagcctattcccaggagagaaagaaagaataaagccacgtgtttaagtgctcttctggctctcattaaagtagatggaaaaaacaggtggcgtagaggcaagagacaggactgctcattcatactagatagaacagtagtttccagcctgcagattgcagtcttttttttttttgagatggagttttactcttgttacccaggctagactgcaatggcacgatctcggctgacagcaacctccacctccc

SEQ ID NO: 125119 - DNA, 393 bp, Homo sapiens
gacggcaccaagccctgaaggatctgctcccatgacctaaacacctctcaccaggcctcacctctagcatggggatatagttcactatgagatttggtcagggacaattatccaaacttaatcatttttagtgaatatgttttaaaaaatttcttatatgagtttctgttagtatttgtccttattagggtgctcatctcttattcattttaaaaactctcattaaaggtattgactctttgtaatatgtattgtaaattgtttttcaagtttgctatactacactttctttatagtatctttgatatagaagacttttagtttattttgcaaaatatgttagtgtttaattcctgtgttttggcttatccctggcaagacctctttaacccc

SEQ ID NO: 125120 - DNA, 753 bp, Homo sapiens
ctccccagccatgtggaactgtgagtcagtttaacctctttcatttgtaaattacccagtctcaggcatgtctttattaacagcatagcaatggactaatacagctgccgtcaatgagattatagtccaatattatattaaatatatgtcatcttagtaaacataatcgtcacaaatatggattgtttgacttgatttgaggtatgaaagagctaagtgaaaataataaaatgttaattgattagtggcccaaatagagaggttaagatgtcatgaaaactaaaagacagattttcatgaaacaaagacatcaattatttcaaatagtggtgagctatcaaaatttaggcatattaaaagttggtctttggagtaaaaatctagaagtcacttgttacaagagaagggatattttattgggatagtagggcatagatgcatgttggattgaattgaagagagaaaaaaattctagttttccataagtgtgaattaaaaacaataaaaatggtggacaaattgtgaaacaactaaatttcaaaaccaaaacatcatcttaaaaatattgaaggacaaaaataaaggtcaaaaaattgagaactttcaatgaggtgctataaatagaaatgcaatcaccacataatattaaagcactattgtaagaatacagaaacattaaatgtaagaaaacagaaaaatttatatattatataagtgtatatacacaatgagactgaccaaaacaagctgatt

SEQ ID NO: 125121 - DNA, 541 bp, Homo sapiens
gttgaagccaaagaagcagagaatagaatcgtggttacgaaggctggcaggggcgaggggaatggggagatgattgtcaaagggtacacaatctcagctagacaggagaaatatgtgttgtgttgtgttttgtgttgtttagagacagtgtctctctgtggcccaggctggagttcagtggcgtcagttcttgggaatcaatccactgtcctatctaaaagcatcgactccagtctgaaaccctggctctactaccaatcagctatgtgatcttgagcacagcacttcacctgcctgggcctgttttctcacctggcacaggaggatgacaagagtattgcaggggtgtagacacatgaggtgtcccggcacaccgtgggtgctcaacacatattagagattactcttctgcaaaacggactcagttcccatgttgtaatttaaaataaagaagaaagcataggaagaggttaagaaaggggataaagaagaaaaagggagtgcaggccgggcgcagtggctcacgcctgtaatcccagca

SEQ ID NO: 125122 - DNA, 283 bp, Homo sapiens
tgggcacagtgcgttgtggctggagcaggtgggaggaagctggaccaggactgacggacctcagattccaaactggggaaccacagcatctctggccagcaggatacctgctgaagcttccagtccaggcctccactgcaggcctctgtctgctctgtccccagccccgctggccggcacgatggccacacaccggggttagccaggccccgttcatgcttcaagcctagccctgcacgcgctggacaggggccagttcttcctggaattcccatctgcctgc

SEQ ID NO: 125123 - DNA, 1236 bp, Homo sapiens
agcgcgtcaatcccggcgggaaccccggctgcggaaggcggctgcggccggcgggagccgaggggaagaatggagcgctgaggaagcgaggcgccagccccagccgcttcgctgccgcggagcctgcacgaccgagaggtcgcggagagaagccagagacaggccagcgacctggcgagagagaagatctagctatgttacccaggctggatttgacctcctgggctcaagggatcctcctacctcagccccccacacagcagggactacagctgcacaccactacccagctcccttcttcatgtcttacctgtccttattatcacagtgaataatgcctaatctattagtgaataatgcctaatctattaagagctatgtgaaaaacctaaactctttccatttgcaacccttttggtatggtcaagtcagtggatctggctatcatacaaactcaaatcaactactacaaattcagattggctaagcagattccagccattttaaaagcttgtctctgctctatcctgtatctttctgcatttacatgtaacttcactgtgggtgtccttacagtatatatttttatgagacatcaaacttactaagagtactttatagcatagtatttaggaacttaggggtcagaattaagacattgttactatgtcaccttgagtattttgtttaacttcacaacacttcagtttcctgatcagttaaataattatgataatacaagacatagtagcatcacaggattattatggggcctaaatagataatgtatataaagtatttatcacagtgcctggtacagatgttagcttctgttactactctgattctagcctccctaattctcattcttttttgggggttgcaggggagttcactgtgctgtttgctatatttcaagcctcaaaagacaatgaagttcccaaatgctcttcaaggcagaacaaatataaataatgattctcacaccaaatgtgtgcaaagttcaaatattgcattaatggtgctttttattgtgcaaatcatacgactaacccatcatgtcctttctgtgtcaggaagaacatggatgggaatagaaggatctttgaaatcctaccctctgtgtaaatcagtatctgtgaatttttctcttgttagtactgatttatttactctttctggtgtatctgctctttcccttaaaacctttatgataaaaacatatttgaatgccca

SEQ ID NO: 125124 - DNA, 388 bp, Homo sapiens
aagtggaaattttagagttgaatagtaaccgaaataaaaaattcaaatgagttcaccagatggtctgaagagcagatttgatattatataggaaacagtctgtgaaattacagataaagaaattaaccaatcagaacagagaaaaagaacagagcattggagacttgtaaacaacatcaagcataccagcatgtatataatgggaacttcagaaagggaacagtaaaaatattacaagaaataactgctgaaaacattccaaatctcatgaaaaaacattaacctacagatctaagaaattcaacaaatccaaagtatgataagcacaaagagatcctcacccagatacttcataatcaaacagctgaaaacaaaacacaagaaaaaa

SEQ ID NO: 125125 - DNA, 477 bp, Homo sapiens
gtgaataagataagactcctgccctgacaactaaatgatgaatggaattcagatactgttaagtgctgcgaagaaaaaggaaacggatttgggatagacaggggcaggtaatggagtggagggctatttgagtttgggagtcaggaaagacctctctgataaacagaggcgtgcatgaaatgaggaagcaaaccttgcaattggtggggaacagcattctaggtgagggaacagtgagtgcaaaggttggaatgagcagtagaaaggccacagtggctagatggagatgagggggtgcggctggttaggcaggggtagccaggtcacggagggtcatggaggccactgggaaggggttggaggattttataaggttttgagcagaggtgttgacaggatccaatttacattttaagaggatcccctggctgctatgagggaaagaatggaaattagaagactggttgggaaacttag

SEQ ID NO: 125126 - DNA, 333 bp, Homo sapiens
gtcctcacggaaagcaacgaggcagatttgaaacccacactaaggaggcattgtaaatgaactcaagaacatgagcttggcacagaaggaacaagttgagagataagaagtttcctgattaaaataaccctagtgcctctttgagatctgcttctagcaccaactgacagctatttccaacggcagaagacaccaaatgtcaatctgtaacatgctacaggtcaatattgctttctttcctgcagatggtttaagcacaacttagcaactcctctgccgcctcgtttctgctgaaacttcgccgggttttaacacgcctgccaaaactgcccc

SEQ ID NO: 125127 - DNA, 781 bp, Homo sapiens
cgtggtggctcatgcctgtaaccccagcactttgggaggtcgaggtgggtggatcacgaggtcaggagttcaagaccagcctggtcgagatggtcctgaaccccctccccaaaaggattttaagccagcctttgctttgacagctgtcctatcatgatttagagaagagaggtttcaactggccccactagtggaacaacatcatcaactggcccacacctgtttttttatcttgaagataagataaaaagataaataacacttaaacaaccaaccaaccaacaaaaaatctttgggaaatggttacaaaggtcgtattttgtatagggcatagcactatgcaactattatcttatttttattttttctggagatggaactactgccctaagtcttggaaaaggcatagggtaagacagaaggaaccacagtgcttacacgcacatccggccctgggaaactgcctttttttttttggaatctcggaaacaaaaacaaaaaacaaaaaaaaaaaacttgtgtggggcggcttgggccctggaaaaggtttttaaacccttcggttgggggccggggcccctgtgggtacggggacctgggccaaaggggtccccaagggaaaacccgggcacagaacccaggggcgggatttccccccaattaaaaaaacgcccgggggggaacaccggggtcttctcggaccaattcccagtggggatccagggggggccacagacggggcgcttaccaccagggagtcccagggaaccgagaaaataca

SEQ ID NO: 125128 - DNA, 681 bp, Homo sapiens
gatggtctcgtggatatcagaatgacttaaaactttaaaaataaaatattcccaaagctactgatgcaaccatctgaaaaaatagaagatgatgtaagacatgcacatgactagagtcagaccactaactctgaagatcctaattcctgaagctagttttaaaatattaaacataatttttgctttgcataaagcaaggcacaagaattcctagagggcaaaatcagatctagacttggtgttgcatttatggaggagcgaagcacagaccccctttgctggagtttgtcacacgaggagcttctcaagactccaggggaacaatagtgcctctttgctgctggtgtggtcttgtggttcttgaggaaagcaatggttttgctaaagttattacaaatatttaaaaattattcagttctaagtttcaatgtgtgtttttaaaaattacttcactctagcttaataacatttccaaagaaatctctaagaaaaaacaagacttctggagggagctagataagaagggctgaggagaagataggtgatttccggctgccatgtcattattaaccacgaatagaagaaaagaaatgcacaaggaataaaattaatgtctttaaaagatatggatacatgttaacatcaaagaattttgagctcaggatatgtattttacaattt

SEQ ID NO: 125129 - DNA, 306 bp, Homo sapiens
actagtccacggttggctatagtccacgaggtactagtccacgtttggctactagtccacggttggctactagtccacggttgtgatactaggtgcacggtcggctactagtccacggttggttactagtccacggtgggctactagtcacggtcgtgtcaattccagtccagcgtatactactagccaaccgtagactagttgagctcgatgttttcgaggctcacccatgtgtcagtgcatcattcctttttatggccaaataatattccactgtatgaatagcctacattttgttgatctact

SEQ ID NO: 125130 - DNA, 344 bp, Homo sapiens
tttgtttttaaataaatactcactgatagcctgggtctatgacaaagttttaatcgtcataggactacgaaaaagcattggcatttcttgtgtttgacagtcaaagcccaaaggaggcaattatccttgtatttgtgcttcagttcctcagctaattgttttaagcaaaaccttacgttttgatcccatgtgttactgtgaaaatattagctgtgtgtgatatgtttattgatattagtcttgtgaatttatgtttagttttttttggattgaagaagggaggggccatccttaatagatgttattagtccgttctcacgctgctgataaagacatatacccaa

SEQ ID NO: 125131 - DNA, 358 bp, Homo sapiens
ctgggtgagaagaggccttggaagggagagatgggggggcgggttgtaaggggactccagctctgggcacagcaggggctgggaaccactgtgggactcttcggctttacagggggtcccatcctgctcccatccaggcgccctcgggcttggcagcatcatcacagagaagtggaggggctggatcacaggtactggcagccaccatcccaggcacatgccctcctcagccctacatggtgactttgacccacttcacagggcacagaacagaactaggagagggaatccgagtggctcgtctatagggaaagaaaccaaagagaagtagatggctcccttcccgtgatggagaggc

SEQ ID NO: 125132 - DNA, 553 bp, Homo sapiens
gcttctaggagcagtgtgaaggactcctgggttgtttttgttttgtttgttttcttataggcaatttgaagtaggtgctttgtcttctagttatgttgagaatgtggttttcatgtgaccagacttcctattggtgtggctgtggaaaatcagatgtttttatatattattggtgggaatgcaaactgatacggccattttataggggaattttccaatatctaaaaaaaaccccacacatacgcatttaccctttgatccaccagtctcacatctagaaatgaactctgaagatatacctccaataatatgaaaatatacagtacaaggatattcaccaaaacattgtttgtcattgcaaaagactggaaaccacctaaatgctcatatgtaggacttgctcaataagctatgttatatccaaacagtggagcattatgcagctctgaaaaaagaatgaggaatatctgtatgaactattatgaagtatttctaggatatattattaagtgaaaaaagtaaatacaaaagactggtatgctacttttcatgt

SEQ ID NO: 125133 - DNA, 709 bp, Homo sapiens
agacccagttcccgaccacgcctttccctccacacctccctgcaagctgagggagccggctccggcctctgccagcccaggaacgggctcccacagtgcagcagcaggctgaagggctcttcaagcgtggccagagtgggcgccgaggccgaggaggcgccgagagcaagcgaggctgccagcacgctgtcacctctcgctgcctcagactctggagtagctgggattacagtcacgcgccaccacgcccggctaatttttgtacttttaatagagacgcggtttcgccatgttggccaggcttgtctcaatctcctgacctcgtgatctgcctacctcggcctcccaaagtgctgggattacaggcgtgagccaccgcgcctggccgatctgatggttttataaggggcttttcgccgcttcacttagcactcctctgtcctgccgccatgtaaaggacgtgtttgcttccacttctgctttgattgtaactttctgtaaaaaattacagcagtgcagaaggtctactggattatggcctccagttccatccatgttgctgcagaagctataattttattcttttgaatgttctttctggctgtaagtctctgatgttggcaagtgacagacccctatggccaatgaatcacaacttaaatgagtaccaagttcccagctgatatgtgaaaaggagctcagtgagagg

SEQ ID NO: 125134 - DNA, 389 bp, Homo sapiens
ttcctcctccagctccatcagctcctctctcccctcctccaacttctctaacttcatctcttcgttgttctccttctcttccaactccctcaactcctcctcctcttttccctctccagcttttctaattcctcctctcccttccacttttcctcctcctccaagtcctcctcctctttcaattcttccaaatcctcctcctccaactcctccaatttctccttctccagttcctctttctcctataattcctcctcctcatgctgctcttcctcctgtaactcctcttcctcatactcttcttcttgtaactcctcctcctcctctagttcctcttcctcctataactcctcctcctcatgctcctcttcctcctataactcctcctc

SEQ ID NO: 125135 - DNA, 534 bp, Homo sapiens
cagcaacaaaattcaagaacatgggcatgaggtagggtttggcactcaaagctagcataaaggaacagtcatgaaatgacattttgacatgcagactttgagcaaaactagggcataaacactgatccatgggagattctgccagccctctgctctggtttaagaagcatttctcttgtgggttaccaggaataagcaagactcagctctgtagttgcagatgagtgcagtaggaggtcaagtgctctggagagtcccctggtttcccaaagcccctcttagccccacctgaacctgaagtttgagtaaaaatgagctggatgacgagtgaagattagaaaggagggccagggtgagagtgtatatagtgtggtttggcaataaaggaagaggtataggcagacatgagtcaagagaaaacatagtagtttatagcggggtgtccaatcttttggcttccctgggccacattggaagaagaattgccttaggccacacataaaatacactaacactaatgatagctgatcaact

SEQ ID NO: 125136 - DNA, 435 bp, Homo sapiens
tggctctgccatcagacagatctgtgttctacttctatccctgctggtcactagggattacttattctctccaccacagctttctcatctgtaaaatggggacaataagagtaccttcgtaatagggcagttgtgaggagtaagtaagatgttacaggatgagtacttaacagacactgagtagtaaatgttagctcttattacaggctacaggaaagaacttttaggaattagttgcagcaattcatggcaactagaactatgtcccattgagctgtcagaagtgtcctgagggatcacaagatcacagagttttattttattctttctgaaaagaaaatctaaggggagtttacccagtctgtatgggagccatgcagatgattcagtttggctctttaaaagaactatttttaaaaatagaagtaggactgc

SEQ ID NO: 125137 - DNA, 375 bp, Homo sapiens
ttgaacttgctgtctttggcagtcatgtccttgtcggctagggacaggtcaccctccagccgcacactgtccagcttggctcccggggcctcgacgtccacctccatgctgggcagagacacctccacgacgggggtcatcacatccgccttggggcctttcaggtccagcttggggcccttgacatccacctgggggcccttgagggccactttgggcatcttcaaacagggcatctgcaccttggggaggtgccctttgaggccggctcccttgggcagggggccctccgggagtttcacgtccacttggccagcctggacctccaggtcggcggaaggggactgaatgctgaggtcagtggtcttgaggtcc

SEQ ID NO: 125138 - DNA, 745 bp, Homo sapiens
tcgagtcacccgctgcgaggtggaatcgttggcagcaggcggatctgcacgagtgaaacgctgatccgatccgtggcaggacggcgagccgttcgccgtcctttcaggctatagccccaagtggctcccgggacgagtagatttgtgcttttttcccagggttaggttttataatacatgggcctcaggactaggcacagcattgcattgacttgagcttcagtttctgtacttgtaacatgggggaagcataatcctcgccctgccgtattctacagtaacctctgtaggagtaattaatgttacttgtagacaaagatggaggggggcaatccaagagcttcaaaaattcagtgtcaagtcatattcagaaataaggctaatgatgaaaatatgattatcagctagaaaagcaattgggctctagttgggagaacttgtttctggtcccaaaatactaaacaggactgtggtcttggccaaacgaaatggcctcgtgtcctcaacagtataagaggtcagcctgaatgacctctcaggtcctttgcagctcaaaacactaatgtttctctgaaaaatgaccaacatgcccatgacccagcaaaggcttcaattctcagatccttgggtgggacaatgctgagagatgtcctgtgggactgagcgccaggtgcccacagaggtagtagactcttcattaacactccctgtgaaagtaggggagtcctctagagtcacctcatga

SEQ ID NO: 125139 - DNA, 318 bp, Homo sapiens
aaaaaaacaaggagggagaaaaacaaaagaaatgctaagagcctggatgctccataggttctataattagcacttgaataattacatgaatccatgtacagggattacagggagaagcctccagaggccccttatatatggtgactgccatatgctaattcatgtgtcctccccggtggcacattccaaagtatgaccaggaacctacagcatccaaacgggcattcagtgcagtccatccagaatggactctcttcctaggcagtgaggtcagctcctgagggagggaggcttccatagaacatcttgctttctttt

SEQ ID NO: 125140 - DNA, 197 bp, Homo sapiens
aggagacatgcatggcgtatcaagagcaaaaattcaaagaaatgggaactagtactcagagacatttttgatctcaagggttaggggcctgtggtttggtgtagagcttggacctgttcatccatatagacctgtgctaatagggtaagcaagcactaaccacatgtggctggttcaagatgagatgtaatgtaagt

SEQ ID NO: 125141 - DNA, 222 bp, Homo sapiens
gctataaagcaaacctcaacaaatctcaagactgacatcatgtatacatgcactctgaccactttaggatttaattagagttcagtaacaaagatttttaaaatatctgaatgttcagaaattatgcaatatacttctaagtaatgtaagtgaaagaaaacatcaaacgggcatgacaatttgtacctatataatctcaactactcaggaggctgaggtggg

SEQ ID NO: 125142 - DNA, 367 bp, Homo sapiens
tgtagggattacaggcatgagccaccgtgcctggcctcaacgcacatctttgagaggggctgggctctgtgctggtgatgcagtggtgattaagacagactgcacttgtcagcagtttacagtttacttgggggagaaagaccatataagcaaacttaaaactaacataacttcaatgttcaataaatacaatgaaggaaaaagtcacaaggggctagcatagagattaagagagtaaccctcttggacaggatggtgaaggaaagcctcctcatgcgttgaccatgagcgtgaatgcacaaggcctggagttggaagcagccagacatggggagagcatgcagaggaatgccagatggagggtagg

SEQ ID NO: 125143 - DNA, 364 bp, Homo sapiens
aacccgtcctcttcctccaactgtaaagtaagattatgaagcagaatcaagagcctacactgaacctcaaaagggaaagcccagggttggggactcccagtgcagcatggtcaatggtgccaccccaataccacctgcaccaacatcaccttcaatagcaggacttattcccctgtggctccataaactgggcagatcaatggagaaggtgcagcctgaaaaccctggaggcatcccctagaatctgggccccaaattcctagcttggaatctcccccacttcattatgttcttaccccaggcataacagttctgctgctgatcaatccaataggtctgctgtacctaagagctatgatgcact

SEQ ID NO: 125144 - DNA, 584 bp, Homo sapiens
tgtgtgaaggagctcaactgcccgccctgtgactgtgcatgcatccctcccgaccctgcagttacagacacagcaagacaaccaaccatattaaattccacatatatatggtgatccaagtccataagctacctacctgaagacagctatgatgttcagaggcgatgacattctccaatcgacaaggaatttagtcagtacttgttgaacaactgatactgaattctatgtcacaataccttgcacaaacttatttatgttgttatattttgttgtagttgtaggctcacagaaaatgagaattgaaagaaatgctggaacccatttagtccacttgcttgcaaatactttcagctctgaagacctttatttgaaagtttatatggaaacctaatatatacaagagagagacttgcagcactttgaagaccttaggagcctaagctcagccctctgtgacaggtcctaagtgccaagaatctttcagaaacactgctcgaaaaccattgttcaggttcaatcccttcattttctagaaaaagaagctaaagcaaggctatgaggcaagttagcgcagaactaga

SEQ ID NO: 125145 - DNA, 530 bp, Homo sapiens
tttacttttctatattttccaggacaaccaaccatattaaattccacatatatatggtgatccaagtccataagctacctacctgaagacagctatgatgttcagaggcgatgacattctccaatcgacaaggaatttagtcagtacttgttgaacaactgatactgaattctatgtcacaataccttgcacaaacttatttatgttgttatattttgttgtagttgtaggctcacagaaaatgagaattgaaagaaatgctggaacccatttagtccacttgcttgcaaatactttcagctctgaagacctttatttgaaagtttatatggaaacctaatatatacaagagagagacttgcagcactttgaagaccttaggagcctaagctcagccctctgtgacaggtcctaagtgccaagaatctttcagaaacactgctcgaaaaccattgttcaggttcaatcccttcattttctagaaaaagaagctaaagcaaggctatgaggcaagttagcgcagaactaga

SEQ ID NO: 125146 - DNA, 393 bp, Homo sapiens
aagggaatatatttaaaatttttttaaaatacaatttcctatatttcagtttcagaactggttctaaatcactggatctgagcaatttcgctagaaatgctccctaatgacctgccctgagctaatagcatcgagatcattgattagacacaagacaaggagcccaggacacagggcacagctaagctttcacagctcagattttcagcctttccatcaccacggtggaaggggaaaaaaaatcctttcagttccctgaaggatgtgttcttgcacataaattggcatttaggttcaattagatactgaaggcctggtcctttaaggccagccgggtgggttgcggctagatatgcctcggcgcctctcctctgtcctattactgggcaagtg

SEQ ID NO: 125147 - DNA, 441 bp, Homo sapiens
tgacttttcactgggattacttgattaagatggtgtctgctaatttcatctactgtgaaattactcattttccctctgtaattaataattattttgcatgcaggtgctttgaaactatgtaaaatccctttcctgatcacagttttagttaatttatttgtatcagtgtgtgcttatgagcccgtattttattcagtgagctgtaatccgttactattgtaacttattttggtgcccatcttgtccctgattttgccagcagtacccccttcagtatctttttgacatgtcatcccttgatcatactgatatctctaatttcattccaatcctataggcttcaattatatttccttccctttttgtacctcctcttatagtgagaaacctgactaccatgatccttagtgttactttatttgatcattctccctgtatgta

SEQ ID NO: 125148 - DNA, 437 bp, Homo sapiens
ccggagggtatgagcaggcgcaacgaaagcaagagagatgcagaggacagtagctgcaagaacagcagccccaggatgagagctcatgtagactggtcttcagaatccaagttgggtttggttctcttcagttaatcttctggtataattttcatctcacatattttagtagtagatttcatctcaagaaatttaatttgtattgataaaaatatctttcataattctacctttggaatatatagactacagttataatttttaacgtccttgttttctaattctaacatctgtttcagcttagggttggttttgactttttgacttttgagtatacacgttcccttgggcttcagagaggttcaactttggccttcagcctcttcatactcatctggtgattttattaacttttacaaatttcacctcttaacttt

SEQ ID NO: 125149 - DNA, 123 bp, Homo sapiens
ctggctgtttctctatttatgactgattttcgacaacttgaatattatctggcttggtgtgactttctgtgttactcttgcttcaggtttattaaagttctttgacagctcctccctctccca

SEQ ID NO: 125150 - DNA, 591 bp, Homo sapiens
ggtgatccacctgccttggcctcccaaagtgctgggattacaggcatgagccaccgcgcccggccacagatctcttttcatccttttcttactctgttgtttttgcagcattcattactgttgacccctctccttcttcaaatatttggtgacgctatacttttttacttgctttcctggctctttttctcctgcccattcttcatttatatatttttttatttttattttttattttgacacagggtcttgctctgttgtccaggctggagtaaactggcatgatcatgactcactgctgtctccacctcctgggctcaaggctcccaagtagctgggactacaggtacacaccatcacatccagctaattttattttttaattttgtagagatgagttcttcctgtgttgcccaggctggtcttgaacgcttgggctcaagcagtcgtcctgtcctgccttggcctcccaaagtgctgggattgtagatgtgaattactgcacctggcccctgtcctttaaatgttcattttcctgaaagtttctgttgtattctccctatctctcgttcttaaacctagtggcatatg

SEQ ID NO: 125151 - DNA, 480 bp, Homo sapiens
aaagaaagagaaaccggcaacattttatctcatttatatgcatctcacttttatccacaaagacttcaggcagctgttacaccaggaactaaaaccattaaaatctaaaacttggccaggcacagtggctcacgcctgtaatcccaacacttttgggaggatgaggcaggcggatcacaaggtcaggagacagagaccgtcctggctaacagagggaaaccctgactctactaaaaatataacaattagctggacgtaagtgggcgtgtgcctctagtcccagctactcaggaggctgaagtgggaggacagcttgagccccgggaggcagaggttgcagtgagccaagattgtgccactgcctccagcctgggtgacagccaggtcctgtctcaaatttaaaaagccaccctaacaagccaagtcataaatactaaaggtgtgttttcatagagaatcagaaaattgagacccgtctcc

SEQ ID NO: 125152 - DNA, 302 bp, Homo sapiens
tatctctactcaagagtctcttctgcccagcctggggatggggacgcagctactgtcgcccaccccgtcataatcttttatctggactatcgaaggagtctcctaacaggtctctctgcttcttccttgcccagctagtgtctgttctgaatgcagcagctgaagtaaacataaaccaagagtcaaatcgtgccactcggagctacatcaggtctgctcaaatcctccagccgctccccatcgcacagaagattaaaccaaatccctctctctgttatccaaggccctccccactctgctcg

SEQ ID NO: 125153 - DNA, 641 bp, Homo sapiens
caactcattagaaaatttacaaatgtaccatattaacagattaaaacagaaaacatgtggtcatcttagaggcagaaaccatttgataaaattcattagccatttatttccaaattctagcaaacttggaataatggcaaacttccataacctgataaagggcttctaaaaggaaaaaagcctatagctaacattgaacttaatggtaaaatattaaaaattgatcctgtaacatcaagagcaagacaaggataccaactaccagcacttctatttgatgatgtaactggtgatcctagccaatgcagtaagacaagaaaaagacaaagtataaaggactagaaagaagacactaaatagtcatcatttgcaggtgatgggattgtacatagaacatgaaaaaatttcagataagttattagaattaagaattatttgaattattattagaatcaataattggaatgacttctaattaacagtttggcaagattgctgggtacaaaagagtatacaaaagtttctctgcataacaataaatagatttctatgaaaagtttaaaagatactagttcctagaaataatgcttagttcctaggaataaatcttacaaaagttgtacaaatatctgtgggagata

SEQ ID NO: 125154 - DNA, 697 bp, Homo sapiens
ttattaataagttattaagccaataaacttaatttttattaaatatccacatgcaccatattggacagtatgtttttaaaggatatacttaggacaggatgaaattgatctcaaatcacaaaatgaaatgtatgaagagtaaattaaaggtaaagaaaatgatacatatttagagaatgaaaatgaatatggattgcattaaacatagtaaaaatgtctaatggattaaaaacaagggtataacaagtaggataggtagagtctaggatttaaggtccttgtcttacctagaaggatagtaatttaaaaaaaacctcttatggaaaattttaaatatgtaaaagagaagagtataatgaatccttatgtatttattacccaccttcaacagttatgaattcatgactaaagtgtttttatatatatcccaagtattttaaagtaagtcctaacaatcacattatttaacccataaatatattgttcttataaaagatatgggcttaaagtataataccagtatcatatacagaaaaaaatcaataatttcttagcattatgtagttagtattcacattttcccaattatctaaaaaaagatttaaaaaattatatttggtttcttcaaactggaatccaaacagggtctacatattgcattttgttgatgtgttgcttatgtcttttaaaatctata

SEQ ID NO: 125155 - DNA, 480 bp, Homo sapiens
tggtatatgtttttgtgatctgtccctggacatgaatctcatcctttaggatactggactggaagtgaagatacttgaatctactttttataaagaaacaacatgggatgattctatcttgagaaaaataaagcagatttggaaaagaactttaaacaacctctagaaataaaagtcactgaaatgaaaaagccaaacagattacagtagattacatacaaagacagttggtgacctgtcagatagatgtaagaatgttacccagaatgcacagataatgtgacagaaaaaatgaaagaagagttctgaaaggtctcacagacatctaagaaaaaaattccaggctgggcatggtggctcacacctgtaactccagcactttggggaggccgagaagggtggatcatctgaggtcaggagttcgagaccagactggccaacatggtgaaacctcgtttctactaaaaatacaaaaagttg

SEQ ID NO: 125156 - DNA, 854 bp, Homo sapiens
tttggatagtatctacagtttgcattgtagatactggatacttggattggctggtgcaccctgtttgtgagactcactggagtttgaagagatgaccactggaaaatatccctaagcagtagctgcaattccacccccaccttggagagccaaaaccctcttcgttttcactctcctgtccttggtcttaggctacttaaagcagcctttagacatagggaaaaattgaaagcctctcttttaagaaaagcattaggtacttctggaatagagagttcaagaaattaggagaaaaatgaacttttgaagctttttctttcccttttttgtttacttcattctcttactcagttttaaaatgctggtaatggtcttttttttcttttttttttttcttgggtgattttaatgctttgggaaaagatctcatggttttatctccaaaggaggaaattaatttggatgccatggaaattagttttctagtcgtatgccttgaatgagtgaagaatttctttttcatggtggtactaaatttggggaaagctatagaaactttcatctggaagcttacacttttcctctttttgaaaatttggtgagagacttggatattttattattttctgtaaaagagtgtaatttgttgtacaggtctaatattgatccttttttggaagtatggaaagaatctgagtataaagcagaattacctctggatggcatgtattctcaaggacactgtcacagtgaaacagtttatttagaagcttgtgtttccaaagtgttgaatttgatattcacaaaattggcatgtgtaaactttattaaactttaagctatttcctaagatg

SEQ ID NO: 125157 - DNA, 427 bp, Homo sapiens
ggactctgcgtcctcattggctccaggaccagggggtgcagccaatcagagctcatcttggctgaacacggacggggtgatttgtttccatgttttctttctttttaacaaaaatttaattggcaagtaaaaattgtatatattggccaggcacgatggctcatgcctgtaatcccagcactttgggaagtcaaagtaggtggatcacctgaggtcaagagttcaagaccagcctgaccaatatggtgaagccccatctctactaaaaatacaaaaattagctgggcgtgttggtgcatgcctgtaatcccagctactagggaggctgaggcaggagaatcgcttgaacccgggagggaaggttgcagtgagccaagatcgcaccactgcattccagcctgggcgacagagtgagactccatctcaa

SEQ ID NO: 125158 - DNA, 910 bp, Homo sapiens
gtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaaggaaatagatctgtgattaaaacacacacacacacacacacacacacacacacacaccc

SEQ ID NO: 125159 - DNA, 182 bp, Homo sapiens
aaggcattctgaagactctatctgcaagaggaatttttctgttgtttatagctatcctctgtagacctgatcctgaaacctatttcccaagtagtaacctttatttttacattattgagcctgaatgctgatcatagactttccttgcaggtggtgctaaatgagaatgttgacacatttat

SEQ ID NO: 125160 - DNA, 1236 bp, Homo sapiens
ggaggtctttaagcaaagaaaatttgcattttagaaaacagctatagtgaatatttgacattgttagtaatttagggtctattccctttttaattgaaccccaatttatttggagagcttttccaatgaatgtttcaacttggtaaaaagtaaatgcctcttaaaaaagaggttctgggccaggcgtactggttcatgccttgtaatcccagcactttgggaggccaaggcgggcagatcacctgaggtcaagagttcgagaccagcctggccaacatggcgaaaccccacctctactaaaaatacaaaaattagtgggatgtgctggtgcatgcctgtaatcccaactactcgggaggctgaggcaggagaatagcttgaattcacaaggtggaggttgcagtgagccgagatcgcaccagtacacttcagcctggctgacacagccagactccatctcaaaacaaaaccaaaaaaagaggttcctcgctggctgtggtaagcatggtgtagtcccagctactcaagaggctgaggcaggaagatcacttaaagcccaggagtttaaggctgtagtgcgttatgattgagcctgtgaacagccaccgtactccaacctgggcaacatagcaagatctcacgtccaaaaaaattaatttaatttattttccaataagaggctcctgaagagacgttccatcacacccttcctttcatcaccacagtacatacattcttaagaaagtatgtgatctaagcttggccaattagatgctgttacatttgaattttgaatcaagagacacaaagacaatacaaattgttacagtttatgcaggccataaattattttttactttttggcaaattgttacagtttatggggtctacaatttatttttttattttctggcttaagttatctaggatttgtttctgtggtttacagtcaaagaacccaaagaccagatcactcttgactaccataaaaatgattaattataaagggatacaagaaaaacaggaggctgggcacagtgtctcatggctgtaatcccagcactttgggaggccaaggtgggtggatcacttgaggtcagaagttcgagaccagcctggccaacatggtgaaaccccatctctactaaaaatacaaaagttagccgggcgtgatggtgggcgcctgtaatcccagctacttgggaggctgaagcttgagaatcacttgaaccgggg

SEQ ID NO: 125161 - DNA, 517 bp, Homo sapiens
tcgctgaggatcccgatcagagcatacccctggtctaagcttggccaattagatgctgttacatttgaattttgaatcaagagacacaaagacaatacaaattgttacagtttatgcaggccataaattattttttactttttggcaaattgttacagtttatggggtctacaatttatttttttattttctggcttaagttatctaggatttgtttctgtggtttacagtcaaagaacccaaagaccagatcactcttgactaccataaaaatgattaattataaagggatacaagaaaaacaggaggctgggcacagtgtctcatggctgtaatcccagcactttgggaggccaaggtgggtggatcacttgaggtcagaagttcgagaccagcctggccaacatggtgaaaccccatctctactaaaaatacaaaagttagccgggcgtgatggtgggcgcctgtaatcccagctacttgggaggctgaagcttgagaatcacttgaaccgggg

SEQ ID NO: 125162 - DNA, 382 bp, Homo sapiens
gtgattgggacactgtactcctgcctgggtgacagagtgagaccctctctcaaaaataaataaataaatacatccccgctcagccacttatcagttacgtagatacactgcctaaccttagtgaaccctgtttcgacaactccaaaatgggagtaaaaatcctaaacttgtacagtggttttttagttttgttaaaagtacaggtgaggtttttttcagagtattggttgccatctgagagtgatcccctttcacctcctctaggacttttagcattttctggagacattttggtggtcacagctggggtggtagagtgtgctattggctaggggcttgaagccagtgatgctgcttaacatcctatatggcacaagacccc

SEQ ID NO: 125163 - DNA, 450 bp, Homo sapiens
agaactttacacagaatgtgctgaactccttgctcctaccaccttctaccactgctccaacataagaaaatgggtgaaatctagccaagtctattccaagtagagaccttggcataaatgtgagacatcccaggttcctctgaagtccctgcaacattgtgactattccgactggcagacaggatacatgtgctgaaaggtttctccagccagagtacagaagcagaaaccttctctgttgccatatcagtgatattggtaaattctgcacttgacaatacagactaggtttaccactgctccacaagccaattcttcaaagacataaaataggattctaatacaatacgattctaataccagccccttacatttttagaatgcttttcatatacactattgtttgatccacagtctgttagaaaagtagaaaagttgctcttcttcctt

SEQ ID NO: 125164 - DNA, 702 bp, Homo sapiens
gaataataatccactaaggtcatcacagaagttttgtgataattatgaatgtcaactgagaggatatacaggaaaactttctttgaaatctaaaacataaaaaaaaaagttttcatgcaacctctgtgtttatgtattactaaaagttgtaatttggtagtatcctttggcaaataactttgactccatttcccatttctgaatagtcattttttaggggaagtaacataaaggaggaaatatgtattatgaaggtggttttggaaatattatttgtaataccaaataattaaaaagacataaatgctcactactataaaaaagttgaagaaaattttatacatatataatcttaaccaaaagtgatgtaaccgtatcaaaaaataaatgtatgatgctaagtaaaaatgtgatataaagttgaaagtagagtatgtgtgtagataagaactagaatagaccgtcaataataaaaaaaacattttagagatggacgacataggaattaaactttttttttgcagtttaatcagtgctgacatatgacgtcaatgctgactacgtacagtctgttacatatacacacacatatatacatatatacgaattctgagggcaagtgataggagaataaacaaactaaaatgcaattgcagcagatatattgtgacaaaaaatgtaggaaataggaaggcattcaag

SEQ ID NO: 125165 - DNA, 294 bp, Homo sapiens
atgtgggtggtgttctagaggatcccaactcaggggcgagctgcagctcagggcgagctccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgc

SEQ ID NO: 125166 - DNA, 1088 bp, Homo sapiens
ccaaagtgctgggattacaggtgtgagccaccgcacccagccaagcaccactgatttttaaaaagcagaaaactttgaagttaaaccatttatatactccaaataagttctcttggtacgtatttcccaaggacatttctctccctgggtaatggtaggtgtttggtctttggtcacgaaattcatctgtaattaagtatgtggctcattttattcaaaaactgtaaaaggaaatttaattattttgacataagaaagaaaaggcttattctgtggcctgatttgctgaaatgtattcagttttattcatgtaggtcaatgattggtgtctatgtggaagacgaagtggtgtctgtgctgcctctctttaggagctgccaacagggagcacctcagacctgcacctgtggggtgttccatattgaagcagatgatattatagattaataaaagcaaacacaacagaatgggtacaaaaaacatcaacaaaatagataatttgagaaaaatatccgtacacctcctattaatggctcccagactgtagctctgagaacaaaatcctgttatatttgatggtacagacacgttactcatagaagcaattcattcactatgggtttcatgttatggaagaagccactcttcctgggccaggtacctcttcatttggtttaggaagagatgaagatgtctgtcactctgactgatgtccccgtatgtgtggaatgcctggagtggagtcctgcctagcacacgcctttcttctgcgttcttgggctcaggacttaatctctgtgcctcagttccctcctctgtgaaatagaagtaatagtggcatgtggctcacgtgcatgaaataaaatgagccatgaaataaaatatgcacaatgccagcagcatagtaaatattcactgaatgctactgttatatttaccattaaatgttacggattcagaaagtatatttctatcataccaaaaattgtaaaaaaataaaatcaagcaaatttttaaaatttattttcatttttttgagatggagtcttgctctgttgcccaggctagagtgcagtggcacgatctca

SEQ ID NO: 125167 - DNA, 545 bp, Homo sapiens
agaggtgtccctggtagaggaatgcaatcaacctacagcagcatggccaggaaggagccaaaagaataaatatccttattgaaccccttggatctcccatctcctgatgccagtgcctcccattaggcagcctcagtcagagccagaaggcaagggaactgggtggatgctgtccacggagggcagagcctctgtggggcagagctgcctgaaggaggatggagggtggatctgcggagcgaatgggaacagtctcacagagtcaagagttgcaggtcacttggattataaggacgtttctactttagaccaaaagaggcttttgtgtatgtttgagtgaaactttgcattgtgaggtcagctacgtagatgtgccggctgtgagggatggtaggagcaacggagatcccagtccttttcagacttgaaaagacccagggaagtcaagggatttgcccaaggccactcattaattcatgaaagtgtttctcgaaagccccttacattttctcgggaaaaacaacacaaaacatttgaaacagttt

SEQ ID NO: 125168 - DNA, 700 bp, Homo sapiens
caatttgttcaccccccagagttaagtctgaaatacacagactcttcgtagacccagagaatgtgtttctcttgatttagggaaatgaggtagacaggaaaagagttaacaagatgattgcttgatttttatctcaagttataatttcagctcttcatgattggcatcctctagacattcgccatcctttaggactgaaggtatcactgcaaatatttatttgacaagagtatggtccactcaccataaagcctcagccaagttctctcaacatctccctctctcgcctaccctgaccaccaccttccgatttttttttttttggcaaggagacccttagtcttggtgagatttgtgaattaatggtgtgaggctcttcacatggatgacaaagctggccaatatgctttctgcgaatctgtgaaatctaaactactttccctgccagaggacaggtgctcccatctggcgctctaccttttctccccagggagcctggcacgcaagtccttagcatagcaaggtaggtctatacagcagcctagagagcagcaccagccatgactgaagaaggcagtgaggccccccgactggattttaggataggatagaaatcaccctggctgggcgcagtggctcacgcctataatcccagcactttcggaggctgaggtgggtggatcacctgaggttgggagtt

SEQ ID NO: 125169 - DNA, 291 bp, Homo sapiens
ctggtttattctgctttgggctgtggttcctgtcctcctgccagctcctgtctcctgcccctcttgccttgctggccccccgctatctcagcctggggggccaccacagggctctaaacagcgctttgcattcccaagacacctgctgccacacaagccagtgactggagacgtcccttggttcgggccctgcccgctccacctttagtatttcccagtctcaggagcgtggctgcacctgagtctccctgaggccccgaacttagacacagaagtccagctgattgcctt

SEQ ID NO: 125170 - DNA, 452 bp, Homo sapiens
tcggcctcccaaagtgctgggattacaggcatgagccaccgcgcccagccgcctggtgcttttttaattttattttttatttttgagacaaggtcttacactgtcacctaggttggagtgcagtggtgcaatcatagctcatcactgcagcctcgacctcctgggctcgagcaatcctccttcctcagcctcctgagtagctgggactacaggtgcatgttaccaggccctgctaatatttttttttagattattttttgtagagacaggatctcactgtgttgcccaggctggtcacctggtgcttttatctgcaaagggacattgattcctcaccctggttcctgaaggcagacagtagatacccctcttggaagtttggggaacaggctcaggagctgtgtaaatatgcccaagaccacaggatcggactgccaactccaaagcattgc

SEQ ID NO: 125171 - DNA, 464 bp, Homo sapiens
acctccccctccactccactgcctcgaagctggtcaggccttggctggtgcccccaggtctgaggtcaggctctgcaccagccgccctacctccaggcctgtcccctctcagccactacgacagcaactcccctaaaacaccaactcattattgaattccgccacatcaccctgtgaacaacgatggcgccatccacctccttacatacctcgaactttccagaagttagaaaataacctcagctgggcgtggcagctcatgactggaatcccagcactttgggaggccaaggcatgaagacggcttgagcctgggagttcaagaccagcctgggcaacatagtgagaccctgtctctacaaaaaataaaaaacttccctggcatggtggcatgtgtctgtaatcccagctactcaggaggctgaggcagaaggatcgcttcagcccaggggttggaggctgca

SEQ ID NO: 125172 - DNA, 334 bp, Homo sapiens
tccacaacaccgatttttgtaatgtttcctttctttgtttcactttgactgtagaagctggctaagatgcattggcactagcactatctattgcatgcaaaagttttgctcaaaagaagtgttgatgttggagctgtgagaaaagcaggccctacgttgcaggacttgggggaagaatggaatgtgaaaagctcactttaaaatggtaggggtttgggtgccaggcaggagcagtggtagagcatttcagagaccagtccgagcctaatgaggtctgccagggctctgggcaggcgtcaccagctggctgtttgccactcctcttgccctccca

SEQ ID NO: 125173 - DNA, 472 bp, Homo sapiens
ctaaacgctttatacttcaagcttccgatctcatttttaaaaggaaaaaaaaattcttacaatggtctgtaagacttttctggatctgattgtcaagtcacaacactctttgcttcccatccccacagagaactcttatctcctgacctattatggactgaattgtgctccctcaccccccaaattcataggttgaagctctacctcccaatatgactgcatttgggggatagggcctttaagaagataattaagggccgggcgaggtggctcacacctgtaatcccagcactttgggaggccgaggcaggtggattacctgggcaagagttcgagaccagcctggccaacatggtgaaaccctgtttctactaaaaatacaaaaattagccaggcgtcatggcaaatagcagtaatcccagctactcgggaggctgaggcaggaggatcgcttgaatctgggagatggagg

SEQ ID NO: 125174 - DNA, 528 bp, Homo sapiens
tgaggacccaggtcaggggcgagcggtaactcagggcgagctgctaactgcaggtgcgagctgctaactcaggtgcgagctgccaaggcaacagaaacgtgcactgaatgctgaaagtaaaggggaactgatgaaaaaggtattgggctgatgaggcctggtgtgagccggccagcagcagtcccagccttgcttcagatgctctggcaaggccagtcgtgctgcccagcccttccggaccccactccagccgggagaaaggcccttgtgcccactcctttccacacccctgcccaggtgcatcagatggaggagcctgggtcaaaggcctgccagggatgctaggaaatcacgcatctggcttcagcttctttaacgttattgggtaccttggataccaccaaaagcatcacccaactacaggaaggggccaaacactgggcaaatggagacaataaaaatgtctccagctcattacagcatctatactttagcctatgccagagcattttagaaggttgcgtccca

SEQ ID NO: 125175 - DNA, 737 bp, Homo sapiens
ggaactccttgtggtatgctctgaaatacagactatagaggaaatattttagtggctctacaggatacatggtctctgttgcacctactgaattctgctaccatagcaagagagccaccatagaggatatgtaatgaatgggtatggttgtgctcaaagcaggcattgagccagattgtttgctgacttctctgttaaaccatgaattttaaatgattgcatagtatagatggtacatacatggacacatgtaccatcattgccctttaataaattttattgcattataatatacatatagagaattgtatttattgtctgttgcagtttgatgaattttgtcaactggatatatccgtgacagtacccagggtgtaattgccttttggtagatcggaattgtttctaatttgggacttttactaatgaagctattatgagcatagtacctgatatactttattttattactatatctgcacattggttgtattagttttctgttccttctataataaattaccatgtacttggtggcttcaataaatacaaatttattatcttacagttttgcaagtctgaaacctgggttaaagccaagatgttggcagggctgtggtcttttctggaggctgtcagggagaatctgtttccatgccttttccagcttctagaggacaccaacattccatggcttatggctctttttttccaacttcaaagccaataaccttgct

SEQ ID NO: 125176 - DNA, 368 bp, Homo sapiens
catgacacagacattcaggctacggatcctgtgtccaccgtttactgagagggccgtgggtgagtgacgtggagtgtggcgtaacctccccatgtcgccctctcctagtgcagaaattggagacagtgggggatccctcacagggttgctgggatgactgaatgaggtaatagacttcacagatcccacatagggtctggtacgcagtggtccctcaacagtggacagacattattaggatctggtcatattctgagaacaaagcttgacaagttctggaatcaaatgtcattgtcaaatgtgcctgctcaatgcaattctacttggctactggactctctgcaataatttgtctgaaagagaggcag

SEQ ID NO: 125177 - DNA, 521 bp, Homo sapiens
gtaacccataagcgcgtctggtattgctggtgggaatgtaaaatgatccagctgctgtggaaaacaatacagtggttcctcaaaaaataaatatagaattgccatatcaggctggacgcagtggctcataactcgaatcctagcactttgggaggccaaggcaggagaattgcttgagctcaggagttcgagaccagcctgggcaacatagaaagaccttgtgtctactaaaaatataaaaaattagaccagcatggtggcacatgcctgaggtcccagttactcaggaggctgaggcaagaggaccacttgagcccgggagttcaatgttgcagggagcagagatcacacccctacactccagtctgggtgacagagcaaaacctcaactcaaaaaaaaaaaaaagcaaagagaaagagagagaatggctgtatgacccagcaatcccacttcttccaatataatcttcccatatattggaagaattgaaagtagggactcagaacagatatttgtacac

SEQ ID NO: 125178 - DNA, 527 bp, Homo sapiens
ttgagtgctggtggctgtccagctttactggcagggattctgatgactcagagacagtagctacccttttcccagtggtattgccactgagtgtgggatgggtcacagctatgtctgtggccttttgcaaatcaacttcaaaatttgcagtcacatttatggtaggacagattcatttcacaatgattttgccaattacccttgttatttccactcacatatatctccccaaagtggaaacaaggacacgtctagagacaggcgctggacgtctcctgctcactggcattaagtgggcaggcggcttattgctgagtgatggtccctggacatttccagtcgactgtgtttgacatggtggtgaattggacacgtgacaggtggcaatatgttaactgttcgtagcaaggaagatttgttttcaggctggtggtttgattacaagttggtcattcttaatgccagggagggggaagagagagaaaatgagagagaatgaatgagaacaaatgtaagaactttttttg

SEQ ID NO: 125179 - DNA, 386 bp, Homo sapiens
tggaagctggatcagaacctcacatgtttgcagacaaacttgtctcctcaaagtggcagagccattccaggaaggaaaactaaagcttgtctgagaccggccagaaaggggggagtgtctaaactgcctcacttccacttctgggagaaggtgcttatgatggggagtcggggagcccctccatgttggggttccctgtctacactgttcctgactgcagtggtcaattgtgttatttgcccctagggcagtggttcttgactgggggtgatttttgccccccaggggacatccggccacatctggagactttcagttgtcataactgggcagtgttactggcatctagtgggcagaggccagaaacgcggccaagcatcccccag

SEQ ID NO: 125180 - DNA, 407 bp, Homo sapiens
atctggtgtatcttgaggccagctattagtgaatctgggaaaaccgtccaatacaggggcacatggcaaaattgtgtcatcccttctccttcttcccatctccatggaccccttgcatggaacaagtaggtaacatttgacacaagttctagccgagggttcagattactgtttgtctgaggcattctgacaggcacaagccactaagcattgctatggaaaccattttgttcttctctgctgtgtcatttgttttctggcacggttgcagttgtggtaccgggggaagggcagtggaagaggtacccaaggatcagacacctagtggggcctatgttcctacaggattgtatgaccaaggctaattcctgcttctccctgggtcttgcaatctccaactctcagaa

SEQ ID NO: 125181 - DNA, 311 bp, Homo sapiens
atttcttttctttataaattatccagtctcaggtattcctttacagcaacacaaatggaccaagatactgcccacactggctccttcctcttccttctggacctttttcttccattttcttctgctcccctttcctccttttgatattccataaagtaactttgaatcttgatatgttccccttcaagttcctactttaacatccttccgtctacccctgccagaatccttcactttccacttcagcccctcagtaatttgaactttaagtacccctactctcaagggattcaaggtctcccaaaagcaac

SEQ ID NO: 125182 - DNA, 822 bp, Homo sapiens
gaaatgggtctggaaggtgagtgagaggttggggtggagagaaagacgtacatggaggtgacagtttcagccatgagagtagcgaggatccctaaggggagtgggccagagggcagaaaagaggactgagtcagaacttgggggaatgttcagagggcaagaggaagaaaaagaggattgcatgagagaggccaaaggtcaaaggccagtaaaaagggcagaaccagagcagtgccatatcatggaaatgaagggcagaagggagtaaggacctcctctgcaggactgctgacttggccttagcccagtgctgttttactacagttgtctggctatagtttgccaggagtttctctctgggaccttaaaacaacactgttgggcaggcatgacttgcttttttagtaaagaatttgaggcttagagagactatcactttcctaaatcagccagcaagtgactagagcccagggattcttgaactctccttattacagtgagaatagacggttgaatttggggatcagaaggtcatggtggcctctgtgtttcagtggtaaggatagaggctagactataggaagttggtatgacttgggagggcagcaactgttgctggctatttcactaaaacagagaaggtgggagaaggtgcgccttggcccctgggtgaacagggttggggagtgaccctggctttgggctctttttagggtttgacatcagcgacctctccatgtctgcgtcctccttgtctctcttttaggcaccagggctgaaagctattcagcagcttgtctttccacttcatttagaaaattg

SEQ ID NO: 125183 - DNA, 217 bp, Homo sapiens
ttagtacagtgccaggcacaaacccaactccggaccacagtgtgggaatgaagagacagctaaggtcccaccccctccacccttccagccttcttcctccttccagccttcttcttcacactggagaagcttgttcttgactgcctacatgttgacactttttagtagtctttcaaaattgtcatctccgtaataattttcgaaaaacatctttgga

SEQ ID NO: 125184 - DNA, 680 bp, Homo sapiens
ctactttgtcatattagttttatgagtggatttgtttttatttttgctagaccatttaaaagcaagtaaatctgtgtgcctctctgaagaatagaggcattctcccttataaccacaatcccattattgtacctaaggcagttaacaaatttctattaacattagtaggtttgggtcggacacagtggctcatgcctataatcccagcactttgagaggctgaggcaggtgaatcacttgagcccaggagttcaagaccagccagggcaacatagcgaaaccctacctctacaaaaataaaaaaattagccaggcatgatgatgtgcaactgtagtcctagctactggggttggggagctgagatggaaggatcacttgagccccaggaggtggaggttggatcacaccactgtactctagcctgggcaacagagcaagaacctgtcttaaaaaaaaaataaaaaaggtttgtctcttaaggttttattcaattccagattctactattagaacgctttcttatctctcctctaagtagggagaagaaaactaacatttactgtataaatgtttgaagggcttttgtgtgttgtcttatttaatcttcactcattttacagatgaggaaactgaggcagaccacaggacgggtcgacgcggccgcgaatttagtagtagt

SEQ ID NO: 125185 - DNA, 196 bp, Homo sapiens
actaggatgatcaaaaggaaccaaatagatgggagaaattaagaagtcattatgtatgcccaggggtgggtggaagcctcagtaaagtcatgtactgaataatgatgttttggtcagtgacagaccgaatagataacagtggtcctataagattataatggaggccaggcatggtggcttatacctgtaataccag

SEQ ID NO: 125186 - DNA, 362 bp, Homo sapiens
aggtggcagaggtgggcccaccgcacagggtaaatgtcccggtgtcacatacctccagattgcagggacctgcgtatgctactgctgctgtggaaaccagctctctctggctctggccttggggagagggagccacagtggatttaggaagagtctccagatgtagcttgagactaccaaacaggcctgacccccacagaccctgcctcttatgagcgcccagactgagccctgcttcaggctcccagccatgtggccagctgcttttcttctttaatttttagcatcagacgaatatttcaggaaaatattctcattgtaaaatctcaaacattaataaaatgtagtgaataaaaggccat

SEQ ID NO: 125187 - DNA, 775 bp, Homo sapiens
aacgaaagtcagagaatagtttctcgaatctgcacctagatggcccaatattctataggaacctagatactagtcataaaatactacgataatgccgtaatgtaagtcttcataatcatcatcgaatgcgtgcaccattcaagctgtagtagagctagccgactctttctattctgaaactatttgttccttgatcgttaccacctttctgttttctcagagcttgagtcatgtttctaaaaacatttgaatcacatcacacatctgcttaaaattttttagtggcttcttaacacctttagagtggaatctcatctccttaacatgactttcaagaccctttgtagtgtggtcctgattgccttgccctactcctatccctcccaagaagatactacacttacttgctgtcctccgttttgttcatttttttcttgtgcatgttatcccccccaggtaatttctacttgttctactactccatccagagagccatttactttccccaaatctcctgagtggtcttataagacactgtcatactttattgtaatttcttctgattagaatctcttgttaggtatgttaattagcttgatttagccgttccacaatgtatacatatcacaacgttatgttctatgccataaacacataaatacacacattttttatttgtcaattaaaaaataatctcttgttagattggaaacatattgctatcagatattacctgtttgttttaccattgtatccctagtgtctgaaatattgg

SEQ ID NO: 125188 - DNA, 632 bp, Homo sapiens
tgttagccaggatggtctcgatctcctgacctcgtgatccacctgcctcggcctcccaaagtgctgggattataggcgtgagccaccgcgcccggcctggtctcccatttcttttcctctttccattctgtgcacaccttgccttcccagagcctggccacagatggcagtggggccagggtgggttgagtttagacatgcctgttcattttttccctcctcaaaccatgccagaaccaaagccagctctttaggtcccagagtcttctggacgttgcatgactctctctgtagccatctgctcacttgtccctgccaagaggggacatttgtgcttggggtttccatgtcactagggactcggtttccaccattcattcccttttgccccaatctactttatatctaagatcacagaaatcagaattttgtgtgtatttatttattgtgcctcttcttttagtactaagtgcacagtgttcagtagggcatacagaattaaattacctttgctttctccaattccatgttgactcatgtggctgttaccaaggataaaatatattagtggacaaaatggccttacctcatcccattacctgaaattatataccaatgcttatatttctgta

SEQ ID NO: 125189 - DNA, 347 bp, Homo sapiens
tcagtgcttctacccagcacctaaagaacggcttggcacgtgacaggcatcagtaattactgaatgaggttttagtcgtatccccctctcacttccgtttctcccctttctccgccctccttctctcccctggctttacctccctccaagacagcttttagctcatgcagtggctcacgcctgtaatcctagcaccttgggaggccaaggcaggaggatcgcttgagcacaggagtccgagaccagcctgggcaacatagcgagacccatctctacaaaacatttaaaaaattagctgagtgtggtgcacacagctgtagtgccagctacttgggaggctgaggtgg

SEQ ID NO: 125190 - DNA, 289 bp, Homo sapiens
agtgactatgcttcatatacaaagcaactttttaaaaatttgtgtgcttgttttacagaaagattccttataatttttttattctttttttaaagaagcaaaggcaggcagactataagactaatcagtttggtaagtgagccaaaagcaaggggggaaaaaacagatccaaaagcactggctgatctcattagctttgcttaagaaactttatagatgtgacttcactcctggattacacgtctatatttagtttatacctaatatggataaagtcttgaaccaacag

SEQ ID NO: 125191 - DNA, 372 bp, Homo sapiens
tccctgccacagtggcccttctttccattcctcaaacatgctcacttcttcccattatggtgttctcctgctatgccactctccttcacttcctagtaaccaggacctagtcagtgcttagtcatcattacgacctcagctcagaagtctcatcaggttttttttttttgagacggagtctcgctctttcacccaggctggagtgcagtcgtgtgatctcctcggctcactgcaagctccgcctcatgggttcacgccattctcctgcctcagccccctgccccccgctccctgtgcaaaggctaattttttgtatttttagtagagacggggtttcaccatgttagccgggatggtctcaatctcctgacc

SEQ ID NO: 125192 - DNA, 441 bp, Homo sapiens
ctctttattgtttgctagattccgtgcattgtatctgcggggtggtctgctggtccccaaggtaaaagccaactaatgtgtcaaatatgcattacgatttgtaccttttagagaaaggtgggatggaggtcattctttctgaataaagagaaattccctgagatagatttgcattggtagaagaataaaaactttacttgcttcaaccaaattccaaaatatggccattccattcctgagttttgttagtcaactccactcacaagagccatggaatcactgccaaatctcagtctagagaccacgcacacagtttgactaactcgggggaaaggaaaaggatcactctaacaacagtcacagataatatctggccaagatcaaatacaggatcattacccaagaagacacttgaaaatggaatacagcaataaaaatgag

SEQ ID NO: 125193 - DNA, 172 bp, Homo sapiens
ttgtggaatagacctgtgaattatggtcttgtctgtatatgacttaggtcaaaatttaattgtgagtggaaatttgtgtttagtaacgtgtcattcctatctgttgagcctactaaatgccctctcaaactagagagctatgtgtaaagaatcttatgttcttcttggttca

SEQ ID NO: 125194 - DNA, 298 bp, Homo sapiens
aacatagtgagacctcgtctctacaaaaaaaaagtcaaagaatgagacaggaggattgcttgagcctgggaggtggaggctgcagtgagcagtgattgcaccaatgcactcccacctgggtgacagagtgagaccctgcctaaagaaaaagaaacacttggagacaagatggcatcttccggatccttgcctacagctatgcagggcagccagcagctgtgcattattttgcactctcagccatgaaggaattcaggcaatccttcaggaacctacacagtaaattcttttcttgcag

SEQ ID NO: 125195 - DNA, 605 bp, Homo sapiens
caccggccccagtgacaccagccgctgggcctgagctaagaagccatgcttctcctgaagaatggcaagaaattagcacttggctgggccgccccatcattgctgttcctcacaccttgctgggtaatttctacaagaccaaagcctgagcctaatgggccgcctgcttccagcccggtggacaacatcagggaaagcagcccccagggtttctcacagactaaggggctctgtgctctgctgaaaggatggtgcttacagttgtcaggagagaaggacactctgaaagcttgggatcctacagctgttgggtgagaatgagcaagttaagagtgctctgctgagcctaaaaagcaggaaaacgttctctgcggcaatgggaaaaggagtcatctctgttagtgacttgagtgccaaagagccatgtctgtgctcggcacacgccgagtggtgaagcctccagcgtgtacagccatccaagcagccccaccgagaacagctctgtgtaccatgccccattcctgggcccaccaccgtccaccctcgagccacccggtgacgaacaccagccatcaccaccgcatgggctggcaccccaccagtcc

SEQ ID NO: 125196 - DNA, 372 bp, Homo sapiens
ggcgtgaaccaccgtgcccagcctaatttttgtatttttagtagagatggggttcaccatgttggctaggctggtctcgaactcctgacccaggtgatctgcccgccttggcctcccaaagtgctgggattacaggcatcagccaccgcgcctggccctcaaactagtattattatgactttttaaaaaaacgatcaactgaaaccccgaagttgtttcctcacaagctgtcatgaggttctatttccccatcctgtacttatatggttgcttatctagaccaacgattctctaccaggggtgattcttgctcccagggtcatttggcagagtctggagacatttttggttgctatgggagtgaggggggaa

SEQ ID NO: 125197 - DNA, 311 bp, Homo sapiens
tttataatcttggccacacgtgtctggcgtagacacctgaagttcctcggttctccgccttggtgggtcttctctcctgcgggcacagtgcagatgcagatgagtttcagagctggtcaaaagtaattccatcacctgtaggatgcagaactgctcattctgcaccctttgctagtgccctgtgtgggtggcctcccctgcccctccccatcccttagggcaggtgttatcagccctgttggagaggaggcagctgaaggccacaggggccgcgtgctctgtatcagtcacatgtcacatctgtcaggctc

SEQ ID NO: 125198 - DNA, 728 bp, Homo sapiens
ggattcccgggatgcaggcagcttggggccctaggggaaagagcctggggctcttcaaggctgggctatgaagccaccctcctcccagggttgaggggcagtcaaaatatccccaaacctaatgtgatttctcacctgccaagtggcagcagtgtggcatcggggcataaaagctgctaacagtggggaaaggcctggcccagtgccaagcaggctgtgggcgtccctagaagaatgagcagcgcaactacagcaggagtcccaggccctgggcagagagacacccctttatcgagacctactacctgccaggcactttatttattggtaaatttaatcagattttgaaaaccacaaaatctggatacatttgcattgtggtatttgttgtaattgttggatataattacatatacatgctataaaatataagatagaactagaacaagagttcttaatctggcatctaagggaacccgaaagatcaaaggatagagttcaaggagtctaaaaatttggaagagaaaaaatatatatctttattttcactaatttctacctgaattttagcattctcttcaacgatgaatgtaggcaacaaaccacagcagtattagcaggactcgtgatgatgtcactagcaattacaaatattttcaaatcatataacggtttttgaagatatttcaaaatatggtttatactcatcactatttcaaaattacagc

SEQ ID NO: 125199 - DNA, 297 bp, Homo sapiens
aaaagaaaaagaaaaaagaggtcaaggactccgtccttggaatcctaagaaaattttccagccgtattacccttctatgaagcccacctgtcaaccaacaagcacccactcgatcagagcttccccaggctttttggtgtctcctccttgcatgggaattgacttccaaggaccaccagacactgaggaagtattttaacatataaagcaaaagcaacaatagggcagctggagaaaggaaattagaagtaacagagccaatgcagtgattagaaaaacactcaaaaaatggtaata

SEQ ID NO: 125200 - DNA, 347 bp, Homo sapiens
tatcagatgtaaaaaagggcttttactacataccctacagacattataaaatataataaaggaatactatgaaaaactctacataaggaaattcaacaacttaaataaaatgaaccaattcctcaaaaaccacaacctgcccagactcacccaaaatgaaccaaacagtactatattaagaaattttggccgggtgcgatggctcacgcctgtaatcccagcactttgggaggccgaggcgggcggatcacgaggtcaggagatcgagaccatcctggctaacacggtgaaaccccgtctctactaaaaatacaaaaaattagccgggcacggtggcgggcgcctgt

SEQ ID NO: 125201 - DNA, 735 bp, Homo sapiens
catgattccaaaaaacaaaaagaagagccattggctcaaaggttagatgaagaataaaattcaaaattaaccattaacctgaggcttagcttatattatacaaactactttttcggggcatataaacgctaataagtttaattaatagctgacacgcttttcatgtggcgaagtttcttaaagtattaacaccaattaattgatttacatattaaacagttgtaattctacttagctcaaagtgatagccccatattcggaaagacatgtataaaagaatcctgattattaaatctggactttgatcatgacgccagctttgaaatacatgtttcattgagtccttacaagctatctgacatgctcaaaagtgtatatattaaatttgaatacatcacccatcaaattcttattccttaataaagtgttggtgtctaggtttatttggcacttcattatctctttttgcttccctaaagtgcctgaagagtgcataattatcaagcaaaaatggaaggacaagaatgaaatttttaacattaacccaattttacatttcaaagagtgcagctaaaaattttttcttaactatacctttgcctggtaaaaagacttactctaacaatgctggctgcaagtgacaacataaaatttctgtattcctttattttagcgagaattgtttaacaaagaaatttctaatctgttaaaatagtgagtggttattgtagaaag

SEQ ID NO: 125202 - DNA, 480 bp, Homo sapiens
acagtcaaacttctgaaaactaaagacaaagaaaataaaattaagtctaaatcagtgaaagagaaacaataccaatgaagagcaatttttcaatgatagtaaatttcacattaaaaaccatggaggtcagaaagaagtagtacaacattttccaagtgcagaaagaaaagaacagtcaactcaggatttggtactcagaaaaaatattctcaggaatgacagggagatcatgacattctcaagtgaaggaagactaagagaattttcctagcaggactacccagaaagaatgactaaagaattttttttttggacaaaaaagaaatgataaaggaagtaatcttagaacatcaaaaggaaaaagaacaatggcaagggtaaaattataggtaaatacaatacattgtctttctcttttgagttttatgttattattgttacataaagcaaaagttataatgttgtctgatgtggttttaa

SEQ ID NO: 125203 - DNA, 256 bp, Homo sapiens
gcaaaagttatcgtggttttggccaccaaaaccacgataacttttgcgccaacctaatacaaagggcagcccataattttatttttcaatgacgattggcactaagctaaggaaacagtgagggattttgtttgtttgtgtgtttactactgattggaattgtcatttcttttttccttaggaaacagtagggagatctccctactgtatcctatctctcccagtcctagctgctggcatcactatactactaaca

SEQ ID NO: 125204 - DNA, 294 bp, Homo sapiens
gaaatttttcgtcaccccaaccagaaactctgtatccactaaacagtaactcctcattttctccctgacccctggtaacctctactctactttgtctatgaatttgcctcttctaggaaacccgtgtaagtggaatggtaccgtatttgttactttgtgtctggcttatttcacttagcatgatattttcaaggttcatctgttttctgttttttgaagagtaatttttcaagaattttttcatttataaataatctcagattaacaaatatttcaaatacaatatgaagactt

SEQ ID NO: 125205 - DNA, 401 bp, Homo sapiens
ttctgcagtccccactctaagcccatggttcaccattttattcttcctcctaaaatttcttcccttctggtaagattatctttgccttaacaagggcccttttcatccacccactcccttacccttcccagaagtggttaatgggcacaaaaatacagttagatggaaagaaaagaacttctagtgttcaatagcacagtagcatgacgatcgttaacaataacttaccatgtatttcaaaatggttagaagaaagatttggaatgttcccaacacaaacaattgataaatgtttgaggttatggatatgcaaattatcctgatttgatcactacatattgtatgcatgtatcaaaatatcacatgtaccctagaaatatgtataattgtcatgtatcaat

SEQ ID NO: 125206 - DNA, 170 bp, Homo sapiens
gtactattgtgcaagtatacactgacttttcctggactaaggtcttctccaggaaattggagggaaaataactattgaacacatggaatgagacaggaaaagtttcctttgataataaaagtgttctgattcgacatttcatcggttttcccaaaacttaaccatctaat

SEQ ID NO: 125207 - DNA, 529 bp, Homo sapiens
ctaactctactaggtaagtgttatcatccttattttatataaaaggaaactgaggctcaaaaaagttaagtgaatagacttgttacagccatgtttgcttccactcaaccctagtatgagtttgttgttgtggaaagaatttatctggaatgtcttggtgcaaattagctgttttggtcaattttatttcttcaacaaatatgaatgatttatgtggcaggcacttgtgtaggcactggggatatgggatgaataggacagacacagtcctgctctcaagaaggttatctccatcacgtgagccagacataaagcaaacaattatctaagtacattttgattatattaatagttctgattagtgttatttatttattctgtgttcctaagtcccaatggtttgaaactgactgatgataaataatagaactgtaaaatttataacaataaatttgttacagaaaaggtcttattttttaacagtgtaagtactctggtttattccagaggctactaaaaattagaacat

SEQ ID NO: 125208 - DNA, 339 bp, Homo sapiens
ttgtatcctggacattgaggatgatacgttagagactctggattctgttatactctttcaaagagcattgattttttgttttaggaggcaactaccttggctggactcaaactctgtctcctccatgatgagcagaagctagaatccctttttagttattttagccttggctagagtacctggagtctgccccaccatgtgtgtcagggggcaaccagagatttgggaagattttatgtgcaaaatttaggactcctctgattgtctttattccaagatttcccttctcactttcaagctactgtgggtaccctaaactctctcctctggttcttcaag

SEQ ID NO: 125209 - DNA, 482 bp, Homo sapiens
ctcaacgctttatacttcagtggtattctgcaacttgctttttcacactcaataatgtttctgacattaatgttgatatgtaagatatattcattttaattgctaaaaacatccttccatatgaacatacaatgactttttgcattcactccccaaccaatggaaatttaggttgtttctaatattccatgataacaaaacatgttgtaatgaaaacatccttatacatgtgtgcaggagtttctttggggactactccaagaagtacagtaagagaatgtgcaccttcaatattactagataccaccaaatttgctagtaaagtagttgtgtcaattttgactctcaccaatgtacaccagcaatatagagttcctgcctgagcgcagtggctcatgcctgtaatcccagcactttgggagaccgaggcaggtagatcacttgaggtcaggagttcgagactagcctggtcaacacggtga

SEQ ID NO: 125210 - DNA, 453 bp, Homo sapiens
cgggaagagtatgacagaaattgcccctgtgattcaattaataagacttattcactatcacgagaacagtgtgagagaaattgcctccgtgattcaattatctccacctgcccttgacacacgggaattattaaaatttaaggtgagatttgggtggggacacagcgaaaccatatcaatggcattgagagatgaggcctttggggatgtgattaaatcccagtggattagaatagattagtaccttataaaaggcctggcggggactagtttaggcccttttggcctttccatcccttctgccatagaagacccctccagagaaagcaacaaggcaccatcttggaagccaagagaggagcccttactggacaccaaacccgccagcacctccgtcttggacgttccagccttcagaaccatgagaagtaaatttctgttctttatacatta

SEQ ID NO: 125211 - DNA, 389 bp, Homo sapiens
cagcaatactctcaaagagttaaagtgttcttatccctgctttacagatgataaaactgtatctaagaaagattaagctgcacgtattctcacagttaatttgctctaagtctgactgcatagatgttactccttctgcaacacgggtaaaatccactttcattgtttcaattatccaccatgtaagtgcctatgattccccaatcgcatttctaattttagtattcatcctgagccccaaatctatccacagcattcaacagttctcatctcccttataagtcctacgaactcatccaaaaaacgaacacataatcccatatcaaaacttgttccttctcctttaatccctttcattttttttcactgattagtgaatgcatattgtc

SEQ ID NO: 125212 - DNA, 748 bp, Homo sapiens
catggtggcacgtgactataatcccagacacttgggaggctgatacagaagaatcgtttgaacccaggaggcggaggttgtagtgagccaagattgcgccactgcactccagcctgggcaacacagcaagactctatttcaaaaaagaaataaaataaaataataatttagtttaatttaataatttcaaaccaggtgcagtgattcacacctgtaatcccagtgctttaagaggctaaggtggggggattgcttgaattcaagagttcaagaccagaccaggcaacacagcaagacaccaactttataaatttttaaaactagccaggcatcgtggtgcgtgcccgtagtcctagctacttgggaggctggggcaggaagatctggaccccaggggttcaaggctgcagtgggctacacttacatcactgtactctatccgaggcaacagagcaaaactctgtctctaaagaataagaataaactataatacaataatttcaaatgaaaattaaagtgtcaaaaaataagaatgtttaacaattgtgatcatatatgtcagatctcaattttttctcaaactccaaaatctttcaaggggatatattaccctggtttttcttaaaatagccaaaagcagattatcaaatttcctgtgattttgataatctcattagagagaattcaccttattaatcccatgtatttgaatataaataatactatcaccttttcaaatatgtattgg

SEQ ID NO: 125213 - DNA, 498 bp, Homo sapiens
ctcactcgggcgcccagtgtttgccgtgtagtggactgacactaggcacacagcaaactaccacctacctaggcttaagtgatctctacatctacagcctcccaaagtgctaggattacaggtgtgagccaccgggcccagccaatatcctatatttgaagttatactatagttactgcagcaaaataaatccaaatgtactttcctaggcaaaggaaggacatctaacactgtctaatgtaacaatcttagaaaattctagtttttttgtggtataggaaatactaatatcatctcaggttatgtgcatggaaagtatttaacatctctttactaccagatagtcatgtaaagttaaattatatttttctcttaaaaattccttcttctgggtactaacaagcccagagtttgattttaatggaatttaacatttgtgtcgatggtgacttctagatttaagagagtagggaaaaacagtggaaattttaaaagtac

SEQ ID NO: 125214 - DNA, 302 bp, Homo sapiens
tgctcaatataagaatttagctgggagcagtgctcacacctgtaatctcaatactatgggaggctgaagcaggaggatcacgtgagccccagagtttgaggccagcttaggcaacatagtgagagctcatctctaccaaaaataaaaaatgtaattagctgggcataatggtacacaccttgttcctagttacttgtcaggctgacgcaggaggatctcttgaacacaggagtgccaggctgcagtgagccatgattgtgccactgcagcccagcctgtatgacagagcaagaccctgtctc

SEQ ID NO: 125215 - DNA, 355 bp, Homo sapiens
ccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagt

SEQ ID NO: 125216 - DNA, 240 bp, Homo sapiens
tgggacaagcccacagccaacatcatactgaataggcaaaagctggaaccattccctttgagaactggaacaagaaaaggatgtccactcccactactcctattcaacataatactagaaatgctagccaaagcaattaggcaaaagaaagaaacaaagtcatccaaaaaagaaaaagaagtcaaactatctctctttacagacaatatgattttatatttaaaaaaccctaaggactct

SEQ ID NO: 125217 - DNA, 497 bp, Homo sapiens
caactatacatatattactgaacattttttatgttcaaatgctgtgctaagtatctgaataatattcacatgaagctgaaaatctatcaaaaatacatttgaatacagatacttggtaaaatctctaaaatgcacaaagcttcatggacacatgaaatttctttactatggagaaatcaaggaaggtttaataaaagtagtaacattagagctaatctttgggtaaagaagaggaaaagacaaattgtagtgcatgctgtaactgtatataggttctttggagatagctcattgaatgcaaactttcagaactcacttcatgagtcaataggaactttacacaatggtgagaataaagtgcatcctttcaaagcacactgtccatggcgtgagagtaaccaccacactgacatttgttgaagaaaggttctcctgggttctccccactctaccctccttggatgccaattaggcaccttaggaaggacaagtgtctt

SEQ ID NO: 125218 - DNA, 199 bp, Homo sapiens
gaacatgtgaaaaccaaaattaaaaatttcatttacagtcactccaacgaaagtaatatgcttcgatttacatttaacaaaacatacacaggactggatgctgaaaattttaaaaatgctgataaaaaaataaatgaaaatctaaacaaatagacatagcatgttcatggattagaaaactcagtataataaactgtca

SEQ ID NO: 125219 - DNA, 297 bp, Homo sapiens
agacaagagtgtgcaagctcaccagagtgcatagaggggcatatgtgcatagtatattcactgtgcctggatgagaatgggtgtaggaaggagtgtaaaacagaaagggaagccagagagatctttgagccacaatgtaaactttcaatactaagctaagaagttagcacttttctctgaacagtgaaaacctattgaaggtttttgaagaggaggtaatgatatgatccagtttgtattttaggactggcactctggtcacaatgtattagattgtaaaagccagactagaggggt

SEQ ID NO: 125220 - DNA, 394 bp, Homo sapiens
gagtttcaccatgctttgctgaaaggaagaatgggcagaaaaggaagatgaactgaaatttataaggactctactacatggccatgtgccaggtggcttcccaatcctgatctcaaagtgagcagccttccctagcactggcattgaggtaggatcaagatgactagggaggaattatacaggttgagtagccccttctctagatgcttgggaccagaagtgtttcagattttggattttttgttttcagattttggaatatctgcagaatacataccagctgaacatccctaatctgaaaacctgaaatcctaaattctccagtatttcctttaagcatcatgtcggaactcaaaaagttctggatttgggggcatttcagaacaggaacact

SEQ ID NO: 125221 - DNA, 325 bp, Homo sapiens
tcccactgtcctctcctcgggttctattaatttattagagtggctcacagaaaactcaaggaaacacatctactcgtttactatataggatattacaaaggatacagatggagagatgcatagggcaaaacatgtgggaagggtgtggcacttctgtccactctctggggatgccattcccccggagcatttatgtgttcaactacctggaagctctccaaacacagtccttttggatttttagggaagctttattatgtaggaatgattcattaaacgtttggccattggtgatcaacttaaccttcagcttctcccccacttc

SEQ ID NO: 125222 - DNA, 1031 bp, Homo sapiens
cttcatggcccttactactctttgaatgcaggcatcttgtttattttattcaccccctgcatcaccaatgccttcctaaagaatcgcatctgctgaatgaatgaccaaaaataaggtactctaaaactagactcattagtttgaggtagaagtggaagagtgatggaaagggtgatgcattggcatcccaaagagttggccaatgtccccaccctcttcattatgtggtttttgggacaccataactgtggttttcggacaaagaaaagcacagactctctagccttgaggaggagcagccagtccggcagaaggtgctcagtgacatggagcggcccttgggtcaagaagttgtcctcccacacagaggctgctgcatcctctccttcacatggcagggagctcctggcagccaaattgctgggtgaggacaatcaccacctatacttttgcctgcttcatccttccatcttggggcctttgcagttgcttgcctgctggtttgctcatttgggaagttcaggaaaatgagccaagagaagcaacccatggcacatgtcctaaatctgggggtgtggaaggaaggacagaacattgagaaagcaaacttgaggacaaggtgagtgttgcaatgcaagtaagaagtacctgagacagaagaaatgtgtgttcctgcctttagatgtactgctgatgtagagacatcagcagacacctcaaatcaatgtccatttttattgttgcttttataattgtattttctgattcattattcagtgaatttaatgctatttatgggttcatttggttcaataaaatgtatctgcacttcgctagacattgaggatacaaaaataagtaagacaccacccctgccctcagagagcttatagtctagtgggagacagacaggtaaatgtgtcatttcagtgccacatgataaaaagcagaatagcggcatgtaatgacatggtgctgtggggacagagaaaagagacacttgtttcagcctgccaggtagtagtaggggt

SEQ ID NO: 125223 - DNA, 451 bp, Homo sapiens
ggtcatagctgactcctgagggtaaaaggagggccagcgaatcgtatcacaatttcgccgtgcccgatatcatcacagttccaccgtgccccgtatcgccacagttccaccgtgccccgtatcgtcacagttccaccatgtaccgtatcacaattccaccgtgcactatatcacaattccagctgcactggctttgaatattttctgtactaaagccgtgaaactcatctgatcagaaaagctacgccccaagcctatgtaacctctgattgtcgctggtgtgtggcttctgttctgtaccaagaaaaagatgcagaaccacgttacaacaagacactccctgaatacacacaactccacgtgcacgcagacttcccaaaagcacacaaaagcatgatgctcatcgcagctctctggagaaatcggactcaggtggacaaaacatctgggt

SEQ ID NO: 125224 - DNA, 257 bp, Homo sapiens
tcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaata

SEQ ID NO: 125225 - DNA, 397 bp, Homo sapiens
tgttttctgcctcttgagttaaaggattcatccactagaactggccaccttaaggccatattatattgtggtggacttgtcttaaatggaatttcctgcttcttcttaaatgtataattcctctgaattgaatataaatttcttcatttctcctcattgactttcaaagctcttcttccttttgatatacaaagtttagccttgttcgagagatctgggatttcccttacgttacggattattttgtaaacagaacacccaggctcctcccctcatgtcctggctggaggtgaaacattaaaaagagattttaaagcagggccctttactcccttccttcctggtttgtggccagggcacagggcagctctgctccatccaccctttgtccctgtgc

SEQ ID NO: 125226 - DNA, 494 bp, Homo sapiens
atacctgtaagtcccagcgacttggggggctgaggcaaaaggattgcttgagcctgggcaacagaggcttcagtgagccatgatcccgttactgcactccagcctgggtgacaaagtgagatcctgtctcaaaataaataaattttatatatgttgtcacatggctcaaacagttttcatgtaaagttcactttgagtatgtgggctattatttgaatttttggcctttgaaataattatgaaaacattcatcgttattatcctggagtttcactcatttgcagaataacttcattctgaaaatgatataacacctcccaagactaagtaatattaacagagttaatattttatctttttgcccttaatgcctcctatattgctggggacatgatagggcctgtgtgtgaatgtttgttgaaatgaatgaataatactttttaatatataggagaaaacctaagcacagcagtttgtgtgagacagtgatcaga

SEQ ID NO: 125227 - DNA, 232 bp, Homo sapiens
agccagatgttcacctgtctgacaactcgtccaagaaggcatgtaattcacttatccaacattagacagcaaatagataatcttgagtccagagctcttaattcaaagatctcgtgatctgcccatctctcatagtggttttcaagtcttgtttccatttgactgacatcttatatttaaatccatcaaaagaggcactagggtttccctttctaccttcaaaaattctaag

SEQ ID NO: 125228 - DNA, 282 bp, Homo sapiens
accggcctttcctcagcttccacaggtgacaccacccgtcttcctgtcaccgacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctcta

SEQ ID NO: 125229 - DNA, 154 bp, Homo sapiens
ctaatgtttgtatttttgatagagacgaggtttcaccatgttggccaggctggtcttgaactcccgacctcaagtgaaaacacaacctatggcctccagacactcaaatgaaaacagtggccttggcggccaaaacaggggctgccctaggagt

SEQ ID NO: 125230 - DNA, 487 bp, Homo sapiens
atgaactccttatcagtgatactaataataaaattaatgacaatagctagtatttactgagcacttgtgtgtgataggtattacttctaaggctttacataaaatacctcatttagtcctcataaaagttctattagttagacataataatcaccacttaaaaataagtaaactgggttgggcatggtggctcacgccggtaatcccagcactctgggaggccgatgtgggcagatcacgaggtcagatcaagaccatcctggccaacacggcgaaaccccgtctccaccaaaaatacaaaaattagctaggcatggcggcatgtgcctagctgaataatctcaaaaagtgaccccacagaggatttctttctgattggtttattaccaatcctttagttctagtgtctagggatatgcaaagtcagaaaaaaaacagtcaccacccaaaagaaaatagtgcaggggcccgctagctgaataatctc

SEQ ID NO: 125231 - DNA, 1679 bp, Homo sapiens
cagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctataggtaagccagccagcagtatgacctcccctctgggtgt

SEQ ID NO: 125232 - DNA, 491 bp, Homo sapiens
cagataatattcatgtggtctaccatgatgtttacttgcctataaatagttaaaatgtagctaatgatgatacagtacttatatttttaatggcctttagtagtttaaccttggttacaatataatactttgaaaaaatttggaaaatacaggagagtattaatataaagaaaaacattatttaaaactgttgcttggaactaagttatgtttatttctgtctccagatgtttctgtcttttaaattatcttagtatgggtgtgtgtatgcatgcgtacgtcagaacacatttagaggtctcaaataaaagattgcctgatctcaggatgagtgaaatcttgacaataagcttaaaacaaagagaaaccatataaaaaatatagattcatttgacttcagttttttttaaaaggaataaaatttaaaaggcaaactgggaaaaatacttctcaatctgtttcactttactccttattcctttgttagcagt

SEQ ID NO: 125233 - DNA, 578 bp, Homo sapiens
tcctgtatttctccagaatgtcacgatgagtaatgaacaaaagcccacccagagctgtaagggctgttctcagcagcaacactcagtttggagggactggaggtcagggctattgtttggctgagcctttattccagaagactgagtaggtgtcaggaaatgaggctgggctcttgaagatgggtgctttgaatcatgttttgttacttgaacaaaaataatagtaaggagcccattcataaaaacaacatcattttcttcaacaacatgtactctgtatcacttcccttgtgaacggaataattctacgtctgtgacagaatcccggaagacagaaccatagcaacactggcacattcatttcttcttataactgacaatactggacacacttatgtgggctggggccaagctgtgcactgagcactctatgaacaccacttcatgtcatcctcacaataatcgggtgcaggagacattattaatattcacatcttacagctgtagcaacagatgcatggtgagccgaccaacctgctcaaaggctcacgggagcaaggggcagagcctgcactcta

SEQ ID NO: 125234 - DNA, 758 bp, Homo sapiens
attcttagaaaacaatttattctaaatgatgatgcatatagaaaaccagtgtattcttttatttcttttaatactggtggcaaaataggacgtgtctggaaaaccataaggctacttgggatactgtcccattagcattgctgtttccatgacaaaccctattttcagatggtttgatttgcctattttttttttaaaccagctataaattggggtcaatttcccccctcacagtgtacttaatttagcttttggagtaaatatataagtagtatgaaagacttctgaagctcttctttctaaaaaagcagttttccacttaagctttgtggggacagagagtcatatttttaatttcagagccagccagtgtcaaacacgtgcaaaagagccgggccggattttttcagcttgtcctatggtagtcacttgtcagcctgagtttactggcctggtccttttgtctccactgtaagtactgaagccttctggtgtagttgtatcaccttaatgtccagcatttaactaggaaaggagactacaatgaagagttggtggccaattaagaaaaataatagactacatcataaatcatttcaggacttgagtggccgcagatcactgtccctgatagcatgtttcaaccttggtatacattttttttaagatgcatatttactgtgtgtgcttttgctttctaatccatctattgactattggccacaatttatataatgcacatgcaattaattgaaacc

SEQ ID NO: 125235 - DNA, 372 bp, Homo sapiens
taaacttgctctcacttctttttcacacgaggtccaagaaccctctcttggggtctggattgggacccctttccagtgacatccgctctagactaatcttatgtcctgtggttgatgaatcgggaatctctggtgaataggaaaaattgttggattgggaggagattctggtttctggtttccctggctctcatttaatatgtaaccctgagtaggtagctttcccttcctaaatcagtttcctcaactataatgagaggatttagatctccaaagtctcttttagttcagactctcaaaaaaatccaaaacacacagccaggcgcagtggctcacgaagtcaggagatcgagaccattctggccaacatgg

SEQ ID NO: 125236 - DNA, 653 bp, Homo sapiens
caacaaagctatttttcttcttcctattttcttccacacctaaatggagcgaaatttggagtgagcccgaatcatagaagtatcctcgtctatttgtagaactgtatttcactcttcccatataatatgttttctttttccttaaaatcttcaaagagattgattgtacaagtcttattatcccattcttatgactagcacttgatttgtttgtagacattgagtgacaaatgcagtgcttaatttaacagagaaatctaacgatatattttcttataaaactatcccctttttgtctggttcttagtggaaattgaacaattgctcgagccagccctaaaatatgattttaaaaactaatatgtttggggagaattgagtaatgaagtgtcatattttgctcttggtgtttaaagctgctgtcatacattgtgatggtctgtcctggtaaacgaggctcccagcattcttgcagaacataccttcttactaaagcccttgcagtaaattcactctgtattaattacctcctctcctagtggcagacatactatttcctgaatgctttcatcagcgtctctgggtaattcattgcccagaaaatgcctcttacctgtctattatagacctcatcacgtgtattaagaagatta

SEQ ID NO: 125237 - DNA, 349 bp, Homo sapiens
  misc_feature (16)..(16): n is a, c, g, or t
aagaaaaaagaaaganccagaattgggatgacattggataagagcaaaggccaagtgacttctccgaggtcacaatgcttctaagcttggtggtgttgccacagtgcatgtggcttcataactctaataacagtagcaagaagagaaacagccaaaacagtacaaccaattccagttacctgaatgaagctttgggaaagtataaataatctaaattcaaatgacttttttccataatgatgatgtgactcaaaatatttgctggaattaatttcttcctttcttctccttttttccccccgtttccctatggaatgatagtagaattaccaaaagtaggaatccaaaa

SEQ ID NO: 125238 - DNA, 193 bp, Homo sapiens
acaataacggaacgggttctatcacactccattgtaatgaattacctgtctgttcttcccaaagaaacaaaagctccttcctttgttcaattagtagatattcactgacaccttcctatgcataatgcacggagctgttaatcaaatggtaaataaaacaaacattggccttttcccattagcagggctcaca

SEQ ID NO: 125239 - DNA, 676 bp, Homo sapiens
gagagtatggtatgcagtctggtgaatttgtcctagtaaacctgatttttagcattacttaagacataaattctcaatctccaaggaattatttttaaacatattattttcacaagtacccgtgaatggatgtggtctatgggaaacaccaaaatagatataaaattgatggtcttaaaatttgtgatttaccatgcatgttacattagttatttgtataaacatgatgttgttcctctttgacagaatttagaggttggatacttgatgcatctgaagaaaccatagaagtttgcgattatattacagaattcctctcatgtctgtgcaaaaaccctgcactctgtgttacagctcttcagtctatttcctattctgtaaataaatgtctaggtattgtaattatacatgtggcatcctttttactttagtattgaaataacaattctttatatcgtcactgtcatgaattcttacctttgaatagcactttatagctttcgggatgttttctcttattatcttattaaatatttacaattaccaagaggtaaacatggtaggcatgtttatcctctctatgtaagaagtaacagatgtagagaaattcttatttacaaagttcaggtgggaagtagtagagctgagatttaaacacttgcattttaacttgttt

SEQ ID NO: 125240 - DNA, 365 bp, Homo sapiens
acattgtttacagttttaagtatgttaaatacattaagtaacgatcagtttgcataatggtttttttagggtagagtttaaaatcagtaattcttagccttacataattataaagtaatggctcattttttgtttcagtattagatagtaaaactaaggctgtagaccagtccctggaccaagtgttaggagacctgagttccaatgtggttttgcctgggtattcttatttgtaaataatattattgattgaagattaggggaaatgatacatgtgaggaaagacatttgtaaaatttcttgggtttttactacataccgtattcattttttaaagaaataaacattttgaaagttacgtttta

SEQ ID NO: 125241 - DNA, 407 bp, Homo sapiens
aggcgttgacctcatcttgggaaagaaagcaaaggtagagctctgctgtccttgaacggtgtttctgcttccagcttctgaaattctagaaagtctgttttcctgcctctggttttatcaactgtattctggtgtttctgacacggagcggggtccagtcacaacccccacacatcatttatcatcacatgtctaggtgtctcgggccacaaatttgttttctaaattgtcagctgcctgctgcttgcgggctgggcacgagctgttctatcacactttgctatttgtcccttgaatgtcatcgtgtacacgtggcattttccagagtcactggattccagctgaaatcattgttgacttttaaaaaaatgattttattaatatctgtagctcaggttgtgacactt

SEQ ID NO: 125242 - DNA, 98 bp, Homo sapiens
aaaatgtgacccatgttgccaactcccaaaagccaccaggtgacttccactgccgttagaatgaaacccaaactctgcactccagccccagcatcaaa

SEQ ID NO: 125243 - DNA, 184 bp, Homo sapiens
agcatcaccttggtagtcacagtaaaaatattataccatggaaatgtgcaaaagctacaaatcaggacggttcttcccgagagtcagttgttaaacatttatgagcagccactggtcccgctgcatctggcacctagaggttctcagtgtgtaggacggggacctgtctctaggtgacagggag

SEQ ID NO: 125244 - DNA, 304 bp, Homo sapiens
taattgccttattaggaaagactgctgtagaaagatgatcgagtgaactgttcatcttaacatcatccagataaattgagctttcatgtttaaacaatacctttaatacagactctgctgtaaacttaaggttactataccatttaaaaatagttttcatactaacttttgttttatgactatctaaataatagtcaatagtttcaaaagcatatgaattcaccaaaaatcaaaaacttttaaattgcatgactcagaagtaaactaccacattcattcacactagcattattttccctgggtg

SEQ ID NO: 125245 - DNA, 513 bp, Homo sapiens
atgtgtttactttcctgtgtggctaaaaatgtctgtaaaagtgtacagatttgttttccgtggcattttaaaaacataaatgatgtcctggtgcagctgtgcagaacttgctgttcacactgaataatgtgccttcgagggccttccgagaagccagcgtgcagagacttagccaagcgcttagcctgccacgacccttctggaaatgttacctgttattattattaattgtagcaagccaaaattgggaaagaggctgaactgggatttgtagactggggaaaactccagatttttaaattggtttccaagatggttaaaccaagataacaccaaatctaagaactaggaaggcgtaggtctcgcagcctccatcagtcaagtgatttgcaacgctggtcctgcttccagaaggtctgggcacagcgggagagaggcacaaggccgattatttctctgttctgttcagctcgtaccaaggaccagctctaggccctttgcagggagagaaag

SEQ ID NO: 125246 - DNA, 789 bp, Homo sapiens
cagccttttgataaaattcttaatttttgaacaagtggttctgcatttttatttggtgctagaacctgcaaattatgtaggtggtcttaaatctacaccacaaagtttgtgaaaaatctatcatctatctgtctgtctgtctatctacctatctatctatctatcttctatctacctatctatctccatcatctctttatcacctggcacattgtaacatttaatgttcttttttactattgttgccattgtaagaaatatatggtggatttttttccttttccatacctgtacagttaacttgtgaaatcttggttataggatttttaatttgtctgtattaagttgcatctttttagatataacttatcactctatgttgtcaagagtcatttttattcatctctgcaacaaaatgcctccatatcagtgaactagttcagcatgtcatcatccagatttgtgatgcaaaccttgcatagaacagcactgagaagcatgctctgtagcacagcacagaaagcttcctttcatgttgatcattattgatttgccaataccttttgatagaatggtttacttagttcccattcacccaaatttgcaattaactagttcttactacatcaatttcatttgaatctgtatcataaaatactttttcaaatgtattgctaaaatatagacacaatttggctactagtccctgttgaagattgttcagtaatttctccctaactctgaaaacaatttaggtgaaattctacagacttaatattgaacaaagaa

SEQ ID NO: 125247 - DNA, 515 bp, Homo sapiens
gccctagcagtgttggtttgtatgtatgtatttataagatattttgtaagcatcttttttcttagttccttataatggttttttaatacactatctcttgatgttttaaacatacataacaaaaatttccattttagtcatttttaattgtacagctcagtgggattaaatatattcaccttgttttgcaaccatcaccaccatccatcttcagaacgtttttcatcttcctaaactgaaacctcataccaattaaacaataacttcccattaagcagtaccaccgcagcctccggcagctaatcatcctactttgtgtcttcatgaatttgactactctaggaatctcagttaaatggaaccacgtagtaattgtcctttcgtaaatgaacattcatcagtgttcatgctttttttcttgccattttgctttttttttttattattattacatttttttaatacctatgaaagcaacaaagttgtaaaagtcatatagtcttactggccacaca

SEQ ID NO: 125248 - DNA, 358 bp, Homo sapiens
cctcaaagtatggcaagattataaggaactcagatgagaaggaggccacactcccaggctatttgtactgctttctctcagattttgtgtctctagagtggagataatattagtgttattttgacttagagccattcttgaaaaccattgttaaaggacatagtcatcataatcataatcttaatacaggtccccccaagagatagtcatagtgatggtaaagtgtcaggattggcacttgtgggatgatattaggacttctgttctcccatcttccttttaggcttaagattcttactccaagccttacttaaacttgctttcaccaaataatgtgctttcagttatacacgttcag

SEQ ID NO: 125249 - DNA, 294 bp, Homo sapiens
accttttagtgccagcattacactaggaccagaggtgtgtgcaatcctacccctaatttcatttacttggtgtagtaaaagttaagagtgggatgttaatattaagcttgtgtttatgctaatacttatgaaggcattccctggtattatttcttagtgtctgcaaagcatcttgccgctttgaaggcccaactggaaaatctttactagaaagccatgttgcagacctgttaggttttagctacagaaaagcaatcaactatagaacatgctaacagaagtgaaaattaggct

SEQ ID NO: 125250 - DNA, 386 bp, Homo sapiens
tctcagttgaggtgacagaaagactgccttgtgttcactggaactctgtgccactatgagaggctgttctcaaaccccagcatggaataagctgcctccacaatttgctatacctctataaggttccctgttccttagtagcttctcactcttgcagacaaactttagtataaaggtgggcttcccctctgcaccatttagttcccaggcttaggaggtgggtcaagaacactgctgccgtttacatgagcatgtggacaacgccgggctgcaactcctgatgaagggaagtgagaactaggtctcaggacaagagaagctaccagaagactgattaaacttagtttgttccgtcaggttatatatagagaggacctaatgaagca

SEQ ID NO: 125251 - DNA, 475 bp, Homo sapiens
taataaattttccacagggagggaaggaggatagggtatgtttgttttgtgtttttaaaattgtttgctctctgcatttccccaaagacatccaggctgtgcctttaccgtcagcttgtttctttggtcagtgtctgccactgtgttcctgacctacagacttgaaaggcttgtgcagttgtcctggccttcagtatctgaggggcactggttccaggatttccctccaatattaaaatctgcagatgctcaaaccccttacctaaaatcggaaattatttgtagaaaatctatgcatatccttctgtatacttttagtcaactatagattacttataatggctaatacaatgcaaatgctatataaatttttactgtattgttttggatttttttgttggttttgtttttgaatagtttcgatccccagttggttgaatctatgcatttggaacccgtggaaaaggagggccag

SEQ ID NO: 125252 - DNA, 463 bp, Homo sapiens
ctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttccccacgactcc

SEQ ID NO: 125253 - DNA, 662 bp, Homo sapiens
ggggagaggaaacaggtggaacccagtggacactcagggtcaaggaaacagggatgacagtgtgggtagaccaaggcagacagacttcataggacattgcaccagaagggaaaaggtacacagagtgagaaccccagagatttcagagggttcctctcaagtattcagtggagcactgatcagtacagggtgaagtcagtaagccaaaagccaaaatcttgagcataggagaaaggagaagtttgcagagaagtaagtattgcctaatggcatgaactttagaggatctagaattttcacagaaagaagaaattacgatttggaaatggcaaagagaggacaacagagatatatacccttcctcatggctctggaaagaaagaaacaaaatgtgaacccattaccttagcaacttttgatttgtaaatataatgctgatgaacaatggatataagtattgaatgaaaaatacaatgcattatttttctagtaataagaacttagagtttatttttaaactgtcttaactgaaatggcctataaacatatccagctttgtatctaatagtacagtgtgagtgtgtgtgtgtgtgtgtgtgtttaatttatcacatttcttacaaagtactgttgtctgccttagacatgtttcatttatagcc

SEQ ID NO: 125254 - DNA, 458 bp, Homo sapiens
tagattaggttggggtggagttgaggcaggaaggctcctacagcaaaggaggtctgatgagctaagacttggttaatgagaaacaaacagtgaaggtaaagaggcatggggcttggggcaagggctagagccaaaagctggcaggttagagagcactggaagattatgcatttactagctgtgtgacctcaggcaagtcacttcgcttctctgtgctgtgtggtttcctcatttgtcaaagaatgggaaaggatacttaactcatggaattttcatgaggactaaactttataagaaacgtgtatgctgcttggcaatgaaaaggaccttttaatagagtaacaaaggattgtattttctcatgaataaggaattaaaatgagttagaggcaattctctattagttaatttaacaagttacttagcagcctatcggtctttcagagcaaataggttta

SEQ ID NO: 125255 - DNA, 153 bp, Homo sapiens
ggggcattaatgtttaagctatttagctaaatgaaaattatttttatgaaaaggttaagcgatctatacacttgtatttaaggggatattttgcttttcctgtacagatttatcttcactttaaagttgaaacatgaaataagccatggaaat

SEQ ID NO: 125256 - DNA, 283 bp, Homo sapiens
gtccagttccataatggagaaaaccccaagtaatgaaatgaggaatctacctacttgctaaattgaaaattctttatgagcacaaccaaactgagattatttacatgcttatagactctcacaatgttttcccaagagggattacatttcccattccaaaagagagaaacacagaactgcatttatctggaaaatgcaagaatggacgtctatgcaagaatggacgtctatgcaagaatggacgtctatgcaagaatggacgtctatgcaagaatggacgtct

SEQ ID NO: 125257 - DNA, 531 bp, Homo sapiens
gtatcaggtgttttttgtctcttgacatttactaagcagtataacttcaatttaaacaattttgtctcatactcagttttgtttatggtggtagacattattatcatcattttacagaaaagatgaacaaactgcgattcagagaacctaaaagatttagtgttatcaatgctgtgtcattttaatatcattaaaaaccatagaattgctggtgtttgtattgtttctctctatagcactttttatctttcttgtttttgctctctcttgctttgtaggtttcatccatccttctttcatcttcccttttacttactgcaccctctgcttccatacacataccctaaattaggtatctcccaagggaaaaaactcgccagaactctcttctcatagattgtcagcatgacctactctctcacctccttgagaattttgatgttttggatcaccttttctctgaagcctttcctgactgtcctatttagttttcatctcctcccactagaatataaactccatgaggttcca

SEQ ID NO: 125258 - DNA, 789 bp, Homo sapiens
atgaaataaatggggtggaatttactttcttcatttataactagatgatttcaattaatttgattttcagcaaaagcatctttatcagttttgaccatgttggaaactgaacacagcccatctggcattattggcaccacattggaaatgtatataatcttatggtgaaagtacaattacaagtgtaattctgtcttgacgtttgcttgaaattcatctcttttgggttatatgttaataatgagggcggaaatttgctgtgagcatttacatttgatctagacacaggctaatattgtttgcctgcaatatatttaacattccaaaactgctttctgatttatcttatgtatcttaaaacttacagctattaattcttctcatttttccactaaagctagcataccacaaagcaaaatatgaatatattctataagttgtagaatttcttaagatttatctctaccattggatgaggcatcataggcccttttcctcaaggaagtggaaaatattctgtgccagtagttgtcagtaaaagaggatatctgtccctaaagtttatttcatatgaatattaatattccttatatggccatcattttcagtgtttcattttccaaatgcactttctaaaaacatgttaaattatggtccattactaaccactaatggatgattttatgactgaattctgcaccaaaaatgattatttgctgtgtgaggacagatttgcaaaacaagatgtggtagcatttaaacggccacttatttttagtagaagactgc

SEQ ID NO: 125259 - DNA, 437 bp, Homo sapiens
tggacagcatcccccgagggtctaaggagcggcacctgtgggctgttttggcctcgggtcgccagtttgggaccagttgggtcttcgtgatcatcttggctgaacctttatcttgcctccctggaaacccatcatggggaggggaggtcaaggaccccgggcccaggcttcctggacatgcctcacggatggctgacctagggagccccaggcacagaagtgagctaatctggaatgaggccggggaattcgattaggcccaggtcacaggaaacagtgaatgcaggatgctgaccaggcacccctatgtgggtgtcaggggggtgagggaacaggcaagagggagggctgagaaagaggtgaaccctgggtctgggggaagtggtcagctggctggaacgttgtgtgcagacaagccctctgcagcagttgtggcc

SEQ ID NO: 125260 - DNA, 469 bp, Homo sapiens
agaatattggacaatttaatagggaacgttcatgtcggtgactcatagaaaaagttcagagccatgccacgtagaaaatgaatatgaatgtattctccaagaagagccatatccaaaaagaaaaatagcagctattcatcatgatgcaagatttcaacatatagttgatgatcgtgaaagttagctaggtcttatgaatgatcgccatgcaaatgcccataatctattcctgtaatatactttttcatatgttaaattttctttttatgttgtttcttttcttttttagctttttttcactactttaaattgtgaacattattttttacaattttttatgctatgtgtttcatcttcgcgtcatttctgatatgggaggtagacattgtgtagagattttttgagagttctaatttgtcttacgcattattacaaacttgacctcataaaagttcattatcacaaaaaa

SEQ ID NO: 125261 - DNA, 303 bp, Homo sapiens
tggccttctcagcaaaagactctaacacctttcaacatggagaaactcaactcaacagcccttggggtcactgcagatgccccacagttgtgagcactgaggacctcaagtgttcataatcatgaaccccagaggcctgctttgcagaggactcaagaagctttcaccactgaggaaaccaatagccagccaagccactgcagacccccaacagcttttactaacaagggcctaccagtttttcaccttctcagacttcacttgcctaagctaccttagtaagcatcaccatgggcaacccag

SEQ ID NO: 125262 - DNA, 325 bp, Homo sapiens
cagccatgtggaactgtgagtccattaaacctttttttctttgtaaattatccagtctcaggttatgtctttatgagcaatgtgagaacagactaatacacaatgctttcaaaattatctccaacctagtattctatgggccagtcaagttgcaaatcaagtatgagtgaagaatcatacttcaggcttgcaagttctcaaaagctttacctcccacatacccttttcttgggaagctagtggatagaggatgtactccaccaaaaggatgggaaaatatttgagaaaggagatctacacagagagaggcagaggtctacaggat

SEQ ID NO: 125263 - DNA, 590 bp, Homo sapiens
aaacaactctgtggggacacttggatagagaggattttcccgaagctgtaaactttggaggatggcatgactggtctcctcccagccggagcggagctgcggcctctcccccctcccttggcctttgctggcacctgtaagcccccggaggcttcagtctttgggccttccaggtccacgctagctggctgctgttttctgctacaggaagtggtggatctgagacttggtactccgtcccatcgtctccacaaatacacccgttcctgtcaggccgcgtgttctggtgttgtttggaaatgagggggtctagatttcaactgacctcttacggacatacagggtaagcgttggtacttggacgtgtagatggagaaagtagagtaaaagacaaacgcatagaaagtagattgcaccatcagcctttctagggctgtgggctgctttgcttcccgtcactttcactccaggaacaagggactaatatggaaaggaacctaggaaccgggaaacccgagcatttattaggctcagctgtatgatttttaatgtgtgtttctttatctgaagtgcatgaactaccttgtagg

SEQ ID NO: 125264 - DNA, 530 bp, Homo sapiens
ggataaaaatttaaagaataggacttccctcaaccaaatagaaaatatgtggttgctatgtttttttaaaaaaacaaaaatacagaaaaatatatagaaaaaggtgaaaattatccaaatcccacctgtatacacaggtagaaatatatgatttcatgtaattgggattgtactctataagctaatctataatctataatctattttaatcactcctttctatgttgttgaatataattttacatcaaaattttaatgcctgcataaaattcagttatacatgtatatcctgttaatttattcatggtgacattcattcatcaaatatttattttcagtcttactatgtagcagacactgtgctaaattctggggatgcagcagcaaactcctctctcagtggatatttaggttattgctgatttttctgttagaagcaacactgcattgaacatccaatactgcaacatgtctttgaatactttattttctccttagaataagttcctaagagaattgtctggtcaagg

SEQ ID NO: 125265 - DNA, 466 bp, Homo sapiens
gggtttctccatgttggtcaggctggtctcaaactcccaacctcaggtgatctgcctgcctcggcctcccaaagcgtcatttctggtgttcttacttcttccctatgattccgatttgcatgtggtatcactcctcttcagcctgagctccctttaacatttcttctagttcagatctcctgatgatgaattttcttacttttcgttaatctgaaatgtatttattttgcctgtattcttcaaggttgttctcatcagatagagaattctgaggccaggcacagtggctcatgcctgtaatctcagcactttgggaggccaaggtgggaggatttcttgaggccaggagttcaagtccagcctgggtaacaagtgagaccccatctctgaaaaaaatagcaaggcatggtggcatgcacctgcagtcttggctgcttgggaggctgaggtgggaggactgcttgag

SEQ ID NO: 125266 - DNA, 285 bp, Homo sapiens
tgcctcaggctcccaaactagtaggattacaggtatgagccactgtgctggcttagcctgcattttttattgatatttttcaattggtttcatttacctctaaatgtagttgtagtctgcttaagtgccataattcttaccatatttatattttcagttctatacttggattagttgatgactttcaaatcattcaatacatcctctcaatttagaagattctacagatgaacaggaattgaaaatgtgacatgaaatcttttttaaataacatttacccactct

SEQ ID NO: 125267 - DNA, 446 bp, Homo sapiens
gctaggattacaggtgtgagccactgcacctgtccccagtgtagttttgggggacactcctttcccctgacatgggagggaagagttgagagcaggggacctttggagacggcacaggaattgaggaagttcttggccccaacctttgaaattcttagcgttggggatgagctcagtggctgagttgtcaaagacagagcttgtggaggataagcactggaggaaaggagtgcagattcagagcagctgccacgtggaagggagaggtagccagacagagccgggctgtcagagagtgccataggaccatgaacgggtgccgccatttgtgtgtgtgtgttttttttttcacagatctgtgtgtgtgtcttttctttccctccagcagactgggcagagaagccagatgagggtagacccatggctgagggcttgcatagcacgtg

SEQ ID NO: 125268 - DNA, 389 bp, Homo sapiens
gcatgattctggaaagaaattctgtttaaaaagatgagcttcagtgttaaaaggaggtgggaataaatcagaaaactttcatagcttttgaataaagcatgtaatttttcaccaaaaggagagaatttataatgggggagagagagaaaggaggcaatgaggacagccaagggaatgctggaaccattttatccctgtggcttagttcttacagataaaaaatctggctggattctctcattaacaggtgtgtggctgtgaataaaccactgaaacaatcttggggttcagttttttagtttataaaaagatcgggccaggtggtggtggctcacgcctataatcccagcacattgggaggcagaggcgggtggatcacctgaggtcag

SEQ ID NO: 125269 - DNA, 306 bp, Homo sapiens
tagggggctttctggatgtcgtcccgagaattttcctgtctcagggctgtactttctgggttcccggtggttgattgctggtctctaatgatgcagtggaaagggcttgagatctggcattggaaaattcagttctgctaattattgttttgtgacctcgaccaagatagtgctctgagcctcagttgtgtcatcttataaatgggaatcataatgcccatttcatagagttactatgaggattgttggtgaaaagcgctttgcaaatggcaaaggattaaacgaacatcagttgttattgatact

SEQ ID NO: 125270 - DNA, 443 bp, Homo sapiens
aaaccactcccactttcatgacagcattcatccatttacgaaggcagagccctggtgagctaaacacctcccaaaaggccccacctcccaatgctgttgtattggggattaagtttccaacacatgcactgtgggagacacatccagaccataccaccatctttgcccaggatcatgatactttttattaaataagagaatcataggataatgtagtatacaagaattcagacctggctcatggtggctcatgcctagaatcccagcactttgggaggccaaggtgggtggatcacttgggcccaggaattcaagaccagcctgagtaacacagcaaaaccctgtgtctacaaaaaatacaaaaattagccaggtggtgtgcacctgtagtcccagctactccggaggcttaggtgggagggtcacttgagcctaggagatcg

SEQ ID NO: 125271 - DNA, 442 bp, Homo sapiens
tcgtctagagatcccgtgtcatcccccttcgtctcatgtgtccttttagcaaaattagatagtccatcaccaaataccgcatgatcaggtccttcctgttggatgactaactgaatgaaaataccaaatttccttttttatccttagaaatatatcattcagtcatcaagcgcttcagctgatacgatcagtgtcaccattatctttggaatctagagtgctgttctgtctctatgccttcctcttctgaatcatctcatcattgtgaaatctcttcctttctcaaattttcttgccttagccatttgggcataaagaaggaattctgaatttccagctgcattcagtgaaatctaacacaacaccccgagcatggtgtcgttgtcttcttttatacattcttgagaaatactgtagaactttgggcactgccgcaagaaaa

SEQ ID NO: 125272 - DNA, 594 bp, Homo sapiens
atgtgcagggagggtagggaactatgtagttaacacatctaatatctctttatttaaaacacactaggatattaagcccatatctaaagtcaaaatagtaaccctgttgatcttgcaacatgagggacctaatgttaataaagcttcccccaaattttgcctccagttgtttcatttctccagaggtctccttgtatctgatcaccactgcacagctcaggcagtacaaggaatccttcctcagtgcagccctctcacctgtgaagcaccagcccaccattccccttttcagaaagacaaccaatcattgggtttctcctgtcttcattcctccaggcaagaaacctcagggttatctcagacttctatcctctcttatccaataattccacaagccctattggttcttctttaaaatctcccttacatccatccaacctttccattccatcttgactttggtctttttcacatggtagcagtaactcagtctccttacctcaatctccctcccatccaacgacatataaaaatatcccattagattaattctacctaaaaactgctttcatttattgccctacctcaaaatga

SEQ ID NO: 125273 - DNA, 104 bp, Homo sapiens
catgaagcacttagtccagagcccagaaacactcaataaatagcaactaaccaggtgcagttgtgcacgcctatagttccagctgctcgggaggccaaggaaaa

SEQ ID NO: 125274 - DNA, 373 bp, Homo sapiens
ctcccaaacctgcctggggtgtgccccaccccatgctcactagggctctttataatgcacgggtactacagtaacataaaaacaggaaaaatgggaacctttctgcctcctcttcccacgagagacagcatagcaattgcaaatctggttcataataaaacccttttttttttttttgagacagggtctcactttgtttcccaggctggaatgcaatggcatgatcatggctcactgcagcttcaacctccctggctcaagcgatccttccacctcagcctcacaaatagctgggcctacaggcgtgtgccaccatgtctgactagttgttgttgctgttgttgttgttgttgttgtcgtgtgtgtgtgtgta

SEQ ID NO: 125275 - DNA, 613 bp, Homo sapiens
tcctaccaaactagcagcaacaatatgccaagtttcctatgctgaactagtgtaaacaaggaagaaaaagagccagaggtgggaagcagtcaggcaagagaactctcttcaagatataactttacttctaaatttcaccagagtaatagcttttctcagtgtgttcaataacccatgtctctctgactaaacaccacaggttagctgtcagaaaactacagtaggctatattccctgcttgagatcatcagacgtaacagatacaaatggagattacaaatgattaattctaaagactatctcctgcatccagtcaaagagttttctaaacatctagaaatttaaacctgctcttgctgtaataattgaccttaaagataaaatagtaggacccatcaaagatgatgcacagaaaaaaaaaatggcggggcatagtggctcacacctgttcccagcactttgggaggccaaggcgggtggatcacatgagatcaggagttcaagatcagcctgaccaatatggtgaaaccccacctctactaaaaatacaaaaaaaattagccgggcgaggtggtgtgcacctgtagtcccagctgctggggaggttgagaca

SEQ ID NO: 125276 - DNA, 125 bp, Homo sapiens
atggtcacatgtcctgctctgacttagatcctcatgtctcccttttatgaagaccttgtgattgcattaggcctatctggaaagcccaggatagcttccccatcccaagattcttaatgtaatca

SEQ ID NO: 125277 - DNA, 180 bp, Homo sapiens
cattccaaatccattttgcataagtaatgatttaattatgctactctcaagccaatacatccctagtaatttttgctaacataatgtgaaagccttctgtctgatatgtaaactttcatagaatatgatcccaatcaacacatcagaactcttttcttttgaatctctaacatgaatcct

SEQ ID NO: 125278 - DNA, 202 bp, Homo sapiens
taacatgagtataactgggaatctaccatcactttggtattactggaatgtatatcaaaaggaggaacctaccatgcagtgaggctggagaggaacaagaacttgagcttgaacttcatcttctaaggattagataagccagggctatgaagatacacaagtaaatgtacgattttgttttagaaaaacactcttctaacta

SEQ ID NO: 125279 - DNA, 349 bp, Homo sapiens
cctagaattaagcaactcagcttcacaattgacacacctacaataagcaagtccatgagggaaaggcggtccctttgtaaagacaaatggaatcggaaccctgcgcctcccctccccaacctgcagggctagaagaccttcgtacaaatcaatgctccctgaggagagggaagaggagtttcagtgacaggaagcccgctgctgcggggaggggatgctcaggcaaggccgtctgccgggcgttcctggggagctctggtgggtgggcaggccaccggtgcaggagaatcaacacaggtgcacagtccatctgctcagtaaacaggcgtgtcctttcgtttctgcttct

SEQ ID NO: 125280 - DNA, 532 bp, Homo sapiens
tgtttcatgaggcaggcatattttcagcttcaataaatactgctggttttctaaagtggttgtgacaatttacacacccaccagagatgtatgagcattccaatagctccttgacaatactaggttttgtgagctcttttccttttagcctcatggttgttcaatgatatagcattctggttttaacttgcattcccatgatgactattgaggttgggtaatttttcatatgcttattagccatttggataacctctttggaaagtacctgtacaagtctctcacccttgctttttaaaattgagtagtctgtctttttcctgttaatttgtagaacttctttatatattttagatatgagaccattagatatttttgctgtaagtatcttctccctttctaagtgtcttttcattaacagaggtttttaattggaatgtactccaatttgtcggtctttttctttttaatttgtttttttgttcatgtctaccatggtgtctacaagagcacgaagatatcctactatgct

SEQ ID NO: 125281 - DNA, 346 bp, Homo sapiens
gcattgatcctctgccacctaagaaccctcaggagcgtatcctctaataggcacttgttcttcctgagaatgttggttccccataaacaaaaccatgcctcaatgttagtagcacctcaatatttgcatatgttcagatttccctgaactgggagtgaggggagaactcaatggcaatctattgtgctgaaactccatctgttgcctgacatgtaggcatctcagaaggggtgagtagagatgctcatgacttgcccaagaacacaatagaccgaccttggccaaggagagaaatgaaaactggagccttgaaatacactgggatgaaattctacacacactctat

SEQ ID NO: 125282 - DNA, 393 bp, Homo sapiens
atcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggc

SEQ ID NO: 125283 - DNA, 103 bp, Homo sapiens
gaaatgccgggtgctggagttgagaatcttctctgagtctgaagcatcctgcctgacaggtttgctcacactcacccatgccttccttcagtccctctcatct

SEQ ID NO: 125284 - DNA, 434 bp, Homo sapiens
gaggatccccctatcatgtggtctacctatcatctctgtcacacttttcttttttcttagagacagggtttcaccatgttggccaggctggtcttgaactcctgacttcaagtaatctgcccgccttggcctcgcaatgtgctgggattacaggtgtgagccgccgcacctggccttgttttttcattttaaaaatacccgtctttttttggaatggagaagatacatcatcactaatacagttttatcatttttcttcccttcatcgaaacctttaatggatggctccccattgcctataaaatgactacattttgcagcaaggtttataaaactctttacaactggtcccagtttaccttttgctgccttatgtcaaaacaccactactatatggtattatatgcagtctcagactatatttgttctttaaa

SEQ ID NO: 125285 - DNA, 374 bp, Homo sapiens
cctagagttcacgtgagaaggaaaagggaaagttttgaagactgggtgaaatgtttagaagatgcaatgtaagggagatgtaattttggttgtagaatgcacagttttctagaagggaagaaagctgaggaagagagtgtgatgaagaaaagggcagaggaaacggccactgttgaagggcccaggttgggacagaatgacaccaaaccccttagccttaaattccaggtctgccacacctggacccaacgtctccagcttcattttctcccttccccataaccccctccctaaatacctacccaacacccgccgtgtgtcagcgacagcccacggcagacacactggcttcccttggtggaaaacaggcttcc

SEQ ID NO: 125286 - DNA, 556 bp, Homo sapiens
tgcaattttttagccaagtgtttatttttgatgcatagatttttaaatttgtggtaattgacttattgagaattattcagttacttttttaaatctgccaattgttacacattttattaagtaataacatatgttcaaacccatttttggatgaatttcaatggaagaaattggctaaaaatgctctatataccattcatgggggtaacctagaacagctagtgaagctcctgctccacttgaatgacccactccaccccacagccaccaacactgtctcccatggccccagccctgtacaatagctcaaggacctgggtattacaatggacagtcaaggtgtccaatggaatgatttagttgcttccattttggtttggtctgtggcctagtgtagaagcttagaccaaaacaatggcctcctataaattgatttagcactgctactcagagttttggcatattttttcatacatagtactaaatatatgttaaaataataaaagaaggaaaaaggagagaaagaaggaaggaatggaatggaagaaaagaaaag

SEQ ID NO: 125287 - DNA, 707 bp, Homo sapiens
ggtctcgccttgtggcccaggccggagtgcagtggcacgatctcagctcactgcaagctccgccttccggttcacgccattctcctgcctcagcctcccgagtagctgggactacaggcgcccgccactacacccgtctaattttttgtatttttagtagagactgggtttcactctgttagccaggatggtctcaatctcctgacctcgtgatctgtccgcctcggcctcccaaagtgctgagattacaggcgcaagccaccatgcccggcctcattcatatatttttaaacaataaaggttagaaattgatgggggagaaaaattttcccttggagcaacatgaattgcctccagctttccaggagagggttatatttgctattgaagaaaaaagaaaacaaagccatttataagcaatctcatccctattcccataaacattgaaaatctttcatttttcaagcaatttcaactctcaaatgcgtactgagagtttctgaaaacccatctgatgttttcatttttacttctgtaaaataatatctcattgagacttctgatatgaccatgattgtataaatccagtgttcttctcttctgttcctgaaaactacccaaaagaaaaatgggaaacaaaaacacaaattgtattttcagtaaaactaggacacagactctaacgtattttgaaaaggatgccaaaa

SEQ ID NO: 125288 - DNA, 174 bp, Homo sapiens
gggcaaacgctttacgactttctgtctcaagtgccacttgaaatacacacagggctttgaataagcttcggataaaggcctgctctgtaatctcacttaaaatgcctctttgcaagggtcaccttcctgctcagcaaccttcaatggctccccactgtctgcatggtaaggatc

SEQ ID NO: 125289 - DNA, 445 bp, Homo sapiens
gtcggttgttgactcctgtgcagtcttgaagattttagccctgactcaaggacggcagagtataaatctgggcagagtttcatgggctgaaatccactagatattacccctgaccctcagaagcctggccactaaaatggcccacatgggtctcacacatggataggggaagtggttgcctaccaagtaggatatttcacaggtcaaggcagagctcttctgagcagaaaacccctccctacttatttagtgatatttgaaattctgaccaggcacagtggctcacacccataatcccagcactttgggaggccaaggcaggcggatccacttgaggccagaagctcgagactagcctggccaatatggtgaaatcccatctctactaaaaatacaaaaattagctgggcgtggtggtgcacacctgtagtcccagctactaggg

SEQ ID NO: 125290 - DNA, 340 bp, Homo sapiens
atctctggggcacagcatgactcagctaagttgaaacagggtggccccaaattagctacatccagaatgacatcccgcttttgacagtggtgatgcatcaagccagatcaaaggcaggacacctggcagtggccatcttcctgggaagagccagtagggagctggccttagagttctgaggactcagaacagaaaagctcaagagtcagtcaagctcagcatgattctcaagtcccatcttaaacatttaggaaagtcaacagcaattgaaaaggtgaaaggtaaagtagaaagggtccaagatataccccactgatcagtctccaaacactcaccaaga

SEQ ID NO: 125291 - DNA, 194 bp, Homo sapiens
ggggctcctgaaggatttaaagaggagatacatataagtcaatgtatatttttaaaagtttactcagaatatgtgtgtaaaatggattttaggaggtaggatagtgtattagtctgttcttacgctgctaataaagacatacctgagactgggtaatttacaaagaaaaagaggttaaatggactcacagttcc

SEQ ID NO: 125292 - DNA, 402 bp, Homo sapiens
ttggcccggccgcagctcgggagtctgggaggttcgggctaggaaagagagaaggaggccaggcggccaaagttaggtcagtttgttggtgggtcgtttggaattgcgctgggtcctagcaaactgtcgccttgtgactgcagagtcacacagcgggtaagttccaactccaggaaggcctgaggtcggccccgatcgcggcgcggttctgcttccctctcctccactcagtcatcccgatctcccctccctgataaagtgccatttttggggggataacggttgatttcagtcgttcgaatcaaaacgggccaaagtttataataataatttggtactttggatcttgaatgcagcagggtgctttctcgctaattggcaccttttggtgaggaacacatg

SEQ ID NO: 125293 - DNA, 180 bp, Homo sapiens
ccctcaagaaatattggttaaattaaggtttcaaaatacattgagctagcaaaccttgatgtcacatatctgaagattcctcaagattcacttctaggtatgtatttgcaacaacaggtatctaaagaatttagaattatctaaagagtctgggcatggtggctgtaatcccagtacttt

SEQ ID NO: 125294 - DNA, 471 bp, Homo sapiens
tgggaactgagattccaagggcagaaagtccagatcattatgccacacaaagaattatgcccagtgggtcagtgaacactacacccccatgtgagatgaagtaattcgaacaagtgattaccaaaagatatcatagaatcagcgtggtcccctcgttcaaacagatccaggttcaagtcctgagtctagcacctgcttgggaacttgagcaagtcatcatcccttatttttccatcaagataacagttatgataacaagacaacagttatgatacaccagcagggttgctttgggcattaatattttattttattttattttaattttttttttttttttttttgagatgaagtctcactcttatcccccagggtggagtgtgatggcacaatctcggctcactgcaacctccgcctcctgggttcaagtgattcttctgccttagcctcctgaatagccgggattacagg

SEQ ID NO: 125295 - DNA, 552 bp, Homo sapiens
ggcctgagagagggaaaggccgtgtctgcctctcaggctcctgccctcagcatgtgaaggaatagaggggaaagaggaagtatggggtgttggaaaaagtggcatagaggctgagatgtccaggtgaaaacagacctgtggatgtcaaggcaaatattaatgcttaggctgaaggcatagatttgaagagagcggcctgcagcgctggggtcatgggcgtgccgcctgtacagggacacagggccaccatgcccagacaggcgtcacgcttggtttaatgctctgctgtccctgcctggatattcataataacctttgggtaaaggggccacatattcattttgcctcctggtaagggaagctacgggagtggaggaaattacctagaatatacagggtaaggagaacagaggacataaatattaagctcacatatttaacggacagaaggaaacaatatcagacagcagagagggaagggaaatctggtgccactctacccaagggaggaaagtatttcaagaaaaaggaagtgcctacaatatttaatgt

SEQ ID NO: 125296 - DNA, 344 bp, Homo sapiens
ttgctggccacgacacaaataagatcaatcaccccagtgtctgcaccagggacaccactgtcttcatccgtaaactctagggatgaaaccacaccacccaggcatcagggataagcatatgtaaaacacccacaccttcctggggtggagcacagatggctgctttgatggggagaacagctgcctgccagccctgggcgtctggcctcccctagagggactctcagcaaagagggatgccttgtcacactgggggaaccctgaaggccctgctacatttcccacaccctagtcaaccccctgcatgccaagcatcccctcacagtctgcctaggagccaggcc

SEQ ID NO: 125297 - DNA, 428 bp, Homo sapiens
cgttatagaggatccccgtcctgagccagctgggtaacgaaataatcctttaaaagttagttttctgacacaaccacttttgctccagtctctatcctatcctttacaaggaagttgagtagtaagtcagccagtgagaaattatgtaaattcaaccaaattacctaacctgtgagcacctgagcttttctgtttgcaaaaggcaaagaatgctagctttcctctcctctgtggagcaagagttaaggcatggcctaagaatgtgccagtcctatcctgatcccagtacacagcaattccttggtgcttttcccagtcctggtcagcctaggagaatatgacccagacgcttagatgacactctcctctcagtcatctacctggctgcaataccctaaagccactgttcttcccgcttgcctcctcaa

SEQ ID NO: 125298 - DNA, 445 bp, Homo sapiens
aggaggagaggagggattggtctcactgtctcaggggtagcagaggcaaaagaggtggaggaggtggaaggggaggcaggacaggcaagcacagttggtgtaacttttattgtaaaaaatcaccatataaatggacccatgcagttcaaactcatgtggttcaggagtcagctgtatacataaaaccataagccaaaatgtattaacttttttgtttcattacatttcttctattactgaccattttaaaaactactttaaaataaaagccagtcttactcttttcctccaagtttcaacgtttaaagaaaaccatgaagagaagtcaaaaaggccaattccaaaaaaggaagtatctctcagataacacaggtcactttcaatactttaagaacatttaaacacacaaatcaagaaaatgttctgtaaggttacagaagtgtat

SEQ ID NO: 125299 - DNA, 244 bp, Homo sapiens
gcctagatactcaagcaattgtgtcctagtaccagttctgccactaacttctatgtgtatgtggggaaagtatgtaacctctacttataacttctcatctgtcctaccaaattagatcctcgcatttaggatgctcagtttttttcaactgttaggtaggattctcataaaaattattaattggatagataatacaaagagaaattttctctaggaaactgcccattgttgatgtgactacata

SEQ ID NO: 125300 - DNA, 239 bp, Homo sapiens
cacctacctcagcttcccaaagtgctaggatcacaggcgtgagccactgtgcccagccccatttcttttgaagaggtactgagactgtgctatgttcttttgccacgcactgcctgggaagtcagctgttcccaatagatactaggccataagcagcctgttgcttatggacttcagctgggcaaaatctcctgatggtattaactttataaaaggatttatttctaaggtagactaaa

SEQ ID NO: 125301 - DNA, 305 bp, Homo sapiens
cttaattggagctcgcaaagatgtaatgataagagttgaatattacagcgatacagcatcctaaaaaaaacaatgaaaatgtcagtggcctcatgaaatcacaaatgaaaatggaaagtaatttttttcagcaataatttacccgccatttatatgacaaagtgcttaagtttgagaaactgaagaacttactagtttagctgttttcaaaataacagacttagagttaacatgagataattcagccacatttagctaattgttagtgtcaaaataaaataagcaattgattagaaattcttctg

SEQ ID NO: 125302 - DNA, 577 bp, Homo sapiens
ggcttcagagtcaccccaaggctccaagtcttagccttgcattcctcagaagcaaaaagactttaagtacgctggagtgggagctgtgacagtggcttagatgattgggaattgccttttcccatcttaaggccaggaagcaaacagtgtaacatttcacagctgacttttaatttttaatgaatgtgtttggcttctgactttgttagcaaacaaatacatcttaacttgtcttatgagttctagactctggaatctagagcaaaggaaaagtgctttaagaaacatgaaatattaacttggtgccattttaaatcttatataacttagatcttattggagttcctttatgaaaactgtaacctaaaatggatataccacatgttaagaaaccccatttacatcagtttagggttttcattttgtgtttgacgtgacactctcccacatgaaacaagtgtgcgaatcatttttgtgtttattagatacatggcggaccaactatgtaaatccatctaggaatgtgaagggactaaatatctttttagaaggtaaatcggagcttgtgatagcaata

SEQ ID NO: 125303 - DNA, 184 bp, Homo sapiens
gtgtgtgaacatttttttttcctgtgcctttttgttttaaaatcgccaactctttctctcagcaggatgatatgcttggtgtcctttgtctgtggggatgtttgaagggaacccgaggcacatatgcttcaaactctgttctcacagtttgcttcctttgtggaattttttttttttgatacag

SEQ ID NO: 125304 - DNA, 236 bp, Homo sapiens
gcacttgccaagccccagatcagctctctcacagggccttccagccccttcttccctccagatgggcaagaacacgggccactagaaagccatcacctgcagtgttcaaatcatgccccacacaaggtaaagaggtgatgtgggggccagaatcccaagtaaagggccaccaacacaaagacatcagacttggcagggaccaccacacagggctcccagatcgacccccttcacac

SEQ ID NO: 125305 - DNA, 351 bp, Homo sapiens
ggtgtttgctaggaggtgtagcattcatgtattaacggataaatgctgggtagatgaatgcgggcttgttctccatagatagtattattccatgtaaggagaataggctgtaatggtgggggagacatgctccctgcatgtcgtctaattgggaagaggaaccagcagcacgtggcagctgcctgttgattttcagaagggagaggtccatggggtggagtgatcttggttaacattatgagtcagatgagatttgaaccaagccttgaagaagtaggacattattataagcaaggacaccatgtgaagaaatggtaagtggtggggctgtttgagaggatgtaaattaag

SEQ ID NO: 125306 - DNA, 160 bp, Homo sapiens
gagtagtaaataaacgtactaatagttgtatgtcatcttattacatgtgtagattcatacaacacaatcacaatgaagatagagaactgcttcattaccataaagactttcctagtaccacattcacacccagccccctttcctccactgtctctaaatc

SEQ ID NO: 125307 - DNA, 414 bp, Homo sapiens
actcatcattaaaaaggaacaaagaggccctaacccaacctcaaagagaaggaaaaggacctttttctaaatggaagaattcttttgtaagaaacgaggaagagttagaacaagcatctgcatagcctgggaagggccactctctcccaaggcatgctgccgcttgcctctgatgtctggacgcaaacagcagatcctcaatctgctccagggtgttagtgccaaccctgacctagtgagcttactcctttctcttgggcttaggcacatcttgaaaggggagatagggatgactctgtgcatcagtccctctgtctggtccagtggaccttgtccttatgatggcctgtgaaaagatcttagtttctgagcagttatgcaagttgctcaaagcctttgagatgtcccccagaa

SEQ ID NO: 125308 - DNA, 107 bp, Homo sapiens
cacctcatttttaaaacgacatcaagcccactttcctacttttctgccagagatgtgttacttctcaccattcaccaatttgctgaaggaactctcagacccaaaag

SEQ ID NO: 125309 - DNA, 688 bp, Homo sapiens
ctggtctcgaactcctgacctcaggtgatctgcctgccttggcttcccaaagtgctggtattacaggcttaagcctcaaaataagacctgttattttgaggcctggcctcaaaataacaactttttaaccaaatctgatcaatgtttcgtattagtcttactgcataatggcagtatccattgatactgctgttaaacaaccaataaaaaatccttccagaaataatttatattacatatccagttattatattcctttgaaagaattcctgttacaattatcagcaaaggccaggtacagtggctcatgcctgtaatcccaacactttgggaggctaaggtgggaggatcacttgagctcaggggtttgaaaccagcttgggcaatatagtgagaccctgtctctacaaacaataaaaataacttactgggtgtggaagcgcacttctaatcccagctactcacaggctgaggcaggaggttcgtttacacccaggagttagttcgaggctgcagtgagctgtgattataccattgcactccagcctgggcaacagagcaagaccccatctcaaaaataaacaaacaaaaaagaatgatcagcaaatttaatttctttaaaatcttttaacctaaaatccaattttgcattatatgaaaatatccttgtatctggtttctggaagaa

SEQ ID NO: 125310 - DNA, 223 bp, Homo sapiens
ttggggtctacttttgttgttctgaatgtgggcatccagttttcccaacaccatttattgaagagactgtcctttcccaatgagtgtttttggcaccttagtaaaaaactaattggctttaaatacacagattaatttctggactctctgttctgttgttctacatgtctgtttttatgccactatcgtgctattttggttactatagcgttgtagtatattt

SEQ ID NO: 125311 - DNA, 121 bp, Homo sapiens
aggagtgaagcatcaggcatggctggatccaggggatcatgcaatgttatcaaggtgtggtcttcttcctccatttcttagtgttgattgcatttttcagccagactttctttatctgctg

SEQ ID NO: 125312 - DNA, 223 bp, Homo sapiens
atagggtgattcttatttatgttctaggctcctggaaagaatgaagaattggggccactaattcagtcttccacaaacattcttttattctattcgagtctataggtctatatgttgggagggccagtgccaaggaaaagggccattttggtttcagttgacctcacgctttgccttggattgagattgatccatggttgtcatagattgttttctgttgcta

SEQ ID NO: 125313 - DNA, 739 bp, Homo sapiens
aaagcctaaatttcacctttgcattagtgcactaatgcaaaggtgacatttaggctttacacctttgcattagtgcactaatgatgtcaaatccagttcttaataaaaccatatagacaaatctatccaatcttaatcagtttgactacaaggtaagattctcataaaccttttatgaccctttacaattttctgttaaagagcagatcagtgctctaagaataccctgttgtgcttttattccaatgttcaatttatggaaaaacagaataatacgactttaaatttagccagtatgttcacatacagaatttcttttacaagattaatctttcacaaacctttcacaacttgctgaaaccttcagttttatcctaacttaaaacaatcctttaaccttttaatctaggccaaaaaatccacattcccatgccttcttatcttttaccaaaaacacatttttattttccttacacaccttgtgtgtaaaattgtttcttcaatagtctcaattacgtataacaatgttaactcttagcaatttttatttttggtgaaaaacctggtgagtaagtgattctaattatgtaccaggtgtggagcttaagacaacagacaggagtgcagatagggtctgactctttccaccatagcgagggggcatggctaactccacatgttcccaggccttacctggaatctaatagctccaaagcaggtaagttggacaattttcaaa

SEQ ID NO: 125314 - DNA, 569 bp, Homo sapiens
gtggaaatgggttgctttgtgtgggggaagatgagctccaagaatggctctaactgttttaagttttggagttctgtaaatattccctttaggggaagaaacagttattctgagctgctttcaagtaagctcagaacgggaaaccagctgaaagtctcatttccagtcaagtgcaaagttgcaaatcttcatttggtactttatactggtttgtcataaactgccttgaagtgagtggatccacagataaacagatgtgctggttggaagggtcttccatttcagtttctgccttcctgaataatcagagtaaatgagtgaagaaacctctttgtaaaacatcttgctacaagactactcatcataaacgggtctttcctggccaggcgtagtggctcactcctgtaatcccagcactttaggaggacgaggtgagcggatcacctgaggtcgggagtttgagaccagcctgaccaacatggagaaaccccgtctctactaaaaatacaaaattagctgggcatggtggtgcctgcctgtaatcccagctacttgggagcctgaggcag

SEQ ID NO: 125315 - DNA, 417 bp, Homo sapiens
ctctttaatggccagaaagtgcatttctcgaatgatgaaactaaaacccggagggtcctcatctgtgcaggcaggtgagcatacctagacacccggccctcaagcagtcacttactccactctccattttcaacccagcttcattcggaacaaggaggggacaaaagggtgggaggagaggctgctctgtggaatgaccgtacaagttactgagagatgaaacaaaagcattcattttctattaaatgtgaaagatctctcaatctctaattggtcctgcactctaaggcaacttagcagggactcaagtacaatttccatggagagaagtggtcaaatagctgaggtcaaaccctccagactccaactgcagccaagtgcttttatttcccttgtaattttctttaagaataaatg

SEQ ID NO: 125316 - DNA, 700 bp, Homo sapiens
taggaggcactatttgaagcatttacatatattcgtgtagtcctcctagtagtctgtgaggtaggtactttgactttacccatttagaaatgagaatattgaggtataggctagtaagtggcagggctgggatttgaacacaacttgagttcttctattctgtgcctaacccttcatgtgtttatattagctgcagtaaagaaggaagaaactacagactcatctttggattccttcctctgcctcagcctcacatccatggtctcctgagctctttgcagggtactctagaccatgtcttcagtctggtttcactcattttcattgtatagtctcttcctgtctcactctattgcatcagcctttgggagctgccttccttacctaggtcaatacacattcatggcagagttaccttctggatcttgtggtttccttgctaaaagttgtaggttgcccttggcttgcagtattggccctctgctgctggagccccagcatgcctcccctacctctcccttgcatggccttcagggaggagtgtgtggccagcagtaggagcacaagaccacttgagagttaagctcacattgtgaaatagtcagttgctaattggtgtatatagttgttcccccgtatctgcgggggatactttccaagatccccagtagatgcctgaaactgagggtagtactgaatc

SEQ ID NO: 125317 - DNA, 396 bp, Homo sapiens
taaaataaatataaaataaaataaaataaaataaagtaaataaaataagataaaataaaataaaataaagtaaaataaaatgaaataaagtaaaataaaataaaataaaatagtaaaataaaatacaaaaatgaagtttgccacatcaattgaaccttcctttcgctgtaagatttctttgtagcacatgatgctgtctggtactattttaaccacagcagaacttttttcaaaactgaagtcaattctctcaaagctttctattgctttattaatattgttgtttcaacaatattcacagcatcttcaccagaagtagattccatctcaagaaatcactttctttgttcatccatgagaagcaactccaactcctcatccattcaagttttacca

SEQ ID NO: 125318 - DNA, 165 bp, Homo sapiens
tctatacctatgctctttgcagtccacttatatctgaaactctaaaggcttactgtggaaaaaataggagtgcaaaagatttattggaaaaaaaaaaacaaaactctagggaccagtatgttttaaaagtactttgggtaaagagtcatttctccaaagaagaaa

SEQ ID NO: 125319 - DNA, 296 bp, Homo sapiens
gctcgtttgattataccttgttatctttgtttctgtgttaaattttgcatcacttgatacatagcaacttgccaaggtaaaacttaaagaaattgaaaatgaaacaattctatcaatcatatagaattatgaaggggatgactggaaaattcatgaagtattcttcaatgttacaaatttctggctttttttttttttttttaaaccagagatagctatcctttgtttcatgccctcctttcaggaactaactgcatcttaccaaaaatatgcatagcctagccaggctgtggtgg

SEQ ID NO: 125320 - DNA, 443 bp, Homo sapiens
gaaagtctggaggcttcattgctgtttatcatggtgcagtggttgaagtcaggtagtggctctctgtgagccacctgtcagcttggccctcatacattccactccaaagtttaaagctttatcgtttgcagggagaatccttgcttccttacctatatgtgcccattattttaaggcagctattctcaacctgggcactattgatgttatgggccagataattttttgttatggggagctgtcctgtgcattacagggtgcttaacagcatccctggcctctaccccctagatgccaggagcactaaacaccagcctgctccccaagttgtgacaacccaaaatgtctccagccattgccaagtatcccctgggaaacaaaatcactgctgcttgacaaccactgttctaagggttattggttattatgtatcatgccatata

SEQ ID NO: 125321 - DNA, 519 bp, Homo sapiens
taaattatcttaaatgcccgccctgtctctaacctgtactgaattttaaaagtgcactgtaactgtcaaatgaaaaccagaaccacaacgaagagtccacagttgttatctgcctctcatcgtctgcttttaaaggctggagtgggaatcatgttatacaggtgaaatgggaaaagtcaagcccacatttgtagactttgagacacttggttttacataaatgagattgatcaaacagttgaatctgctcttgccattttgatctatccactttgagctgcaatacaccaacctttcttgttttcctcattcttaatgttgcttcatggtgaaccacattaggtaagaatttattaagtgcttctgatacgcctggtagcattcagggagccggagaactccagcagagttcagggctgggcacatcctatcagcctggagctctgctccctgggctatttgcacgctctatctcctccctccttgaccctttcctctgacatttgcctctgggaccta

SEQ ID NO: 125322 - DNA, 412 bp, Homo sapiens
agggcttggcatctgctgggggagcggggggccatcggaggacggcacatggcaatgtgtggtgttgcttccctcctgccttggaagctgtgagtacccccacaggattgaattgaaggcctagaaccctggatgggaaaaaccaggaacccaggagatctcgagggtcttagcgggcagacccatgtgatgtctgaaccctgaccctccccacctagtgccccaggattgcagaacacctccttccttgtagccttgctcatttgctcagaagtcaaggcccaggatggaatctcattgcctgagaatgcaggagtacgaggagcttctagggagcccttgcttctgtcgtgggagggcagcctgtgcatttaccatcccactaggagagcatgcggtggaggagaggtgc

SEQ ID NO: 125323 - DNA, 238 bp, Homo sapiens
ttcctctccagtctacccatcctctttttggacaacctgatgtacacgttaggactcctaggacatcaagtggtaactcatcattatcaccatcacacagcagctggaaccagcagcctcaccaggcctttctcctttaataatgacaaacatggtgtgcagtctgggccacttaatcctgttctgcagatggggactctgagacataaagaggtaaagatcatgcaggtgacaaagc

SEQ ID NO: 125324 - DNA, 224 bp, Homo sapiens
ccatttctcagagtgaaaagctgggggctggaaggttgtctcatacagtgagctagtggcagggatggggcgctccagagcccctagaaatttctgactctgcctctatgagcccttggaagttaagtattagccagggttctctcgagacacagaactgataagatgtgtgtgtgtgtggagagagaggaaggaattgatttattttaagaaatgggctttgg

SEQ ID NO: 125325 - DNA, 122 bp, Homo sapiens
aaattatagaacatgattctcagtaaatctaagaatcacaagcctactaagtaactacttctcacaagttcattacaaaaatccattaggtgtaatctctagaagtaattgttcttatcgca

SEQ ID NO: 125326 - DNA, 504 bp, Homo sapiens
tctgtcaatagtcccatgtcacagtcccttgtttagtttccatagtcccttgtcccccttttcaaatgaacaggatataaattataagtaaaaacctcctgagttacttccttattccacctctctcccactagatgtaaactccttgaaggcaggcagttccctatagatcctgttccacatttaacacaatatccttaacacaacgcagacctaatacatatttgctacctaaggaaggctaagagcaggtaatgattgaggcacaaagggaaagagagaaaacactggtcagaaaactgactggtttatttcccctttattttctcctgtcagtcctgtcagaaccattctagaggccaaggacctagggtggccagtctgcacagccatttgagatcccaaatcagggatctgccctccattggttcacctttggtcaggggagaattaaatgggcacaccagggcaggtccctgagatgtggcagtttaggcagaggga

SEQ ID NO: 125327 - DNA, 303 bp, Homo sapiens
ctcccaagatttccttataatgaagtgacttcccctggtctgaacaagtgaacacttgggttcaggtaagacctgttacccatttccatagcctcatgatttgcagttgccacaggaattttcccagagtgtcttttgcctaagttttccttagtttttattcaaaaggaacgcttctcaagacttcagggttttaattctatttctgccaatgacttaaggtcagtcactgttttctgggccagttaagctttctagggccccttttctgctaataaggatatagtttagtgaataaggagc

SEQ ID NO: 125328 - DNA, 367 bp, Homo sapiens
tcattcgatttgattccattctgttctattccattcaattctttttcattccattcgaatcctttctattgcagtccattccattcgagtccattccaatcccttccattccattccattacagtccattccaatagattccattcctttgccttccattcgaatccattccattctatccattccattccattccattctattcctttccaatccattcgattccattcgattcaattccatttgattctctttcattctattttattccatgccatttgattgcattgcattccattccgtttgattccagtccatccaagaaagttccattccagtccattgctttccagtccattccattcca

SEQ ID NO: 125329 - DNA, 307 bp, Homo sapiens
tcccacgacaaagaatcatccagccccaaatgtcagtagagccaggattccaaaaccctggtgttaggtaataagaattgacttgggggaaggagcagggaaggcttctcagtggaggtggcatttcaggcagagggcacagccaggggaaaggctctgagttagaaatgtttgagagacagaaaggccagtgaggttgggggatagggcagagatggcgagtggtgggatgggttttaaagcagcgattaggctggacacagtggctcatacctgtaatcccagcactttgggaggccgaggccag

SEQ ID NO: 125330 - DNA, 116 bp, Homo sapiens
tccaccggtcacagcactttcctagggtccttctggcatcttctcaaatcttggaagaaatgccagctctttttcaacattcatttgtcacttttaaggtttcactgaattagcca

SEQ ID NO: 125331 - DNA, 492 bp, Homo sapiens
gaattccacgctaaatgagttggagtgaaatgttgagcaaacaatatgtccgggctagagatacgtaaaatgcttagaacagtacttatcacatggaaattgttcagtcactgttaggccatgcatcaatggcagcatgataaaatagtcaaagtgtggccaggcatgagccagcatgcctggcagtaattggattttgaaggacagttttactttagggtagtctactgctgctttggggagttctcaggctttttggaagaaagctttctagacttaagagcatctttgcaacctggtatgtagggatggttcttatagacgtgccagcaccattgcaggagttatattctccaaatgtcaatacaatgctctgaaacctgtagatctgtttacaactgtcctcatgtgagcatcttgctgcattaaagggcctgctgtaatggatggctcatggagcttcccagggaagagcttggagaagctggcaaa

SEQ ID NO: 125332 - DNA, 579 bp, Homo sapiens
gaccacaaaagaagtgcctggtaattgtgaataaacctcaacttccttactagtcaaataaatggaagatttttaaaaataataatatcaaatattgctgaaaatattgctaatggaatgcagattagtaaagcctccctagaaaagctgtttgactttttaaaaaatgtcagaatcttatctaaaagttctatttctgggacttaccttatgaagacatcagaatctcagacaaatttatatgtagcactgattattatgtaatgaaatgcttgtttttatggtagcaaaaaattggaagcaatctaaatgttcaactttagtttaatggttactataaattatggtttagccatgtaatagaatataatggaatcattaaatatttaaaaagactagtgatatgggaaaacatttacaatgtactgttaaaaaggaaataggatgttaagaaaaaatatttctaggtgatgggattattggtggttttaaatttctttatttttgcattcctcccctcacttgtttttatattgaatgtgtattagttttataattaaaacacctttgtaaaaatgc

SEQ ID NO: 125333 - DNA, 770 bp, Homo sapiens
tggagattatgtttcaccatgaggtttagaggggacacagatccagaccatatcatcgccccagggattccgactccccaagtctggagtggggcctaaggctctgtatttctaacaagctccctgttgagcccaagctgctgctgttcctaggcaccgctgaccaacacaacacgctcgttcaaccccctcaaggtgctctgaagattcctcgaaaatacatctgagaaattcttttgacatcccggattattctccagcctacttagttataaatgagtctgcgtgtgtctcagtctgtgctgataagacggatggagtcctcctttccttacagtaacggtctcactctgttgctcactgacgctggtcttgatcttctgggctcaagcagtcttctcacctcagcctcccaaagtgctgggatcacagacgtgagctaccgatcccagctaccattgttcttaatcaatggtatcaatgtttttttaaatggaggaagaggtaacatttgccagttatatctttgttgaatgcacgggctctgaggattagacaccaggcattgtgctaaacacatcgtatccgctgtcactggatcgccaccatgactctcagaagaagaagggatgctcattccacccactgagatggctttcaaatcgacagtagaatccagcacatattctgtctttggaaaattgctccaggtgtatcctcagaacaatccagccccgtcgtcactttccacagccactgcttggcacctg

SEQ ID NO: 125334 - DNA, 666 bp, Homo sapiens
agtcataagttttagcagtgagtgtgtgtatcctgatgggaagtggggctgagggctgtgtgactgctgctgctttctgggaaaatagttttgtggtagattatgaaatatttagattacagaatatagtagacaccatgtatccccagtgtaatatttaaacaatgttaatgttgtcacatttccatctttgtttttttacatgagaagtcaaacattataggtagagctaaaatccaacttctccatcccctttccagagataatgaggagcttgattgtaaatttgttgtatgtcagttttaggcattttaaaatatattcatcagttatctgtattggtaacaatccttattaatgtttatttgtttatttttgtgcagcttttgcattccccattgttgagattaggtcatgttgatacatacagtaaataaattgctagatagtatttcatcaaattccttcactacttgtgtgtacttaatcttgtttagtttttttgtagttgtttcattcaacattgtgttcttagatttaatcatgttgatacatacagatgtcgtttatttttattactatagaactattaaatgaataaattatagtttatttaccaagttcagcagaattagaatataattagtttttatctattacagactc

SEQ ID NO: 125335 - DNA, 441 bp, Homo sapiens
tcttgctctgtcgcccaggctgaagtgcagtggcaatctcggctcactgcaacctccacctcctgggttcaagccattctcctgcctcagcctcccaagtagctgggattacaggtgggagccaccgcgcctggccctatttttttatttttttaaccagacttttacatactgataatgccatgtaacatacttttatattgtttattatctattttgtatgttagagtcctctactaaggagagattcttaatctgtcttatttggtgacttatcccaagtacctggaacatagtagttctcaataaatatacgttgaattgattttatttacatgcaacttctgttttctgttacataaaatgaaagtgtatgtggggcttacttgaatatacttttccatattacatttttttatttcgatagcaagaattttgatt

SEQ ID NO: 125336 - DNA, 417 bp, Homo sapiens
gctgggagaggggcaggcacagggtcttccctcctccctccacccaggaggctggcccggccccaggtgggtgccttcagtagcaccgtgggtgacttggcagctgccagacctgttagcccagggcagggagaccagtgactaaggccaggccccagctcaagtgagcccctggggcggtgggacgtgccatcgtagtcacaagaggtgcaacctgtcagggaggacacctgtggccctgggagctgtgcagtggctgcagcccaactagaaatgggccagtccagatgccactttcggcacgcggcaggtgtgatgccaccagggctgggccctcacacggggcctcctcactgccctgtccccacccaggggcaagcacccatctagtaaggccctaacctgcaattaaccctg

SEQ ID NO: 125337 - DNA, 278 bp, Homo sapiens
tatctaaggattgacagacacaatccctctccagctctaagtagcctgtgaaaagggaaaagaagatgcctcttccagatgtggaggaggcagaggcacaagtcgatgatcctgagtcaaagagaggacgtgtgagaagcatggccatgcccacgtcctgggtaatcgcggagacacagtgaagacgaccagccttcaaacagaggaaggagctccttgtggagcggactctacaccaggatttccgaaaggcaggggctgtggggtgacccagtgct

SEQ ID NO: 125338 - DNA, 487 bp, Homo sapiens
ttctaatagctgggtgtttgtgggggcgcagtcaggctggtgggaaaaattttagttttagaaaatatacacaaacccttctggagggctgggagtttttacatacagtacttggctgaaggcagccttgtccccttagttaagtaaattagattagaaaaggaatgtggggagtttatctcactagcttgtttacccatgtggtcctaagactaacctttgatttaccgggttcttaattgctttctactggggaggtttgcaatatcaattaccctctagtggtgttgactcaaggctttgtcaattaatctgtactgaataaatgcgagtctcactggctcgtcgaggctgctgtctgcaactgtttacagcactgttcttggagtctgtaagtggcccagatgcttagccagactggcaaagcagaatatctgtgtcagtgtactttattcatccgtcattgggtcagggtctgtgggacaga

SEQ ID NO: 125339 - DNA, 301 bp, Homo sapiens
acaaagttgggggcacaggggccctgggaaggttcacatcactgttgacacgttacctgacaactctgtgaaacctctggaggatttttgcaaggacaaaccaaaatgggtgatccaccctgtttccaagtcataaagttgtaaatgtctagaaaagtaagatacatgtgaaaaccagcctggcacagtggctcacctgtgtaatcccagcagtctgggagacaaagaaggcaggaggcttgctcaagttcaggagttcaagaccagcctgggcaacatagtgtgacctcgtcccttcaaa

SEQ ID NO: 125340 - DNA, 513 bp, Homo sapiens
tttaacctttcttcccaaatttctcacctatgcatttgggaatgattaatatctaccacatacagttttacaaggattaaaatagattgtagatataaagcacttagcattgtacctggcacacagaaaatgctcaataaatgaaactattattaatgttggcagataaagaacagaaagaagaaacaaaagataaagtactgggttgaattactagggccatggataccttctcccctggctgactctacttttcaagttcagcaagtgcgctgacccagatcacaggctcctccctgttccctcctttcagctttacaccaatccacattcctcagggagcaggttttggttgtgcctataatttaagctcttttgctcaatggttaaccttctcatttaggaagtataaacaaaaaaggaacaaatcccagaatgggctgtaattttccatcaggtgaaactggcatcaccgttgtggaatttgacatggtgtttatttctcataactag

SEQ ID NO: 125341 - DNA, 324 bp, Homo sapiens
ttgacaactaaaaagttcacaacagtgcagtccaccagatttccagtagcagaaaagaagaaaatgcaaataaaattggcgggaatcaatgaaacaaaccatgcttccatgaagacagggattagctgaccctgtctgaatagagaggaaaggagagaatggaaagtaaagaacagctgaggagccacagaaatttttcacactaaatatacaaaaagtttttcacactaaatatacaaaatgttatagggtctaaagcagagtttcttaaccttgacattttagactgaataattctttgtgctggagagaatgtcctatgat

SEQ ID NO: 125342 - DNA, 367 bp, Homo sapiens
ttctgtcccagcacactggtgaaggtgcaccaacagctgtccctctgcaaaatccagagcccctccaggaatccccaccccaaactccaggcagctcacatctcagtagatctccctctcgggccaccttccccctcttcctctcaaagcaccaccccagtcctgcccgttagcacaccaggcttctgctcaagagaagctcaagggagattagcatgtgctcatccataccacaagaattaaacaccacttgcagctgcaaggtttactagcttgaaaaatccaacactcatgaactccacactcctgtctttggggaacaggggagaaaaagaaaagcacgttagtgacagatacaggccactgt

SEQ ID NO: 125343 - DNA, 369 bp, Homo sapiens
ttacccttcttccagctaaacttcttcagttccatacctgacaccatatggtcttgaatctcattctcctcgtcctcctagtgactctactctaggctggacctgctaacccactgagcccagaacaagaaccagtgcttccggcctgctcagacccacaccgaacctgagcgggctctcccagctcccttcggtagacactgcccacaagagaccagccctgctgccctcacctggtcgcacgttgttggttttggtcacctagatgccactggaacaccccatggctctcccctctccctaagatgtccgatgtgctgagctcaggctcccatccaatctcacctctgcagcgcggcacttctccgg

SEQ ID NO: 125344 - DNA, 244 bp, Homo sapiens
atttttaatctgcttatattgctgtatttgaagtcagtttctcgtagaaagcatgtaactgatcattttaaaatctactttgtctatcttttttttaaaataaattttgaattttgtttctcaagtcactggtatgtaaactgtgttccttggagtcccagatattttccacctgccagtgggtctgtaactggaggaaaaaggcaggctgcatggtgaggttccaggccccaaaccccatgtt

SEQ ID NO: 125345 - DNA, 406 bp, Homo sapiens
ttcagataggataactgcaacccagggaggctgtcacttccccaaggacacacaggcagttaatgataatgcgaggtcacccagttctggtttccactccagtgccctttgaagtgccatttttcttcacacttcattcattaatattgctttactacctagattttctctctcttgacagcatactgcattaaaaccgttattcatggaacaggtacccttggtaactgtatgcatgggaacattgtcatattttcccaaggaagaacttggactgagtcacatgtatctaaaagtactctggtctcaaagttaagctttttttttttcagtcattttgtattcggctaaatacacaggaagaaccagctacagctttgatttataacagggcctttcatttgaa

SEQ ID NO: 125346 - DNA, 400 bp, Homo sapiens
ttccactgggcacatcctgaagaagccgcactgtttacaaagtactgtcacccacagcgccttcttttgtccatgtgacaactctcggggcatggagcaccctgtggcagcccacagtggtccgacccacccatcttctttgttaatgaaagtcaggattttattcaggtctgcccagacagtgtggctgtggggaaatctggcagatccccagccctgtggagcatgtgtggggtgaaccttgaccagtccaaacctgtaatggttaattgcataaccaaggccaaccattgacagagggatggacgcctgacaattgcagcctattaactatgtggggaagcgacttctgcaaaacattccttgctcttacgaaggaataaagggctgcacactctct

SEQ ID NO: 125347 - DNA, 374 bp, Homo sapiens
caagatatgtcaattacatgaatggtccttaaagtgtggtccctatatcagcagcctcagcatcactgagggacttagaaatgcaaattcttagacccctaccctgacctacaaagtccgaaactttggagatggatcccggcaatctgttttcaacaaactctgcagatgattctgatgaacgctacagtttgaaaactactggatcagatgcttttctcattttggctcaaaaatgacaggctcatttgattattcaatatgcagaaagatatgatctcagccctcaatgattctaacccttgactgcacattagaatcaactgggggcttttaaaaaatgaccagtgccctggaatacccccagagatttt

SEQ ID NO: 125348 - DNA, 458 bp, Homo sapiens
aggagatgggggctttgggaggtgacaaggtctcaaaggtggatgctcctgatgggattcgagctcatcagtcactaataaggcagctccagagagcttcctcgcccccttcatggagtgagaccatggcgagaaggcgtcatctatgatccaggaagcaggaccttgggatgccgagtctcctggtgccctgctctccgacttcacagccttcagagctgtgagaaatcaaggtctgttgtttccaggccacccgacctgtggcattctgttacagttccagctaagacatttcctgacagagagacttctcttggaggtcatgagatctcaaaagacatgtgttcattggcccctttgtgaatctcttcgcacgagagagaggcaggtctgcagctcagtgtctcagccctcagtgagcttcctctcagtgttcctcttcttggggaccacgcttg

SEQ ID NO: 125349 - DNA, 306 bp, Homo sapiens
gtatttgtgtctgtgtctatgtccatgtctatgtttatgtgtatttgtgtgtctgtgtttgtgtctaagtctatgactttttccatgtgtttctgtgtctatgtctgtgtgtctatgtctttgtctatgtgtatgtctgttgtgacagaggcattaaatctctggatcagagcagctcatgtcttgcttacggcaatactatcagccagagtaggattgtggcactgactctccattcccaagtcaaattcctccaagggcaatgcgatgttttcccctgtacgtgcagcagactttgtaccctag

SEQ ID NO: 125350 - DNA, 318 bp, Homo sapiens
acgcaccgtaactgcatggctatgaccccgccctcagcgtccgtctctgcacctctttctcctcatggctcctgggtggggagaggcagagggaggagagcaggcccagcttggtggggaggtacggggctgcacgtcccatcacacaggtggaggtggggcagcgggaggaccatctggtcaccttctctctctcagtcccttccccagcccccagccagcccccagctctggcttgagccaattttctagcagcctgttccccaaacagggtagccctcccatctcccaccctctccattaaggccacttgagatt

SEQ ID NO: 125351 - DNA, 501 bp, Homo sapiens
gatccacctgccttggcctcccaaagtgctgggattacaggtgtgagccaccaggcccagcctatctaatttatttctaaattttgtttggtttcattgtatccagaaaatatggttcacacagattaagtaactgcaaatgatgacaaatgtttttgaaagttgacttcacaatgtcagaacaggctttgattgaattgagctagaaacttgaaagtgatgtaataagaaattattgtttcaaagttaaatcactaagaatatttaatgagggcttttacacatagaaaacacttaagactgacattgaggacaaaaactgtccaactgacttgaagtgttaagaattctattattacacaattctgccacaatgagaactgtgtagatgtacagagagcaagtcgtgttatatttttggtcgtgttatttaatgtattacacatgtgctatagatgtttttctttgtatagtatacatgagtggacatggacaggtttg

SEQ ID NO: 125352 - DNA, 154 bp, Homo sapiens
ggaattacaggcgtgagccaccgcacccagcctgcttattgaatatttttaagatagttgatttaacatttttgtctagtacttccaatgtctggacagcttcagaagtgacttctataaaattaccttttttttttttttcctgtgaatgggt

SEQ ID NO: 125353 - DNA, 333 bp, Homo sapiens
tcagtacctggctagaaatccaaggcagagaacactgccttgtaagagtaagagacagatttgaactcagggctattaaatttcacagtttccatgatatactgatgctcttcaatcttagacctgctgtaccaacatctctaagagacggggtctggttcctggaaattttattattttaagcatagatatcttgttcttatttgaaaagaaacttgcatttaattaatttagttgtgagacagtgaccaagggggtcatttttacctaggtgttacaccaattacctaggtgttttcaataaaacctctgtctggaacactgaaagtacaa

SEQ ID NO: 125354 - DNA, 376 bp, Homo sapiens
acagtcagccaatctgcagtctctgtaaccacctgtttttcctccctggcttttcacattgctttctttcctttactctctcttctcattctctctgaaagctcgccttctttcaccaagaaactctaggtttgtcagtgggcacttcctggctctctccaatatataccacaggaccctacatggccaactgccagatgcagatggctccagcctggggcaagctgcggccggcctgcccaggtggcatgcatgctgtggtcagtggtgtggcagggcctcacttccgcccaggactactttagtgatagtgatttttagtgacagtacaggcaaagtatccaggttaggtatcagcagagctttttgagaggat

SEQ ID NO: 125355 - DNA, 332 bp, Homo sapiens
tagcaagcgaaggaactgaggatattttgttctctaaagacattatttgaaagtgtgagagatcataaatagcactaaacagttaaagaccttttccttggaagatgtattagaagaagaaccaatcagagaggcaaattgtaaatctcattgagtagcatggttccagggaggaatcaagcctcaggctggatggtttttaacattctactggactaaagcccattcagtatacaaatgggtggaaatggtaaagggtcatccaagaaaacagaggcacagaattgctggtgtgtctcagcagtgatctaacatctagctgttcatttgag

SEQ ID NO: 125356 - DNA, 217 bp, Homo sapiens
atgtcaagtgcctggcacaaagaagggtgatttccccattaaagggtatgactcggaggtgatctatctagtaggcctgggtggcttaggagggtgggtgtacagtttgtttcctaagtcagacaccctgtgcaagatggagggaggctctgtttcaggaggaactggtgggagtgaggggatttccctgacattaggaagtcagcagtcatgatta

SEQ ID NO: 125357 - DNA, 691 bp, Homo sapiens
ggctgaggtggagccggcgtcgctgccctggagcgtgggcgagtttcctcttagccggagcttcagggattgactcaaagactcctccgcttttttagttgttttgggtgtgaatacagcccggactaaaccttagtcgcctagactaaaccttagcctcccaggctgccaaaacagcacagcttttacagatgactcttacatcaccatccctactctgtgatactgtgtttttcaaagtttagtgcctgaaccatcagcatgaaatctgcctgagacggttgttgaaaattcacatcgctgggccttgcggcaggatgcctcttgaagcccaaggtttttgtttcgtttttttccatttgagtttgaaaataaacaggatacagtaaagcagagaacttggaaaggggcttacattctgcaggaatttaagtcctgaatctttggtataatcttgacctggactaccagagctaacgccgacatcagtgagacagcaccctaaaagttctgtgcttgttgttcccgaaggcttagcgagtagagacatagcaatctagagaatttgggtgcattgagtcatggcccaacagatttactctattattaagtatgagctaatctgctttgcgaagcaaacatgctctgtatttaccaccactccagatccatacgttcctcccatgtactt

SEQ ID NO: 125358 - DNA, 509 bp, Homo sapiens
tccattaaccaacttctagtccattattcagaggatatggaactgctatttatttatttatttgagatggagtcccgctctgttgcccaggctggagtgtagtagtgtgatcttggctcactgcaacctctgcctcctgggttcaagtgattctcctgcctcagcccccaaaatagctgggattacaggcacccgccaccatgcccagctgattgttgtgttttagtagagatggggtttcaccatgttggtcaggttggtcttgaactcctgtcctcaagtgatcctcccgcctcagcctcccaatgtgctgggattacaggtgtaagctaccacgcctggcccctatttatttatttatttaagagacggagtctcactctgttgcccaggctggagtacagtggtgtgatctcagctcattgcagcctctacctcctgggctcaagtgattctctaatcacagccttttgagtagctgggattgcaggcatgtgccaccatgtctg

SEQ ID NO: 125359 - DNA, 448 bp, Homo sapiens
tctggagcaaggatggggggatcatgattcagggggccccaaggagggtctatcatagactgttgctttttaaagtaactagtagcaatgctttaaattgtcattgtagatttaagaacctgtagttcaaatgtctcagtttagtatgcaaaaccctttacctccaagctcctgcctatttctgcctctctcctttatgtcaagccatcatgatttatatggtataatgccaatggatcattgtttcacaaaagttctttccattccttttagttcttttccactccttcagcaagttgaagagccctctcttgtccttcagcactgagctttgtatttcctttttatgccaaaccaggagaaacaaataggaactctgccaacttttgtttgcaaacccctttcacggtaatctataatctcacaaactcccttagaaaaaaatcaa

SEQ ID NO: 125360 - DNA, 354 bp, Homo sapiens
gcgcggtcttcctgcctcagctccacggggagctcttggacgctccgcagcgctttcgcagagtccccagttctcccgtcccgccgggactccaggaagggaaagagaggcgtggaattggcagagccctggcagcgtgatgaggaaacagaccccattctgcagtaattagaaaacgtcatgatacaatgccacgtgaagcacacaccagcacctggcaaaacgctcaacctggatcgaattactgggaaacatcagatgggtccagattacgcaggacactctccatgacgactggcctggaatcctcaaaaacagcaatgctgtgaaagacataaataaaacagaaaaaaa

SEQ ID NO: 125361 - DNA, 510 bp, Homo sapiens
aacatttccacagggcatctcactaggaaattaccacgttctggctttatgagctgaggtccccaagtacaacgttttggccgaggattccaaccaactgccagcaggataatgtggttatgctgtctgagctactgtgaaaatgcattaaaatctcaatgtttgagctcatccaagcaattaaaattaacacggactgttctgttttagactgggaaaaacaagggataggggaatgttggcctccataatcctctgctagtttcttaaacactttaaaggcatttggagctggcatggatgctatccaaactgagtgtgaagggaatctagttaggcaggaacacctccaccgctcaagtgttcaggggcagggggaatggcagatgggagcctggggtaatgagcaaaaaacttagacctactgggcacctactatgtgccagcccgagctaggtgcattcaccacccggaaaaaggagtatcttcaaacccacctgtggcaggtga

SEQ ID NO: 125362 - DNA, 680 bp, Homo sapiens
gagtatttgttttttatggtaaattgatgtttatcatacaatgaaattacattgttacaaacattattctgtaaatgttgtcacaaaataccacacgaagctgtttatctagatataatcccaggcttgtgtttaagtgtaagtggttcaatcattatacttgcattgttttgggaaattacccccagggctagcaggaatggggacgtgtgaaaaacaatcagttggggtccatcaaagccactggataagttgtgcaatcgatcattttgtcctgttgccataaaattccattcaatccagtggtgggagaaggagtcaaatgttaaactgagaaaactttgattcattcatatgatgtccacagtatttgaagtacttctgttgagagtaaagttaactggaccttgagaaattaatgagtattctctcacatgaaaaaaaaaaagtgctatgggagttgtgagatagttcaggacacttaatgaatgtctactattatccccacacagtgtaaggcagtgataggggttaggggcacaggcaagagcttccaatgccgtggtaatggggggaaatgtgttagcctgaaaagatttggtctaatggaatttaatgactttcatttaatagggagtgctgcagaaagattcaactcaaatatatacaatgaatattta

SEQ ID NO: 125363 - DNA, 252 bp, Homo sapiens
acacatcagactacaaaaaaccaaaattaggcggtgacctttgaaggtcaaaagggatggagtttcctaacagttttcctcggttacaattctacttcttctaggaccctctggcttgtgacagccaaagcaccagctcagaatctgtatcaaaatacaatgtttcaggaaattccagaaacctaaaacgagtggaaaaaacgaaagaaaaaccagagcaaaacgcaatgtaactgaaaacaggaagttaac

SEQ ID NO: 125364 - DNA, 104 bp, Homo sapiens
tgaaactcagtgggacagtgctcctgcctcccaatttacatgggctgttgagttactgaggggatgcacacatgcagaatcacctgcagttcctcgaccatgct

SEQ ID NO: 125365 - DNA, 635 bp, Homo sapiens
tggggggaacactgaaaatgggccaggtttgggagagaagagagattatgagtgttttggatatgtcaaacttgaggtgtccttctaaacagagaatatcaggaagcaattagatagataaatcaggaggtcagacacaagcctaagttggagatatgtattagtggcttctacctgtgtggaagatgcaaacaaaaccagaggagtagaagagattgccaagggatagcataaaaaataagaaaaggagaaggccaggggacatgctttgagagctctaagatttaatggctgagtagagaactattagagagataaagaactgccagacaggtaggaggaaaaccaaactgcatagctccatagaagccctggcaaggcagtattttagagagtgacaatggccagtgccaaatactgctgaaaggtgaagtaagatgacgaaagtcaatatgcactggatctactgacatcggaaagagctctttcagaatatgatggaggctaaagccagactgaaacaaatggattgtgagaaggaagtgatgaaataaactcatctcataaactctgactcaattgggtaggagagaagaggatagcagcttacaggaaatggaaataagagtctgaag

SEQ ID NO: 125366 - DNA, 589 bp, Homo sapiens
tgctaggatgtggggcctttgggaggtgatggggctgaggactgagcctcatagtggggattagtgccctgatgaaagaggcctcagagagcaccctcgcttcttctaccatgtgagcacccagcaggaaggtgctgtccaggacccagaaagtgggtcctctgcagacaccaaatctgctggcaccttgatcttggacttccagcctccggaactgggggaaagcaatgtctgctattgatgagccgcccaagctgcggtgctttgttgcagccccaacaggctaagtcaggaaccgtgaacaggagacctcccagggagtctgctcggaggggggatttgtcgtgggggaattggtcattgtgcctcagtttccccaatgttggggaagtggtgcccatggccactggcaggcccccccgggggccagcacaccaggtaggaagaaatgcaagccccaggctgctgagatgcacagagccccacattctgccttcgggacgtctgtctagtcccttgtcttacaaagggtgggcaggtcccctgcaggactcagcagagggagagacacagtcagggagcggccaga

SEQ ID NO: 125367 - DNA, 384 bp, Homo sapiens
atgattctgtatagaaaaagtttggcacttctatcatccatatcccttagctttccttttgtgttttcttatagttatgtcacccaagagagttattaaaaatattgatgtcctgggtcctacccccatagattctgatataatagatctggatacagtgtgggcatttggatttttaaaagctcccccaagtacttaagtgtatccagagttaactgctgctctgtggtgcctgatcagtctgaacctattttcatggttaagcattctggactgttaccatcaatttctgcagtgaaggagtaggcaatgattgccctaaggtaaagttgttcgtccacggaataaattgggaagtactccctcctcctgtaaaaaaaaaaa

SEQ ID NO: 125368 - DNA, 722 bp, Homo sapiens
aaacaagtttgccggccaggaagttttaatcagccctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttttgagagagaaatgagatactgataataattataccaagacaacagacataaattgggattggcctagacgagcaaagatgaatgggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttcgatagcaagtagaagaaatgttcattcaaacaggcttaattaactgaaagatataggtgtggtaaggggatcaggtaaagcttgacccaggggctaaacttta

SEQ ID NO: 125369 - DNA, 859 bp, Homo sapiens
ttccatctccccaacatcttgaagatgtatcaatttttttaaattaagaattactttaaacagcactcatttcagaagataggcagaggttatcaaacttctgctccaatcttctcattattccaaggttcataaaaaccacttaggaagaccttggttactgtgacacatcacagctataagtgtaggtggcctagactctccctatctcttagctgccctgagtcatgtgaaataagatagtgaccttctccatcatccctagaggctctctccccgagagagagtacttttagactaatttctttaggaaaagtacatttcgtattctgataacatttttattacttcatatccaaaaatgacatttcttaactgtgatcttgcatgtcattcattatctattgctgtataacaaataacttcaaagcttaatagcataaaacaatcgtataaatcattttcatgattttgtagctcaagaattagggcagtgctcaggtgggcagttgatttctctcttccatatagggttgacagaggtcccttagtgatatttagctgctgaatggactagtctggaaagtccaatatcactcttatgtctggtgccctggcagggatggctacacggctagaactgtcaaccagagtgcccagatgtggcttcttcagtatggcagcctcaagatagtgggacttctaacttgggagctcagggctccaagagtgaggggttctagtaagaatctacatgactttataaccttgtcttgaaggtcacatagagtcactgctgctctgtcctattgattgaatcagtcacctagaatgaaaaaagggcaggatgtagacctca

SEQ ID NO: 125370 - DNA, 761 bp, Homo sapiens
ggttcatatcttgtcatctcagggatatcctgtaaacccactcctaatttttagtgttacatttgtcaagttcaatattgatctttttgaaggtctcatattacctctcagacacaatgtcagtctcaactgtaatttaaaagagtaataaaaggaacataatttgtaacacaatatgtatttcaatatgcttgagcgtgaatacactagaagacataatgaagtaggcagatgcttgccacttatatgtagaatttttaagtgtataattgctacaaatgcagactgaaacagatgtattggctactcagatatcatgagtgacatttccgttgatgagatgatattcagaaataggaatacctctttgtaatattaaacaaaacagaatataagcttcccttagttttctgggaaatttagtgtatattaaaactacaactttatatagctaaatggggttcagttctagactcagattattataataggcttttcatgtacatgagtatctcttagaacatttgaaagtcaggcaaatcctggaatgattcttttttgtgtgagactgtcaatttcattgcaggatgccttgtttctgtggctgttgtccagtaaatcccaatagcaaccccttcccaataattctgacaactcaaaatgcctctcttcaccccccaccaattttcagaacaacttttcctccactgaaagtcattcaggctagattcttgtctgatagggtagaaaatatcccagaa

SEQ ID NO: 125371 - DNA, 167 bp, Homo sapiens
atacgaagcagaagggggaaaaacgtggaccaagggatagagaagagggcatggagagaaaaggctggggttgagggcttaacatattagacaagggggtcacggaaagcctccctgcttctctctgtttgctccaaactcttgcttctctttgcttgctcagcatc

SEQ ID NO: 125372 - DNA, 797 bp, Homo sapiens
gtgaaactggtgtattttttattataagggaaaggaataaggaattctatatttgatatattaattttgagatgccatgagagatgtctggccaagtggagatgtcaagtaggaagggattagatctacaagtctgaaaggctacatttggagctgcaatatacctttgggagtcatcagtgtgaggatggcatttaaaactttggaattaggtaatgccaccaaggaagaatgctatggagaagtggtggccatacctcccaagccttcattcttaattctcacatcaactgatggacatagtcatagaccacagaacaagttcactccttccgttccattaaatgcagcaaacattgtcttttctatatgaaaggtgccctaagatacagaatctacaaaaatagatgactaatatatgatgccatcttgtcaagttgctaaaaaattgttaaggagaagacaattctaatggaaaatgtagaatacgttaaggtatttgcaagggactggggaggatcttcaaaagataaatttggtaagataggatgagaacagatcttggagggccaaagaattatatttttcctgcttagagaacagggcaacattgaagatttctgatttccatgatcagattaacacctttccttctgcatccatgactaattcatccttccatgtctagctcaaatctcacctagtccacaaagcattgcccattctctgctcacatactcttttcatctttaagtcctcttgcatttattttccagcactaatccatttagcacttg

SEQ ID NO: 125373 - DNA, 704 bp, Homo sapiens
gtgccgggcctgttcttgttttttctcctgcagatgtaagatttaagattgaggggaaggggagagatggggattggagaatccaaaaaaggaaccattttcaagggttggtaatatctttcgtgttactgctaaactttagatattgactaaagaaaaaggatcagaaaagagcaggaggaagaaaaactaggtcctagtggtaaaggtattacctgagcacaggctctgtatctgcatctgcagaaggtttcagggtcttctgatcaactcagtgccatgcccacacccattccctaggtgatctaacatctgcattgaggaaatccctttaagctggaaagaacaatggactaggggtcaaagctgtagcctgtgttttctgtgtgtgtctctgctccttatggcaactttggataagtcatttaacctgaattatcttgtattttttcagctcctaaaaagagataataacgcttgccttattatgaggattgtattagacaatggatgtgaaatttctgtatcaatagtctaaaagactatccttcaaaaaaaaataagaaacttatcagtatgagtttgaaaacccaaaaaatcagttgccaacattgatttattgagcaacttttttggtgttttcaacaacctgcagaaaactagttctctgaaaaataaacttgtttcttggcttttacttattc

SEQ ID NO: 125374 - DNA, 425 bp, Homo sapiens
aatgtgttagcaatacgatagcaagaacaacaaagctgaaacaaaaccaacaacagtgaggatgctgggtgtgggccaggcagtgtgccaagcactcacaccatctccttgactaatgcttgcacagggctttagggcttccagacccttcacatcaacattctctcatctaatcattccaacactcagagtgacttactagtgttatgcccatttctaggctgaggaaactgaagctcaaaaaggtgtaggggtagctgactttgaggtcatgttgcgagcagtgggacctcttgtaactacattgattctgagtcctactgttacacctctgtggggcctaggcttagtgggggtgactcagaactgattgggttacaggaaggaagggaaggaacagggcactgtgctgggcgcctgacata

SEQ ID NO: 125375 - DNA, 280 bp, Homo sapiens
gtccttttcttcccacagttgtatcactgcctctcccctcttaaaagtggggattgcactagtggcccttaagccccagtggacccactaatgagttctatgcctacatggcaccgttgtttttcaacttttaaaaagtgggctgaggctgggcgcagtggctcacgcctgtaatcccagcactttgggaggccgagctaggtggatcatgagatcaggagttcgagaccatcctggctaacacggtgaaaccccatccctactaaaaatacaaaaaatt

SEQ ID NO: 125376 - DNA, 128 bp, Homo sapiens
taggtgggctctgccgaggtgtctccctctcctagagtccatctctctaaacacaccccaatctctctgctcagaaatcgctcatggcacactactcctgaaggctgcacatctgggacactgatttg

SEQ ID NO: 125377 - DNA, 305 bp, Homo sapiens
ctaggcccgaataaagaaaaagccaaaaaatatcagggttattatggttgagaaatttgagtaatttatagctaattgtttggaaatcttcctaatttgtatttgataatccaaataaatgaaagttcagttaatctggaatggattatgtttctctctttttattttgatggagtctcactctcttgcccaggctgagtgcagtgttgtgatcttggctgtctgcagcctcctcctcccgggttcaagtgattctcacacctcagtctcccgagtagctgggattacaggcatgcgccaccaca

SEQ ID NO: 125378 - DNA, 544 bp, Homo sapiens
gcagcaaccagacttgtaagagtttgcatggcatgttaagatcttagccattacagctttgacttttagctgacttttagtcccagctactcgggagactgaggcagaagaatcgcttgaacccaggaggcagaggttgcagtgagccaagatcccgctactgcactccagcctgggagacagagcaagactctgtctcaaaaaacaaataaaaaacaacaaaaaagacacagatgcttaggttggacacagtggctcacacctataatcccagcactttgggaggtggaggcaggcagatcaccagaggtcaggagtttgagaccagcctggccaacatggcgaaacccagtctctactaaaaatacaaaaataaaacataaaaacttcaaaattaaataagttacggttcaccattgttaccattttattttatcctatttattttgagacagcctgggtaatagagtgagatgctgtctgaaaaaaaaaaaggtttaagtttttggggggggggggattttaatttcacctatttttttgg

SEQ ID NO: 125379 - DNA, 360 bp, Homo sapiens
gctggttccatagaaaaggatgggtctgtggagtaaatggtcatgagtagtgctagccacacacattctttaacacttctgaatgcagcaggccagctggtcattactgttactgccccctcatgggagaccaaatatagctatatcattcctcctccaaaactgccttctggcaaaagttatctcttttaagaattgtgtgcattcttaaattgcattaagggaagcaaacatatggaacaagaaagcacctcacttagttccatttgctaagcccttttgcagacccactgacccttccttaattccaaatgaaatctcaaatgctataaagaaacccgccaaatgggttacagcaaa

SEQ ID NO: 125380 - DNA, 705 bp, Homo sapiens
ggccttcgcagtctccacgatcacgatggtcctctggtgtcccatctttctctctcaaactgtcctttcctcaatcctttgactccgccggactttgtcacccccacaacctggttttgggtctggccaccccaacattaaggtttaattatgacaaacatattaaacacagaaagaccctactttacttgacatctaaatgtgaatgaatttattaatgtcacatgttgcaacattaaagggacaacttgacacaattcaagaacatgacaacttaaaagtcaatcttaaaagtcatggtaaagaacacctggcagtgaaatggaaagtgctcactgtgctcagttgtacctagccaaaacgagcaacacatacctgtataaaacattcatgcatggagacacagctagtactaatccatctgttgttgaaaaatatataaatgaagtcaaagaagatgaaataaacaatccgaatatccctctgaaggaacttctccgctcaacgttctgtggcagctggtctaatatgattcaactggtcttctgttcatgtttcttacattctaattttgttttgttttgtccatttttccctgtgaaacatgacatatttttcagaagacttctatgttgtttacaaatatgatgtcagtgtgattaaaatttcagtagatggaaaaagcaaactaaagcattctttaaa

SEQ ID NO: 125381 - DNA, 914 bp, Homo sapiens
  misc_feature (87)..(87): n is a, c, g, or t
gggccttcgcagtctccacgatcacgatggtcctctggtgtcccatctttctctctcaaactgtcctttcctcaatcctttgactcngccggacttgtcacccccacaacctggttttgggtctggccaccccaacattaaggtttaattatgacaaacatattaaacacagaaagaccctactttacttgacatctaaatgtgaatgaatttattaatgtcacatgttgcaacattaaagggacaacttgacacagaaaaaaatcactggatattttcccagaagcttcaattttgtgaagaggagatactgtttttttttcagcgttaatatttcaaacttaaaaaatacaaagcaaggtttcaaaaggtcaactttctggtaactacaagtcttcagattgtgagttcaaaagcaatactgaatttcaaagagaaaatttttttttcctttcttaactccagattcaagaacatgacaacttaaaagtcaatcttaaaagtcatggtaaagaacacctggcagtgaaatggaaagtgctcactgtgctcagttgtacctagccaaaacgagcaacacatacctgtataaaacattcatgcatggagacacagctagtactaatccatctgttgttgaaaaatatataaatgaagtcaaagaagatgaaataaacaatccgaatatccctctgaaggaacttctccgctcaacgttctgtggcagctggtctaatatgattcaactggtcttctgttcatgtttcttacattctaattttgttttgttttgtccatttttccctgtgaaacatgacatatttttcagaagacttctatgttgtttacaaatatgatgtcagtgtgattaaaatttcagtagatggaaaaagcaaactaaagcattctttaaa

SEQ ID NO: 125382 - DNA, 716 bp, Homo sapiens
  misc_feature (87)..(87): n is a, c, g, or t
gggccttcgcagtctccacgatcacgatggtcctctggtgtcccatctttctctctcaaactgtcctttcctcaatcctttgactcngccggacttgtcacccccacaacctggttttgggtctggccaccccaacattaattattctttgatggacacttgagttgcttacacctttcactattgtgaataatgctgctgtgcatgtacagtggctcatgcttgtaatcccagagtttttggaggccaagacagaactgcttgagctcaagagtttgaaaccagcctgggcaacataatgagatctcatctctacaaacaattaaagtattagccaagcaaggtggtttacatgactggctactagggaagctgagtctaaccatgagaaaaacaccaaatcatcccaaattaaggatgttggatgaagtgcctgtccaatacacaaaaccgtcaagttggtgaaaaacaaagtctgagaaacagtcacagtcaaaaggagccaaaagaaatctgaatactaaatgttatgtgctaccttggatgggatcctggaacagaaaaaaaaaaagaggcattttcccaacgcaaatggcagcataagcatctgagaatctgagcagcccttgcaagcacctcacagaagctgaagaaacaaaagttggagttcagaacctatcaatgtggaggcattctagcaatgaactctagagtta

SEQ ID NO: 125383 - DNA, 799 bp, Homo sapiens
  misc_feature (87)..(87): n is a, c, g, or t
gggccttcgcagtctccacgatcacgatggtcctctggtgtcccatctttctctctcaaactgtcctttcctcaatcctttgactcngccggacttgtcacccccacaacctggttttgggtctggccaccccaacattaagaaaaaaatcactggatattttcccagaagcttcaattttgtgaagaggagatactgtttttttttcagcgttaatatttcaaacttaaaaaatacaaagcaaggtttcaaaaggtcaactttctggtaactacaagtcttcagattgtgagttcaaaagcaatactgaatttcaaagagaaaatttttttttcctttcttaactccagattcaagaacatgacaacttaaaagtcaatcttaaaagtcatggtaaagaacacctggcagtgaaatggaaagtgctcactgtgctcagttgtacctagccaaaacgagcaacacatacctgtataaaacattcatgcatggagacacagctagtactaatccatctgttgttgaaaaatatataaatgaagtcaaagaagatgaaataaacaatccgaatatccctctgaaggaacttctccgctcaacgttctgtggcagctggtctaatatgattcaactggtcttctgttcatgtttcttacattctaattttgttttgttttgtccatttttccctgtgaaacatgacatatttttcagaagacttctatgttgtttacaaatatgatgtcagtgtgattaaaatttcagtagatggaaaaagcaaactaaagcattctttaaa

SEQ ID NO: 125384 - DNA, 522 bp, Homo sapiens
  misc_feature (87)..(87): n is a, c, g, or t
gggccttcgcagtctccacgatcacgatggtcctctggtgtcccatctttctctctcaaactgtcctttcctcaatcctttgactcngccggacttgtcacccccacaacctggttttgggtctggccaccccaacattaactcaagaatggaataaaacatgctacatgaacatttttatattgtcatgatttatcatccagaaaaaaaggagattttaatactactttgaaggagatggggaactgccaagaaggaaaatatacaagtgttcatgtgatgagaggtactgaatcactgaaaataaactggcctagaagcaataccaggatcgagagagatggattctcgctctgtcacccaggctggagtgcagtggcatgatctcaactcactgcaacctccgcctcccgggagaatggcgtgaatccaggaggcggagctagcagtgagccgagatcgcaccactgccctccagcctgggcgacagagcaagactccaactcaaaaaaaaaaaaaaaa

SEQ ID NO: 125385 - DNA, 269 bp, Homo sapiens
gggccgtgcctgtatggggaggggaggaggcccaaagatttgcaaaatgtttatttcagtgagactgtgtctgtatgtttgcttgtgtgcatgcgcgtacacttgtgcataagagtgtgcttacgaatgagcgtttgtgcatgtggaagggctgccatggatgaatgctcaggctgtgcactgtgtaattccaggaagtgccatttacatagacctcaatgtgactggcacgtgcgcaagttgcacagtgctgtatgagtgtgtgtatg

SEQ ID NO: 125386 - DNA, 426 bp, Homo sapiens
tccccccactggctacacttcccagcctcaagtaacaaccattctactctatcttcatgagtttgttttaatattcagctcccccaaatcaatgtgaatgtacaaagtttatctttctgtggctggcttattttacttaaaataatatcctacagcaccattccatgttgtcactaatgacagaatctcattctttgttatggctgaaaagtactccatcatatataggcacattttctttatccattcatctgttgatggacactgaggttgcttccacatcttggatattgtgaatagtaatgcaataaacataggagtgcagttatctcttcgatatattgattttctttttttgtgtatatatctagcaatgagattgctggatcatatgatagctctaattttagttttttgaggaacctc

SEQ ID NO: 125387 - DNA, 774 bp, Homo sapiens
catggtggctcatgcctgtaatcccagcactttgggaggccgaggcaggcggatcacctgaggtcaagagtttgttgagaccagccgggccaaaatggtgaaaccccatctctactaaaaatacaaaaattagctgggcatgggggctcacgcctgtaatctcagctacttgggagcctggggcaggagaattgcttgaacccaggaggcggaagttgcagtgagccgagactgcgccattgcactctagcttggtcaataagaaagaaactctgtctcaaaagaaaaaaaaaaaatctgaaagagaggccaggtgcggtggctcacacctttaatccagcactttgggagttcaaagtgaagggactgcttgaggccatgagttcgagaccagcctgggcaacataatgagaccctgtctctaaaaaaagaaaaaaataattctcaaaatggtattagcactcctgtgttctttacaacaatattcacaatagccaaatgtagaaataacccaaatgggttgaatggatgaaaaaaatgtgatctatacatgcaacagggactactacaattaagccttaaaaatatgcgatgacaggccaggcatggtggctcacgcctgtaatcccagcactttgggaggccgaagtgggtggatcacaaggtcaggagttcgagaccagcctggccaatatggtgaaaccctatctctactaaaaatacaaaaattagccaggcgtggtggggcatgcctgtagtcccagctactcaggg

SEQ ID NO: 125388 - DNA, 452 bp, Homo sapiens
atatgcaggctgtcaatgagaacaagtgttgtgtggggtcctgtgtgttttcattgtgtgcacacgcagtgttgtgctaatgctgtatataagcacagatgggtagtgtatgtaactggggtgctgattttgtgtgctgtgagcacagtgtgcatgttctctgtgctgtttgtatgcaatatgtgtgtatgtgtacagggatggtgtgttctgtgtacacagtgtgagtggcatgtggggtaaggacgagacatctgccacgactgtgtcccccagctactagcactaggctttgggtagggagaggagggtgatctcctctgcttctgtccttgcttctgcagggaggagcagcttttcttcaagtgacatccatgtggtggctcccatgggggcagtgacccacctctcctgcaggttggcctgggtagggtacgagcctgggattgtga

SEQ ID NO: 125389 - DNA, 255 bp, Homo sapiens
agcacaaggaaacatggcaagggtagaaaattgaatcaagttatgcaaaaagacaaaactagagtctttggaagaaaaccacttgcttcatggatggcctttggcttagtggggtgcagtgctttctctgtcaagaggcgccccaagaagagatcctaagagaagtcaaggcactagccatgtgtcacccagggttgtcccacctgtgtcctgggagctcccaccctccaacgataagctctaagtgggtccccc

SEQ ID NO: 125390 - DNA, 804 bp, Homo sapiens
tttctccacatggctagactaagaaggctgcaaaatctatcactgttatgggctggaaagccaaccaggagagccttcttaggacttctaaagggaaacattctggatgaacctcttggtcttgtaagaagggaggctagttatgtttaactataaacacatggcagtaggtgtcagcgatatgttccattcgaagactatataataaacatcatttttggaaaaggaaactaaactaagaatagataacctgagaatgccatgcaagggctagagcaacttcccatccttttgcaagcatttagcaatcaggtttcgcctttagctgaactcctttcatttcatgcaatatttaatttatacagagatgattcatttgcaatagtaaatcatcacaacattctgtaaaaacaacaacaataacaaaagactagaaatataggaggcctacaacaagcacctaatttaaaactgcagcctcttcctatccccaaattggccctcctctttcctgctctgtttttaaatttttttcctagcaattaccaccttctaacttactataatttgcttgtttattgcttattttctgttttcctccaatagaatagaagctctaagagggcagcaatttgtgtctgttttgttcacagacacatcccatgcattgagaacaatgcctggcacaagcaggtgtgcaaaaatgctggccgactaaaaaaagtcatggatgggttgtcaatattgcataaagtcctattctcagatgacaattgaggtggcctcatcactaactacaagaga

SEQ ID NO: 125391 - DNA, 727 bp, Homo sapiens
aaataaacttaagaaccttaggagtcctaataatatgtatatatatgtaaagaaccttagagtcctaataatgtatatatgtataaaaatcttttctcttgttcgtgtaacctttgtttctaattttattgtttattgtggttatcacaatctcattttttttttgttgttttttgagacacaggcttgctctgttgcccaggttggagtgcagtggcacaatctcagctcactgcaacctctgcccccgggttcaagcgattctcctgcctcagcctcttgagtagctgggactataggtgcacaccaccatgcccagctaatttttgtaattttagtagagatggggtttcactatattggccagggtagtctcgatcctctgacctcgtgatccacctgccttggcctcccaaagtgctgggattacaggcatgaaccaccccaccaggcctccatcttgtttttgaaaggaaaataatcaggccatttggagaaggagaatattatgttcacggtatttggggagttgggcatgggggtgctgtgtaacaacaattcattgataaattatgtatccagacaatcagactataccaattacacttggtgtgtaggtacaattaaaaaaaaaatcagtacaccatgtacaggaaaggattagggccatagaacgctgctatgtttaatatgcctgtgagctactttaaattcttcttagaaccaa

SEQ ID NO: 125392 - DNA, 217 bp, Homo sapiens
tgatctcgaggatctcacgtaatatgtaacaaacctgcacgttggcacatgtactctagaacttaaagtatagtaaaaataaataaatagaagttaccttctccctttttggagggcaatttgaccacatctattaaaactttaagtgctcataaaatttgaccttgcaattttacatctggcatccatcctacagaaacactgaagtctgtgcaca

SEQ ID NO: 125393 - DNA, 479 bp, Homo sapiens
aacaatcaagacaggaaattctgcagacataaattcaggctagcggcaataggaatggagaaaagtgaacaaaaatgaaggatattgatggggtagactcaacagatggatagcttgtttcatgaagatttagaaaccggaaggagacacaagtttggagtgaagttgaggactcctgttttgtacactttgatttgaaagtccccatagacttcaatgtcaagatctccagcagacaacaggatatatctggagctccgacaagaggtcagtgataggggagtcttcagtaaattgggggttataaaaatggtagaagtgaatgagttatcttatacagaaagagtttacagagtgaacacagtcaaaagcaatgtagagacctccagagaataccattttaagggctaagtaatgaagaggtactcaagaagctctgcctctaatctatgaaaatagtgagtaatggacaaccaaac

SEQ ID NO: 125394 - DNA, 165 bp, Homo sapiens
gatctaggaacaaaccctggggtctctcttaaaaatagaccccacctgtttccttattactgactcacaaaccacatagcaatgctccccagtggctccaggagacggagcatgggagcctatcccattccagctcagcagaatggagccagcacaggatgccag

SEQ ID NO: 125395 - DNA, 394 bp, Homo sapiens
ctcaattaggcatgatgttcaaatgcctaggcattccctggggcttctggcattagtatcttggctcctggcatagttgttcatgacgaaaaaattatctgctcccctttgtcaacttcattattttatactttcaaagttctcgttatacttttggatgtcttagactatgctactgaatgtatgtttcccgcacgaaactttgcacagcaaaggacaaaggatagtccagactctttgttaaactggctagtcccaaattttctctaactggcacacttccagaagtgaaattctttctttattgacttcccatttagagtaaatgaacccttctatttgtttctatgacagacataaaaagaatttttaaatggtatagttttacctaaat

SEQ ID NO: 125396 - DNA, 475 bp, Homo sapiens
tgggagatatgggcactaggcatggggatgagaatgaggcaagacaggctgagcacctgcttaaaccaggcccttgcagtgagcccggccaaatcaggcctttcaggtccttacatggcaaaatgtggtgatggttaattttatgtgtcagcttgcctgggctaagaggtgcccagatagctggcacacgtgactctggggtgtgtctgagggcatacggatgagatgggcatctgaattggactgaatagcatctcacactccggaacgggaatgggtgtcatccaacccgctgagggctggaataagacatggaggtggagaaagggagactgctctcacctcttgagctgggacgtcatcttctcttgcccttgaacatctgagttccgggttcttgggcctttgggtttggactggaacgacaccactggctcgcctgtatctccagcctgctgacagaagatcatgggac

SEQ ID NO: 125397 - DNA, 132 bp, Homo sapiens
cctacacagggaagtgaggggtcttatctgcatattcttttcccaaggcccaccaaagacagaaaagtctcagtaataaaacactcaatgaaaccaaattcattgagtgatttatagctttatttttttttg

SEQ ID NO: 125398 - DNA, 398 bp, Homo sapiens
cttgcctttctggacttttcaggcccttgctttttaagatttgccaagttctaaggcagaggtaccactggctcagctgtggggcagcagggaagttggggccactgcatctccatgcatgtctgtgtttgaccaggagagaaaggcaatagacagttaacagcagtgatcagggaaggaaaagtaaaatatgtaaaggatggagagtgctctagatgagtgacatttttctagattcctgaccatgcacagcacctgctagctaggcagggctcagtcagcacctgtttaatgaatacgttgctaggtactctgcatctttgctaaaagactatatctaatgttgatataccatcatattcttgcttcaagttagttgccaaatgtatataatcttt

SEQ ID NO: 125399 - DNA, 454 bp, Homo sapiens
tcccaggctgggcatcatctgatgggaggaaaatgagggccccagactctgtgtcaccctggcaggacccctcccctcccatggctttgaagcccatgagatggccttggacaaaacggcaatgggcccttccctgagacacagtgcggccatctactgggaaactgcccagtgtgactctgatgactgtgatgtgaatcccacagcaaagttgagcagtgcgcaacctgggctactgcacctggcagccctggctcctcttcctctgcctcttcctgctccttcattctcccccagagctctaattgtcactgagattttatgtttcgtttaacaaatgactgtctccccgcttgaacagaacctccatggggggagggaagagtgtctgttgtataaatagttgtatttcagtgcataaaacagtgcctgcctcaaagggaggactcagtca

SEQ ID NO: 125400 - DNA, 763 bp, Homo sapiens
agttagcatgaagcgtggttattctatcacggagatatgctcctcatccacaaaccagagggacgcacggtccaatcaccagtgtcaggttttactgtttggttttatttgtcaaaactactgctttacatgcagaggagggaggagtgtgtgtttcttcgggtgggggatggagggagcattatagaagaacacgcatcccagtgacagtatttttaaagactctatctaccatcttttctgaactaacaatttcaccttgaaatctgttacaataagtacctttaatcaaaagccatttgttttccattcttttctatgggcatacattcactatagctatttactgtagttcattatttcagcatattgcaattatcattgttgtagccttcaatcctattgcattaatgtaggagtatgaaaaagtcagaaaggaaaacttaaaacagttcattttaaactgtattgcctgttaacaaccctgtccaaaattttagtaggtaaaaaagctgaaccactgcctacaagaagaccaaaagattgtctgaagattccatttagtacttgtttcctgttctctgtaaaacacggatattctcttggtaaagacattccatttctatttctatctagtgaccatcgaatatgttgtaacttgtttacctatttaatagggaattatagcaataatcataggattgcggtggcggtacaataaaaccagatatatttgtctcctatttgccttcatagtaacatt

SEQ ID NO: 125401 - DNA, 501 bp, Homo sapiens
ttcaggagggccaaggaaagggcctcccgcctggaccgggtgtggaattgacgctgagtaacacacctgtgcaggtggactctgtgagcaaggcaagaggagatgaggagagcatccgcaggggaagaggccaagactgcatcctgagaaggaagtgttgtcagttgctcttgctggggtgaagctgaccagaccgcaggttcttcctggagccagtgacaatgccgacagctgacacagagggagcacatgacttgcgcttggcattttcacctgcattatcttgtttattcctcacatcaaccctataaggtatgtgccattactgtccttgtcttccagccaaggaaactgaggcacagccctatcaaatgactcccaccaggtcacgcagctgataggtgccagagctggctgcagacccagggaggctgcctgcagaccccaagctacaaacctgttctaatggctgagagctgaacacacctccggagcctccca

SEQ ID NO: 125402 - DNA, 106 bp, Homo sapiens
aggacaggcctggagggacattccagaagaagaatgaggggcttggtgaataactggaagaaacgatgagggaaagaaggagtctaagaggaggcaaatgacagtg

SEQ ID NO: 125403 - DNA, 609 bp, Homo sapiens
aagtggtgatctagaggatcccgagctctctctgtggggtggaatgccagttcaggagaagtgtttgacacttggtagatatttatgaaatatttgtcgtacaaatgaatgaaggaatgaatgaccaaaaacttggaaatcaggaaagaagattcaaatggaactgtcagatctagagcagatcttagaaatcatctggtccaacccagagagggtaatgactggcccacagtcacacagcaagggctggagtgtgaaccaatggactccatgtctgcggctctttctaccttcccacttttgctgcttgggctgggtctgaaggatggagaatgtgattggccaaatactcagggaagacaacctaggagtgcaacataggcaaagggaatggcaggggttagggccacatgtgaagggaatgcgaaaagggggaggaggggaggttcatttagcacctactatgaggcaggcactagcatggcatgagctgagagaaaatctctgcagggaaagcctggacaaagaggcggaaaagcaagaacagccagagaacgtaaggagccgcgaaggtcaggccaaggaggctggctgggcgggttttgacag

SEQ ID NO: 125404 - DNA, 255 bp, Homo sapiens
taggtgcagatgaagatcaaaatattatctttatagtaagtgataaggatgactggagaacatggctgagatgtgtaatcacaaatggcctttcttatactttcctatactgaattcaacttacctaactggacaaaatgcaggctgacctggcatgggcagaccggctagagcatggaagtgggacaaaacataaaaatcctgaagactgggccgggcatggtggctcgtgcttgtaatcctagcactttgggg

SEQ ID NO: 125405 - DNA, 809 bp, Homo sapiens
cggctttgccctgtgttattaattggaccttaggcaactgacaaacctgagtcagtttcctcacctgtaaagtaagccaagtgccctcctaacagggctgatgtgacgatttataagacagcaatacacacacaaacacgcacatagacaggcacacacgtgcacacagacaggcacatgtgacggcatacacacatggacataaacacacactggcacacatgcacataaatgtgagcacgtgcagacatacatacacatgaacacatgcatacacatgcacatggacatgaacacatacacctgcacacccactaaaacacaaatgtgagcacacgcacacggacaggcatacacacgcatacacacacgtacaggaacacatgcacacacacgcacgcatttgtgcagtataactcctggtctgttacacccaacagcatagagtcagtgataatttgtcatttgatcaattatccatcactccagtctgatttcttacaaagctgcattcttagaatgattccagcattgtggggactcaggtataatagaaactagtcccagacagtcagctttggactctacaaggcatctgagtgaagagaattaccctcagctcctgcaaacctgctggaggagcaatatttaattcaaggtccatctaataatttctgagctggcacatacatacatatgtacattcctctctgcactgttccttctcctgttctttctgcctaagaagttaaaatgaacactggcaagacaggaaagaaacttggatatttttcaaacttaaataaaac

SEQ ID NO: 125406 - DNA, 318 bp, Homo sapiens
gaaccacccactgcccttggaaatgtccactttaagacactcccagccccagacctcctgggcgaatccttcttgccctcccctcccatctccaggaccaacttccagatagccgaaggtgggtttggcacgtactgagcctcaaattccacatctaaaaaactgagaggaggccgggcatggtggctcatgcctgtaatccaagcactttgggaggccgaggaaggcggatcacttgaggtcaggagtttgagaccagcctggccaacatggtgaaaccccattttattttattaaaaataaaaaaattagttgggg

SEQ ID NO: 125407 - DNA, 299 bp, Homo sapiens
cataaaggaattagaaaataaagctgaagaaatcacactcacaaagtagaaaaataatgagaaaaagataaaaattagagataaataataagaaaattagaagactgatcaagatggtccaatacacatattgtaggagctccagaaatgtcaaacagaaaaccaaggtattcatcagacaatattccagaaaatacactagaactgaagtacatgaatcaccaagatagaaaggattcactaagtattttacacaatggataaaaaaatgatccaacctgaggcacaaaaatgtaaaa

SEQ ID NO: 125408 - DNA, 395 bp, Homo sapiens
cggtagctcctgctctgattcctcctccacattgctactgctgcctcacactgccactgttgctcaggactgctctgtggagcagccagtttgctgtacactgctcctctgggctactctgggctactctgtctatgggacagccctgccctgtctgcggagccaccattttgctatacactattgctctaataaacttgctttctttcactgtcaactcactcttgaattctttcttgagcaaagccaataaccctcccaggctaagccccaattttggggttcatctacatcaggctcagagagaccttctccgatcatccaaaatatacagtccatccaatgtatctaacatatttcctattttattctcttcatagcactgaccacaaatg

SEQ ID NO: 125409 - DNA, 373 bp, Homo sapiens
aactagtaaatacaaaaggaatgacagagttagaaacaatcattttacaacatcataatagtacttgattcaggcaagaatcattggtgactgcaaaactatttcataaaagttgatgaggaatataatatgtatacaaaatacttaataccagaaaaagttcaccctacagtggagaaacctggcagatactatgtttgctaaagagatcacagttgatgtcaccgaatctggggcaaactggtatcttgtgccttttgatatgatgaacttaatgcagtgtaaactgcattactctcaaaatgtgtaacctcaatccatgcatgaggaaatatcagaaaaacccaaaaataaaagacattccacaaaactc

SEQ ID NO: 125410 - DNA, 702 bp, Homo sapiens
ctacatgctgacatatgagactttaccagctcttcccaaattcattcccagaacactgaaagcctgacttatatctgtcaggttgaggattgaaggatgtctttttggggtaattaaatagcccaaggagggggaaatagatgaggatgtatagctgtaggcatctgaaggtcctaattaaatgggcaggtcccttcctgatcaccctccagaaagctaacccctggataaggaaactctcccttacccctcccctcctacacacacatacacccaaaatcaagctctttagggtctcgctcttaaatatcagtggatagacaagaatgatcagacatttgataaaaatctatgaatgaaagatggtgaccaaagacaaaagaggaacttggaggaaacagagacaatgtagggagcagaagaaaactaaaacaggctgggtgtggtggctcacgcctgtaatcccagctactcaggaggctgaggcatgagaatcgcttgaaccagagaggtggaagttgcagtgagccgagatcacgccactgcactccagcttgggcaacagagtgagactctgtctcaaaaataaataggccaggcaccgtggctcacacctgtaatcccagctctttgggaggctgaggcgggcagatcacttgaggtcaggagtttgagaccagcctggccaacatggcgaaaccc

SEQ ID NO: 125411 - DNA, 406 bp, Homo sapiens
tgcacaatgtcgtgcatagatttaatgccactgaattgtgcacttaaaaatagttaaaatggtaaattttatgtataatttactgcaattaaaaatgctttcaaaaaacaagaaatttttaagagtaagatgcactacttttttttgtaaagtttgtgagacataattgtgtggtatgtggaaaggagaatattttcatttttgcatttaaaagaatatagtgttttagttgtctgtcatttatggttttcttccttctgttttcagagagtgtgaatttctgactttctatgtgggacccaaaatctttagctttagatgtaagtgagatgacctaaataccactgactatgttacatctttgataatcaaaaactaaattttgataagccagactagactacag

SEQ ID NO: 125412 - DNA, 521 bp, Homo sapiens
ttcaccatgttgcccaagctggtctcaaactcctgagctcaggcaatccacccgccttggcctcccaaaataatcctcacacctaggattacaggtgtgagccactgtgccagcctccagctgtttcttcatagggtaaattgatgaaaatgggagggcaaggtgcttggtgctaatgtataaaacaacaccttggcatgtctttaacatgatattccattttattgcaatgtttacaaaatggttaagtttggtaaccatatcttctaattttaagatctaattgcatccgctgacttcctcacttagattaaaataactttaaattaaaactttgagggttttggtggagggaatagtgcttttgaatgaatatgcagatgatcagcaaggctggatggggctggtgtgagtgatgtggcaaggacagcagcttttgcaggggttgcgtttgcatctgccccaagaaattcactaactccttgtttggagatgattattgaaggttgactaattgatga

SEQ ID NO: 125413 - DNA, 533 bp, Homo sapiens
ttcagagggacgttgattgccacttagcccgatcctccggaaactcccacactgcctttccaacaacgaggtgatcacccagactctgagtacttccatggacagggagctcattcctgtgtttttgagggagtcttttccatttatgcatttctctcctgtactgaggtgaattctgcctttcactgacttccgccagcagcctggccccctcagactgagatagctaccatactgaatgctgcaacagccagggggtgaccatgtcctacaccaggaaggggaagaagcccgattcactgagccaatgcatgactgcgtgccaggctgattggtctcacacacttacaatctgtgcagggggagagtgaggctcagaggggttcagtctcttgcctaagctcacgtagcaagcggagaagccgtcctcataccccaggtccctctgactccactgcaccgcttgggggaacccagtgccaatgtcacaaggttcagggcagagggcccgtgggtgcccacagtagggcctc

SEQ ID NO: 125414 - DNA, 664 bp, Homo sapiens
agggcagaattagattattaatacaataattattaggcaggtaggatggaattttggaagaaataaaaattttagttttagtcctctagtgaaattttattatgtggagatcagacctcaggaatggagttgatccagaagtttaaaaaaaaattttttttctgaaagcttagaagcagtctctaattgtgaagagtttcagtcacatctgactagctgtgagtaattggttaacccaccagaaagaaaaaaacgagtcattggttgcgatcaaacccaaactggcagtgaaaggaagactgacaagtgaaactcaagagcagataataagggaaatgcaaagagcagatgccttggtacaggttagaaatggagggtagaagaggaagttaaggagcagatactgttgagattgagataactatagccaacaagaacagatagaattctgcagttaaattctgcactgggagaaatgccagcagtgaagggtggaagtggcagagtgccatttagagcacattaagctaaaagatacttgttacgttgctgtgcagtttttggtacctcttggaggaagctaatgattaactgctgtttcttcattgtgaaaagtagaggacaatgaggctgggggattgttttacttttgccacacagtagt

SEQ ID NO: 125415 - DNA, 366 bp, Homo sapiens
ttttttgtgtatgtctttagtagagatggggtttcaccatgttaggatggtctcgatctcttgacctcgtgatccgcctgcctcggcctcccaaagtgctgggattacaggcatgagccaccttgcctggccgaaagtatcttcattttaaagttcactgtttggctactctgttgacaagagtttagtatttctcaaggaggctaagatacctattcctttttggatcctacctctatcaggagggtgggccttccttgcattgaaacagtatgaaacagtagccctgaattcataagtgggacacctttcttctattggtagagcaggcagtttttttctcctgccaatggtgcctactaagga

SEQ ID NO: 125416 - DNA, 283 bp, Homo sapiens
attttgcattctgagggaagtaggcattccataattcttccaaaggttatttggattcttttctgtgttttgaaataagacatggttgttacaagggaactagatgtgagttaaaatgaattttcgtataaaatgatttttatttccttttattaaaagtgacaaattgttaaacatgtgttgtcctgactttcttttgtgacactttttagtgtaataaaagttgctaataaaattgtaaatgtgtggaagataacatatactagatgaattataatctttt

SEQ ID NO: 125417 - DNA, 738 bp, Homo sapiens
gcctgtacgaaccggaaactcaggccccctcttcctgaggaggctgccatggctccagctgttgactcgctctcccctctcgtgtggaatgagtgccctctgctggccgtccctggcacagccgctcctgtcaccttggcttcccaggaaggagctcccccttcacccacccacccccagctgcctcctcctgcaaggtcagctgtgcctggataaggaggagctttgggccgggcacagtggctcatgcctgtcatcccagcactttgggaggctgaggcaggcgaatcacctgaggtcaagagtttgagaccagcctggccaacatggcaaaactctgtctctactaaaaacacaaaaattagccgggcgtggtggtgggcacctgtaatcccagctactcaggaggctgaggcaggagattggcgtgaacccgggaggtggaggttgcagtgagccgagattttgccattgcactagagcctgggcaacaagagcgagactctgtctcaaaaaaaaaaaaaaaaaaaaaaagaacaaaaaaaaaacccggggggcatcatatgggggggaggggaaaaaggggacagaaaagggggaccagttgtgccacaaagagggtacccggagccccagaaatttgtgggaccacagggggggaaaactcgggcgaacaccccacaagtaggggcgtgaaatataaatggacaaaaaaccagggtacaccgggcgtataag

SEQ ID NO: 125418 - DNA, 230 bp, Homo sapiens
tctgccgtgtcagaagtaagctggtttaatccgcacagaaatccaagccaacagttcatgtgagctcaagctttctgactatgggcatcctatctccagttacaacacagtatttaatatacccatggacacagaaagtagaataatgattgcctagtgctggggggtgtgtggtggttggggaggaaatcggcttttgattgccaatgggtatgggttttcttttttgg

SEQ ID NO: 125419 - DNA, 477 bp, Homo sapiens
agtaagggttccaccagttcactaataaaccccatctaaatgccagtaactcccaaattaatacctccataccaggtctttccctgaaccccatattcctatccaactacttactcatgagcatagtcggccctccctacatgtgggttctacattcatgggttcaactaaccgcgactgaaaacatcttggggggaagcatctgtactgaacatgtatagaactatttttcttgtcattactccccaaacaatacagtacaacaactatttacatagtgtttacatcttgcccctacatctattctctaaacagcagctagagtgatccttttatttatttatttatttgagagggagtctcaatctgttacccaggctggactgcagtggtgcgatcttggctcactgcaacctccatctcctgggttcaagcaattcttctgcctcagcctcccgactaagaacctgagattac

SEQ ID NO: 125420 - DNA, 131 bp, Homo sapiens
cactagagtggctgtaatccaaaagacttgcaatactaagtgttggtgaggatttggaaaaactgaaattctcatacattactgatgggtatgtagagcagtatagtcactttggagagccccttgacaag

SEQ ID NO: 125421 - DNA, 475 bp, Homo sapiens
atctccactattaccctacttaaagcaagcatcacctttcatcaggaccacttcagtcacctcctaaatgcagtagtcccccagttatccatgggagaaacattctaagaaccccagtggatgtctgaaacaacaaatggtactgagcacttgattctgttttttgctatacatacatacctataaaaagtttaatttataaattaggcacagtaacagattaacaacaacaataaaatagaacaggctgggtgtagtggctcacacctataatcccaggattttgggaggctgaggcgggcagatcacctgaggtcaggagttcgagaccagcctggccaacatggtgaaaccctatctctactaaaaacacaaaaaaattagctgcatgtggtggcacgtgcctgcagtcccagctaagcaggaggctaaggcacaaaaatcgattgaacctaggagactgcagtgagccaag

SEQ ID NO: 125422 - DNA, 574 bp, Homo sapiens
tacttgttcacagggcatggtcatgggtttgagttgtgaaatatggacccttccatgtgggtatcagcacagagaaagcacaggacattagtggtaggaaagaaaaaagaaacaatacctttcccctagattccagtgcattattttgtttcccttccacttacttatcctcatataaatgcaagtgttcagagctagaaacctcaaagatgcttcctgaattcaagcccagcgtcttcaatctggggcacagagtatgtgaaggaagctgcaggatacaccccagcagttctgtgtcattaacagtatttcatacaggaatagcttctaaattcaccttgtaagcatccacagtgaatctgaaacaagctttctgagatttccctttctaaggtgatttggtgtatgtgggttctcacatcagtgaagctaggaaatccaagctacaagagttaatctctgtttcaaggcgggtaaacaccttaatgttttctgagactcctggtgctaattttcatgtttaaaatgcccacagaaatatatattaccctgtggaaaagtaagttaccaaaag

SEQ ID NO: 125423 - DNA, 491 bp, Homo sapiens
ctggcgcgtgggcgacatattacaacgtcgatgacttgggcaaaaactctgagtgcattattttgtttcccttccacttacttatcctcatataaatgcaagtgttcagagctagaaacctcaaagatgcttcctgaattcaagcccagcgtcttcaatctggggcacagagtatgtgaaggaagctgcaggatacaccccagcagttctgtgtcattaacagtatttcatacaggaatagcttctaaattcaccttgtaagcatccacagtgaatctgaaacaagctttctgagatttccctttctaaggtgatttggtgtatgtgggttctcacatcagtgaagctaggaaatccaagctacaagagttaatctctgtttcaaggcgggtaaacaccttaatgttttctgagactcctggtgctaattttcatgtttaaaatgcccacagaaatatatattaccctgtggaaaagtaagttaccaaaag

SEQ ID NO: 125424 - DNA, 120 bp, Homo sapiens
atgcgaagcaaaaaaagacatgagtcaaaaggctacacactgtatgcctgcatttatatgacattgaaaaaggccaaactataggaaaggaaaacagattagtttttgccagtagttagg

SEQ ID NO: 125425 - DNA, 273 bp, Homo sapiens
gtgtctcgggatgggtgtgcagtgatgtcacgggatgggtgtgagtggtgtctcgggatgggtgtgagtggtgtcacgggatgggtgtgcagtggtgtctcgggatgggtgtgagtggtgtctcgggatgggtgtgcagtggtgtcacgggatcggtgtgagtggtgtcacgggatgggtgtgcagtgatggtaccggatgggtgtgcagtggtgttatggtggtttttgcttctctaatgacaggcatttctcctgagcttatctgtcatct

SEQ ID NO: 125426 - DNA, 710 bp, Homo sapiens
ggctcggctcgtgggccgggcggcctctggcctcccacgtgcttgagagcggcctggtgcggtcggccgcgcgccttgcgggctgtaggggcctgagggcggccctcttgcggcgcggctgcgtgggcgtgggtccgacctgtgggaattgccccattcgtctcccgggtttagcgcggctgcccgccgtcgcgagccccccccccgccgcggaccggcgcgggccagttagcgccgcggccgggtgccccagcgggccagtggctttcccgcggagggcggccccgcggggcctcccgacccgctctgggctaagcgagcggccaggtttcgtgccctcaggtggctgtggttaacaagtcgcgaacttgtgggaattcgtcgaccagggtttacctggtgtgctcgacattttaaatccttgctctctagtctttgaggtcaccactaacgcggggcgggccgggctccaccgcacggcgctgtccttcccggagggcccgcgagggtgggccgctccgggggttgcgagatggagggtcgcgggcgtgcgttcttccgaccttccgtcagacattttgtgcccgccacgtgctagcctatcgcccagctcgcgcctcaaaacttgagagcaaggatttaaaatgtcgagcacaccaggtaaacctggtcgacgaattcccacaagttcgcgacttgtaaccacagcc

SEQ ID NO: 125427 - DNA, 119 bp, Homo sapiens
ggctaatgggataacagcagggtggccatacaatttattgtccaaacagggacgctctctgagtgaagagggcatcattaatagtgaagcctggacaacaaacataaatgtggaccatg

SEQ ID NO: 125428 - DNA, 266 bp, Homo sapiens
tagagaatgcaaattcattctggctgtctgagaaagactccgtttttgtctttgattcaatttgatgacacagattatctgtcttgatctgattattctcttttccctttgccccaacaattgctatttgacatctcatgcacaggaaagacccagtgggccacaaatagagaaatacagttacaggtgctctgtgtttatggaaactaggtgtcgacctacacatttatgggagttgtctatcactgagttagaactttctgagc

SEQ ID NO: 125429 - DNA, 439 bp, Homo sapiens
cctgaggcgaggaggcggatatgaggtcaggagaatcccagagaatgcagagtgccacaactgtcaggcctcggaacccatgatgtaatgcctctctgggggccaaggaaaacaagcccactgttgtcactgccctcccagcaaccaggcgctgccctccccatggcacggctgttctgcgtaattatgatcccactttctctccttgggaggaggaaatatgaaaaacctttgttgtcacataaaaaccaacccaagatatgagaactgtcttttaaaatacatcttgctgtagagagatttccatagcaacttcagaagtgtgtgtatacaactagagataagtccaggctgatgaaagctacctggaatgtgaacaggctctgggcatcagcagctgtggatttttctagaacctgtcatgctgctgtgtgaccct

SEQ ID NO: 125430 - DNA, 270 bp, Homo sapiens
agtgaagatggaaaaaatatttctatttttacaagagggctgggcaaaggctgggagaagaggggccgtgaaaatcactaagggagaggctccagggagtgaagtgagccaagatgtacgtaaggtggcctggggtccagctctgccttctgagctgtgtgacccttagggagtcacttcagatccccagatctgtttcctctcatgtaaaagggtgaggggatgggggtcagggctgggtggtggtgccagttcctttcagcctgtcta

SEQ ID NO: 125431 - DNA, 821 bp, Homo sapiens
gaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagtggggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagcatatctttatgaccttggagtagtcaaagtttcttaaataggacacaaacagcctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggac

SEQ ID NO: 125432 - DNA, 592 bp, Homo sapiens
tagaggatcccgagctctctctgtggggcgatgagtgtgccaaccgagactctccctcgagacaatcgtgccaagcaaaggaaccaagtgcctaggcaggctgggacagtcctcttccttccaagatcttttaggagtgggacaaagtcaagtgctgggttagtgccccacagagagagcgtgacgctctctctgtgggggacgctgtggggtgcaggcagaaagtagtagcagtcccttggttacagccgtggcacacctctcagtgaagtctgatgttacttgatatcctcaaatgagtccaatcagtatcagttgggatacttcatagagatcaagaccacccccaaattaggatagatgtgctttccaggtcatggtttctgacactctgaaggttcttcaatgtatgtcacttcaaagtgcacagatgttaaattatacaaaaccaatgtagggttgggtcaccagctttacaaaaataacacataagtaatcagacatttgagccaattacactttcttatgttacataaatcctatttcatccacttttccagtctcatcccctgccacttgccctgcgctccat

SEQ ID NO: 125433 - DNA, 457 bp, Homo sapiens
gtgatctagaggatccctcacgcccatctccactaaaaatacaaaaatcagctgggcatggtggcacatgcctttagtcccagctacttgggaggctgagacaggagaatcgcttgagcccaggaggaggtggaggctgcagtgagccgagatcgtgccactgcactccagcctgggcaacagagcaagatgctgtctcaaaaataaatgaataaaaatagaatgatcaatgatccagcaatcccacttctgggtctacacccagaactgaaggcagggtctccagaggtcactgtgcacccgtgctcacagcagcatcattcacgacagctaaactgtggaagtcacccgtgtgtccactgacagaaatgggtaaacaaaatacatccatacagcagcctgcggttcagtcttgagaaggaaggagactgtgacacaggctacgcatggctgcgcc

SEQ ID NO: 125434 - DNA, 835 bp, Homo sapiens
cagaatgggatttggtgtttttcgacgccaaagaacctccacccccccacccccaccccgagcttttggaatccatttcgcttttgtaaaacgtgtgcttcgtctgtaaaaactgagcaaggaatagaaacattcgtagctctacagtgagtgcctgtcacacttcacatccatagagccttttgtgaacttttataagattcagaattcagcttgagcaccagtgacagcaattgttacatttattctagaatgctaaattaattcgattttaaactgattattagcctcggtgtgccgttcctaaaggcttgtgactttaggtatttccaagatgcccttaagtctctgcttaccactttcctccctccccgagcatcctggatgttgggactgtgaatccaggtctccgttatctaaatggttgatgttagtgtttcctgtcatcacgtttagtatgcttgttgcctttactatcattatagctaaaataatactgctttcagagatgtgttgtataatcgcataataatttcagaacgccttcatattgaaccagatatgaagtgatacagtatcatttattcaaactgcctaaaaagtaaaaagtataaaccatatactatttttaaaacaggtaggttagatttaaatcacgtagtttagaactgttggaatggtactttgagtgataggatttatgttaggccttctttagtaatagttaatatcatgtaattagcactcgtttacacacaattttaatgtgttcgaatccctagagtcatcgaattcagaatttatagtattttattttacttagttaatattaacc

SEQ ID NO: 125435 - DNA, 538 bp, Homo sapiens
agtctctataggatcccctgctcacttacactgttagtctcttctgttcttaacgctgtatcatactatatctattttcagtactactcaaagactataatatgactatatcgctttaaattagtccaggtgactcctcattaaactacacgtaagatgttcgggttggttagtgtgtttctggttacaccgtctcgtcactaagacccctcttgcgttcttcatgattttttacatgatgaaaacaatattgccgttttcttttcttttttaagagatagggtcttgactgcactccagcctggatgacagaacaagaccctgtctcaaaaaaatgaatgaatgaatgaataaatgaattcatgcatgcatgctactcaggaggctgtgtcttgctatgttgcccaggctgggattacaggcatgagccactaaaactaaacttaaggggataagaaggggagctcatagagattgtggtggaccccttttgctagaaactgctacttcctcccaagtagagcacagacagatcagg

SEQ ID NO: 125436 - DNA, 232 bp, Homo sapiens
aaaagaaagaaagaaagggagaaaaagaaagaaagaattgcctctaagaagcaggactggcaaatggataggagtgaggcatgcattataaacaatattattttcagtattattaatcaatgtaatcacttgacttttaaactacatatatagttttatatacatgtatagtttatacacacatatatacatatacacacacttttaatcaagataaagttaatttaagaaa

SEQ ID NO: 125437 - DNA, 655 bp, Homo sapiens
tgcacctgcctcagcctcccaaagtgctgggattacaggcctgagccaccgcacccggcctatcgtctcctttttataggtaattatactgaggcaggcagtagttgtaaaatggagtctcacatcatagttatatgaagcagggaatctggtttcctgtcttggcagtctgacttcaagatcccctcttagaaaccattatactataaaaactgaaaagaaataaaatccaagattggagactgattttaacatctattttaaaccatttcataatcaaaaataaattaaatagggaaaaataaacctgaatattcatacacagagaagtgtagactcttcaatggaacacgttttttaagtgtccgaggaatagttataaaattgctgaatattttcattaaataactaagatttaagtattagactcaagagaaaaacttagtcaaaggcctaagcatgagacattaagcttgataaacattgaaaatgcgctgaaaagcccaagtaagaaaattaatttttcattttagaaattataggacaataatttactcaaccatgaggggtgtgtgtgtgggggggggaatgtgtttatgttaatgagcttgttaacaataagttatacaaaactattagttaacagcaaccagat

SEQ ID NO: 125438 - DNA, 246 bp, Homo sapiens
tttccttcctccatacctgctagggctgagcctcagttgaatgtgagaaaaacgctatgggtgtgatatttgccactctctctgccttgggaccttgagtcatagtctcattcttcatctcaaacagtcttctgtctcattctgtccagctactgtttgtcctttacagtctggctcacatttcctctcccacagaagccccgtccagagctgctctgtcccctccaccactccattgtcctgtct

SEQ ID NO: 125439 - DNA, 269 bp, Homo sapiens
caagagtaagctcgagtgctccttgctattgtgatgggacgtgcaagagtaagctcaagtgagtgctccttgctattgtgatgggacgtgcaagagcaagctcaagtgagtgctccttgctattgtgatgggacgtgcaagagtaagctcaagtgagtgctccttgctactgggatgggacgggcaagagcaagctcaagtgagtgctccttgctattgggatgggacgggcaagagcaagctcaagattgagtactccttgctattgt

SEQ ID NO: 125440 - DNA, 362 bp, Homo sapiens
gatgactttcccactggaagctcaaacccgaccagtgcaaaaccaagctcgtacactcccttgccatgaaacaaataaacccaacaaaaacctagcatagtcagtagtaccacaatcgagccaggccagaaatctgggagttatccttctttttctcctagccgcctaatcaccaagccctatttagaaacagaggaataacattcaagtcactcttcttcccaccacattggctgccactgtcctggtccaggccgccatcatctctccaggcatggtagccacttcctggcagtcctgccatgtctatccctgctctctaacagcctgttctccacccagctagcttttaagaaatatgc

SEQ ID NO: 125441 - DNA, 201 bp, Homo sapiens
ccagacttaaccactatgcaatatatgcatgtaggaaacctgcacatgtaccccctaaataaatacaaataaaccaaacaaaataattatatattatgaccaagtggagtttatcccaagaatatgaaaaaaaccaaaccacaaaagtgaatggcccaagaaacaggaaggagagacggctaatttcttaagggctggcat

SEQ ID NO: 125442 - DNA, 552 bp, Homo sapiens
atttacttttcacaggggtggaatcatatatttatctgtattgaatgtcatcctgttaggtttggtctctttgcaaactgttaggctctttttgtcactcagttctgcgtttaaattagtacccacctcagtcagtagtcatagtaacttggtaagtatcatagctccttagctgtattagtcagtagggctgccataacaaaataccacagactgggtgacttaaaggacatttattttttcatagttgtggaggttgagaagtccaagatcagggtgctggccagtgcagttcctattgaggagtctcttcctggtttgtagataactgccttcctgctgtgtcctcacatggcagagagagctctggtgtctcttcctcttgtaaaaacactagccctattggatgagaaccttacacgaaccctattggataaaagccttacactagccctgttggataagagccctacactagccctgttggataagagccctacactagccctgttggataagagccctacactaaccctgtcctgtggaaaagag

SEQ ID NO: 125443 - DNA, 293 bp, Homo sapiens
agtagagacgaaatttcgccgcgttgcccaggctggtctcctgaccgcaagtgatcctcccgcctcagcctcccaaaatgctgggattacaggcgtgagccaacatctcccaaattctaacagccacgattcctaccttcacactcttgtccctgcctacaccatgtcactctggccttctaccccatcactgaaattcagcagaatggccatgtgtcagacaagggtgtgggacctgacggtacagggcagttggggagggagcatggagtctgggatttattttgtaggct

SEQ ID NO: 125444 - DNA, 380 bp, Homo sapiens
attaaaacccaggccatgtgactctagagccccagccatggacttctgccccaattctggctcccactgagtctgactctctagcctcattgacaggatttgtgctcttctggtcaggatggggagatgatgaaacattcatcctcaaagggtcatatacaagttctccagggatgtccagatgacccctattggtccaggtgagatcctgacaggcactatcatccaaatgtcccaacaagcaccctggagttcatttatattttcattctatgttgtggtgggtgggaatgtactagatccaatccacaggataaagatggctttctttcatttactaacacaaatttctttatttagtagcacaaaggaatacttat

SEQ ID NO: 125445 - DNA, 255 bp, Homo sapiens
gaaagtcagaacttttttatttaaaaattttaaaaaaattttttgagggtaagaaagatcttgcagtcttttaggaccactgccctaacaacttcagataggctagctgtaagtagaaagaagctaggactgtggaattgaatttcctggatcagctgcaattacaaggaggataagagaatggttgagctgattcttttctattttcttttcctagaaatagtatgtatttttagtcattaactagtattttgg

SEQ ID NO: 125446 - DNA, 153 bp, Homo sapiens
gttagttggcaatgcagggatttgagctcaggtctccagagacagagtctagtaccttttctaggtcttaaaagtggactgggtttcagaggtttttacctagtgttggggaggattgagagtttggatcctaacttgtaagtgtagctgtat

SEQ ID NO: 125447 - DNA, 200 bp, Homo sapiens
acatagaggcgtctgcccaggctggaacatatgagggaaatggtcaaactttcagaaccccaaaagattgggcatggttaccttcatactagtagttttggaaacagcagagtgatgtgtgactttttaaaacacagattttcggtattttcaatgtagatcagtgtcctcatttaccattctgtgattcataaatctgt

SEQ ID NO: 125448 - DNA, 535 bp, Homo sapiens
caagggaagggggagaatggaacgatctgagcaggttgacctggaggaactggtggcccttgagtccacgaagcccaccctgccaggtgcccctgccccacatgacccaagggggttgcagagcagcaagcaggactctggttagacaggaggaaggacctgccaccacgtggccttgtgaggagacacagagcaagcctgtgacctcggcgtccacccagcacagggtgctgctgaagcccctcctgtcatctcagcaggggtcccagggcaaggcccgaggcaggctgaagagaggggcagagtgaggatgctggggaggcaggggtgaggggagtgagagcccaggtttcagctgagcccctgcacagggaaggaacctagctgaacacccatctccccacacgctcccaaccctgcctctgcccaaccacctcccagagggcacctcgaaccctctgacacccacactcagcaaggggtatggtgtccccaccgaatccagccagtgaggcccggcacagccacgcctgtg

SEQ ID NO: 125449 - DNA, 325 bp, Homo sapiens
tggagactgacgagaagggatgggatggttgaaagaaacattaacaagtagtaaaaaaagaaaaataggaagtcctttgacagtagtgtcttagcttatgataataaagtgatacttttcttacaatgaacattatacagaatgcttgcatttgtaggtatataaaaatgctacttatccttctgccctgagtttctgctactactaaactttgaacctcttttggcaataagacaggtttcattttacttctgcaagtattcagataccatatgttaatgttttactctgggtacaataaagtttagaattattactggtcaca

SEQ ID NO: 125450 - DNA, 235 bp, Homo sapiens
ttccctggccagaagggcactaggactctctaacccgagaagctttcagagcctcaaacatccccttgtctcctaacaagagctgatctgagtttatttaagaaaattataaagaaaacagctgattatattcttcaaaactgctacaagagacactctgcattatagagcactgcttcattactcttaaatagggccgtgttgcccaggcacagtggctcacgcctgtaatctc

SEQ ID NO: 125451 - DNA, 465 bp, Homo sapiens
taaccctacttctcctagtgatacacccatctccacgtgcccaaacgggaaggctcagcatgattccagccctctccttccaacatctgcactcactaagtctgtggtcacgtctgtcctttctccttttctcgtcactcccatgagtgcatgagagagaaaccaagagcaagacatagcctccctgggtgataggaaatgtactcctaggctgccagatgctagatgcaaactccttcttctagacttccccttcagcctcatgggtcagtgccccccagcacgaagcatcccccagaggcagcattaggaagtggttatgagcacattggaataaaggatctgggtccaggttctggctgtgccacctgcgagcttagattggacacttgatatccctaaacttcagctccatcctctgcagagccgggccacgatggtgtgcatcccgtgagttagtggggt

SEQ ID NO: 125452 - DNA, 235 bp, Homo sapiens
caagcaatagaagaagagcaacatttaatattaattttccaagtgagcaagtcaatctcctatgttgaccccaagcaaaaatgtccagggtgtcagcagcctgaaatgtccacactcatcctaagacctcatttaaggacatatggagggtaacaaatatataccatagttaataaatgacaagaacattggcggcacgctctctgaagagtgaattggtcttgcttgtttctta

SEQ ID NO: 125453 - DNA, 174 bp, Homo sapiens
cactgggattacagggacgaactaccgtgcctggccctataaatatttatagataaaagactttgaggaaatatgctaaattattaataatattctttatctctgagtgataggatttcacatcttttgattctttatactctgtttttctaaagttttcttttatgcttacct

SEQ ID NO: 125454 - DNA, 828 bp, Homo sapiens
agcggtctcctttttttttcatttctcaaagtctgtatggaattcaagcattaaatctctctgcctctacccaatccagtccacacatagtcctccttattttaatctcttcctctttctccctgccatttcattctattcttgtatgtattctttccattatattacctaatccttacatgggaagcatttctatactgtctgctttacttcacagaatctcctcaatatgtttctatagccttagaagtaggaagatttttgtccttatatgtgagtacagactttttttcctccccagaaaaatcttaaaagctaaaatttatcaagtgaaaaagaaatagtaattttgaaactggaaaatgtttactacctaatgccatttaacttaagcctattcagtgatttcgtgtatgtgacttccataattattatttgaaaaaaaaaaggcagaagaagaaaaggacaaaaagagagagtggggtaaagcagtgtgggataggaagaagagaaaaatatgtgcatttgcatttggttgttcaagactcaaagcaactaggcattcacaaggagctatccaaatgtttatagtaggttctactatttaatgaaagtaaaacaaactaaaaccaaagactgtaattatgtttaacatttccaattttttaaggaatataagccaaaatgtatccatgtgtatccatgattctagcttacttagctcctgtttatgaaaatgtatatccagagaaaaagtagttattttatgttacatttactaacatttaagttctgtcatccctgttaaggaaattgggaatggagaca

SEQ ID NO: 125455 - DNA, 370 bp, Homo sapiens
ctacaatcgcctcttccctctctggccccatgccctacttgatgtttttgagcccttctctttacaatcctatcatgtatttagtcatttatttgtttactgtctgtcttccctgctggaatgtaacttccacaagaaaagactgtcttattcctacataatccccagccccaagcaatgcctggcacacagaaagtgtctgatgcataattggtgagtgaataaaggaatgaatgacagagaaacgtagcactctagcctgcgggaggtgactgggcttcaaagtgaaatgagtggctcatgtctgtaatcccagcactttgggaggccaaggtgggtggatcacttgaggtcaggagtttgagaccag

SEQ ID NO: 125456 - DNA, 569 bp, Homo sapiens
aattataatactactactcagcattttacagccctttggctttttaataaaaagttttatttcctgacttatgagtaacatttgcccattataggtaatttgtaaaaattttaagggataaggcagaaaattaaacactctcataactctaccaaatagaactagttggctctatttcctgcttggatttgattccccctgccctttgatttctcaatacttggtccatttttgcattcacagcctagaggtaatgggggaattcttttaccctgatggagaaaaagatttctgtgcaaaaaattaaaagtgcacctcaagctttgctaacatgtcattatgagagaactctcactctggccacaaaaaaggacaaagaggtagctgtgcaaatgcgcagaagtgtatgcaaaacaagaagtacaggcaaggccacaaggggacgacctgtttatctgcccatctgctttcatgacagaactgcctgccactgagagacattgatacacatccactccagctcattagcatttttcatccaaccttcctcctctagcagtgatcacagg

SEQ ID NO: 125457 - DNA, 449 bp, Homo sapiens
tgaaatagccaaaggaaatcatcatatctgaagcagaatttgctttctatttctgtgactttttagatactttttgcatcttataattttacttgccaaatgcatatgaaaatatgagattttactccaagaagagaaattaaaattcagttttatttttaaatggcacttgtcatcttttattaagatgtcaaattcatttttttttcattttacagatattgaacatctactatgtgctagacactgttctagacaccctgggtacagcagtgaaccaaacattaaaagctccaaggaacttctattctagtggaaggaggcataatattgtatagtatttgatccagggggtggaggaaaaataagtgaatatctatgtgaaatgatggtacatgctgagggaagagaaaacaagataggagaaatagaaaatgacaaggaatact

SEQ ID NO: 125458 - DNA, 397 bp, Homo sapiens
agctcttcctgccatgatgcagtgggtccgcacgcagaagcccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaa

SEQ ID NO: 125459 - DNA, 451 bp, Homo sapiens
gctgcagtcgtcgggagccatgaactggggctgtcccaggatataagggaaatattggctgtgccttccaagttattatagagtaagggataaataagacaaacccatgaacgtggccacgtatttatgagactcataatgagaattttcagcctccttgcagaggtgagctactattgtgctcgggaagattaaggcacttctaaacggctgttcccgtgcactcacggacacttggtgtgcacacgtgcacacggcaacatccacatgtgcacacaggtgcgtgtgcatgcacccctcacacgtgcacccctcacacacatgcttacaggtgtgtgtgcatgcacccctcacacacgtgcacccctcacacacgtgctcacccacagatgtgcatacaggagcattgcatgcacccctcacacacgtgcacccctcacacacatgcacc

SEQ ID NO: 125460 - DNA, 449 bp, Homo sapiens
tatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattgtgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatg

SEQ ID NO: 125461 - DNA, 323 bp, Homo sapiens
gcgaccaaagtctaccaatgacatttccttttccatagtttgttctactatgctttacccaatgaattataactgtgtgtgaaaactatgatctaaagtgaagcttttcaagacaattatttctgaccataagggaaataaaaatctatcattaatcagtgtcaaaaatcaaatgacaaaatccaatcagacatctccacgtccatcaggaataggaacctgctcggtgagcctggatctgcagtgagaagggcatcagtcaaaactgcacacgtctgcttccttctgaattacgtaaaccttccccggctccggagctgcgg

SEQ ID NO: 125462 - DNA, 835 bp, Homo sapiens
taatgccgtatgacttttatccattttactgttgatggatatttgggttacatctaagttttatctagtatgaatgatacttttgtgtcatatttgactatatctcttggtgtacacatctacctgttgcaggagctgctgtgttttgggtcatgcagttccgctctagtaaacccttcacatgattttgccaaatgatatattaagttatactccagtcaggcagtgccttcacttgcattttcagccttttttgccaacatttgcattttcagccttttaaacttagcatttatgataaatatgtagaagtggttttaatgcatctttctacagagtctaataacattgtgtactttttcatatgctttcatatatgcctttattttttgtgacaagcctgtcaaaatttcttggcatttttcttctaagatatcccttcttctcatcagtttttggcctttatgcattctggattggagttctttgttaagttatatatgcgttgcagatatcttcctcttctttcctgcaggctgtgttaaacagaaattcttaaatttagtaaagtctgctttattaatcttttcgttcaagattagttttttaggaaaatttttgttgatgatagtggtgttgattaagcaatccttcactaccaaaaagttatgaaactattcttgtaatgtttgatgagcgatgacaattcaatgaggaaagatgatttttttcttttaggcattttagtgttctttcacatttagaactgtaattctaaataggttttgtgttcatattgaagtcaagatcaggtatcatctcccctcattccctg

SEQ ID NO: 125463 - DNA, 449 bp, Homo sapiens
  misc_feature (35)..(35): n is a, c, g, or t
tgttcatagctgactctagaggataaacgccaacncaccgtggatggaagagtgctcggccactgtgaagctctgtgtaaatgttatatacacagtactcccaatgccgtcctcagagcgtgcacgagggcgtctgatgaataccagctctcagaagatgttaaagaggatgctggtctggacgtagtggctcgcgcctgtaatcccagcactttgggaggccaaggtgtgtggatcacctgaggtctggagttctgagaccagactggccaatgtggtgaaactccatctctactaaaaatacaaaaattagctggacatgatggcgggtgcctatagtcccggctacgtgggaggctgaggcaggagaatcacttggacccgggaggcggagattgcagtgagccgagatcacgctactgcactccagcctgggcaacggtgcaaga

SEQ ID NO: 125464 - DNA, 359 bp, Homo sapiens
ccattgaccgtgaagtgtctgctttgaactctgaggtgcttacatgcagcccaagacacattcatttctagtagagtgtagtcccctctcagtctcttattctgcatgatcaaggggtagacttcctcatttcttgaatcatattaacctctttagaaactaaccaccactgggctgcagcttttttattcacaaacttaaaatacagtttccagtcagcatgtgagccagtcagtttccagggatgatttggttgagcctaacgttgatgatgactcagatcaatgagtaatttaacatttttgtccaggagtggtggctcacacctgtaatcccagcactctgggaggccgaggtgg

SEQ ID NO: 125465 - DNA, 510 bp, Homo sapiens
ggcctcccaaagtgctgggattacaggtgtgagccaccgcacccagcttaaatgttttttttactgatggattacatgattaaaaacatttggaaaccactgcttccgtgaaaacaacagttataaagtcaccttttgtgtcacatggaataatgtgcaggttaaagggcatttctcctggggttggattctggtgtctggaatgatgagaaaggtttttagatccagtgagagccccatggaatactggacatagatgctgtttgagaacatccttccccagattcctgacccctacatcctgctccagtgggaaccgtggaagagcaataactcagtgctgacgtgaccccgaagggttctaagagagcagcagtgagtgaggggagaagtgaggagacaggtgggaccctggagggggacctgtggaggtcatgactgtccagagactcggttctgaggggagccaccctttgagcactggcctgtgtctcctcccagtttaaactc

SEQ ID NO: 125466 - DNA, 680 bp, Homo sapiens
ggcttaaagaagaatactaataataactaagctttgcattaaaaatcttaaggaacagactaaactgaaagaagacagggagaaatagagataaagacaataattaatgaaaattttaaaatggttacaatagaatagctctgcaatatttaaaagctagaaaacaaacaaacaaaaaacaccaaatcaggctttgtcaggatttcacaagaagagaagagagaaagcaccaaaaagccaacattaggggactttttttatccaaccattcagtggacaatatgtccacactgtatgtctccttctagtgataactaaaaattgtgaatgtaatataaatgaagataaatgcaagtctggataaggtagaaagaaagatttcatagagactgtacaccgggttcagaactcagaatagtaagcagaacactaaagctggctttgccctgaggaaatttgataagctaggtgcatattcccttctattgtgtccctttcttggtctcatggtgacagaccccagctgcatcaagtggggactcagacagtcactaaaccttcagtgtaagaatactagaattaaattcagccagcccaaccaccctagcatacctcccaccaccaccaccactacttgttgaagacagcaagaaaggttgcctatctagagcaacaatgct

SEQ ID NO: 125467 - DNA, 477 bp, Homo sapiens
ccgccctcggcctcccaaactgctgggattacaggtgtgagccactgtgctggacgaatttttttaaagaaggaaaaataaaattaattcggcccttcattaaaaaaattaaaaactctttaaaggaaacgtgggctaagttatttttctgagagactataagatttgggaagaaaaataatcatgatgaaacgttttgggaatatttttggtatttaaaattattgtagaaatttataaatgtgcactccacaatcacacacttacacagctccgccttgccaggcagtgtagaccctgccaagcagtgtagacagattctggataactatctttgcatccttccccataccatgtcccagatgttgaactgaagcagctccttccatgttccctacccgttaattagccaggccgctgcccacattgtcacaaacattatattaactgaaaaactggcccatgccatattccatt

SEQ ID NO: 125468 - DNA, 589 bp, Homo sapiens
cctgcagcctgggttatacagcgagacaaaagaaaaaataaaaaagttagtggtaacaggataaactacataaccgtatattattccttcacattcatgaagcaggtcaatttgaagcttgaggacgacttccattcctctaggtgaatctaccaagaaatgccttggtagagctaggagtgccaatggtatcagcaaggccagcctggttccctgtgattcatggtaattctcactatgactttgacatgatgttcctacactgtgcctatcaacacttgtagacacactgtataagcgtttgttacatttactttttcttttgtcattaggtcttttattacagaggccactgtgcactccacaatcacacacttacacagctccgccttgccaggcagtgtagaccctgccaagcagtgtagacagattctggataactatctttgcatccttccccataccatgtcccagatgttgaactgaagcagctccttccatgttccctacccgttaattagccaggccgctgcccacattgtcacaaacattatattaactgaaaaactggcccatgccatattccatt

SEQ ID NO: 125469 - DNA, 277 bp, Homo sapiens
agacttggccaggagatgtggagaggagatcccgcacagggaggggcggaggaaactgagatgggatttcgacagggtgcacacagtggcccatagaggggggtcacagaacacagctgctagcattttgtatgaccatgcattgttaacgtttgattcacacagcatgatgttcaggccctgtacttgaccacaaaaaagatttaagatttccatccccaaggacagagatttatctcatttattttccacttaatacctcagcaaaatgcttgtc

SEQ ID NO: 125470 - DNA, 1160 bp, Homo sapiens
ctcttcctcagtttctacagatgacttcattcccctatttcacagagaagataaagccaagggatgcaggaactgggtaacttcctgttacacccacagacgaagttatgtcaacgtagctttcctttacttttcagtctccagatcctgttctcttccagtttttccagaggctttactccactattatcttctttcaggtgttcaacctctgcccctctccctttcctcttaccctgtaaacttactgaaacctcatccctaaattcaaccctcatcctctagattaccagtctaacctctttctttcccttcgcagccaaggtccttgaaaatgtagttgtccatcactgtctctgcctcttcatctttcatttattcacagtccactgtgcagtcatttctacatataccatataccatacagcccaaactgctctgacaaatacatgacctgttattaactagcagttaagtaccaaatccagtgggcacatttcagtccttacgatttatgttgcatgtactaatagtttgttcttgttcattgtattaatatatcacaactttaaaaccctcttcacctgttgatggacatttaggttgtttgcagtttttggttattacaaatctcttgggtaaatacctaggagtggaatgactggttcaaattatatgttcaagcttaaaagaaactaccaaactgttttccaaagcaatcgcaatttgcattcccaccaacaaggtataaaagttccagttgcttgtgagcatttggtgatatccaatttttttcttcctaattttagccattttaataggtatgtaatactgtttatagtggttttgcatttccctaataactcaagatgttgagcatcttttcaagtgcttattagctgtctctgtatccttttttgtaaagtatctattcaagcctttgcccatattttaattgggtggctttcttaatagtaggttttgaatgatctttacatattccggatataaatcctctttcagatacgtgatttgcaaatattttctcccagtctgtagttcctttttaaaaaaattctcctgagtgtcttttgcaatacaaacattttaattttggtgaagtccagttgatccactttttcttttcagatcataacttt

SEQ ID NO: 125471 - DNA, 1160 bp, Homo sapiens
ctcttcctcagtttctacagatgacttcattcccctatttcacagagaagataaagccaagggatgcaggaactgggtaacttcctgttacacccacagacgaagttatgtcaacgtagctttcctttacttttcagtctccagatcctgttctcttccagtttttccagaggctttactccactattatcttctttcaggtgttcaacctctgcccctctccctttcctcttaccctgtaaacttactgaaacctcatccctaaattcaaccctcatcctctagattaccagtctaacctctttctttcccttcgcagccaaggtccttgtccactgtgcagtcatttctacatataccatataccatacagcccaaactgctctgacaaatacatgacctgttattaactagcagttaagtaccaaatccagtgggcacatttcagtccttacgatttatgttgcatgtactaatagtttgttcttgttcattgtattaatatatcacaactttaaaaccctcttcacctgttgatggacatttaggttgtttgcagtttttggttattacaaataaaattggaatgaatattcatttacaatatttctgtggacataggctttcatttctcttgggtaaatacctaggagtggaatgactggttcaaattatatgttcaagcttaaaagaaactaccaaactgttttccaaagcaatcgcaatttgcattcccaccaacaaggtataaaagttccagttgcttgtgagcatttggtgatatccaatttttttcttcctaattttagccattttaataggtatgtaatactgtttatagtggttttgcatttccctaataactcaagatgttgagcatcttttcaagtgcttattagctgtctctgtatccttttttgtaaagtatctattcaagcctttgcccatattttaattgggtggctttcttaatagtaggttttgaatgatctttacatattccggatataaatcctctttcagatacgtgatttgcaaatattttctcccagtctgtagttcctttttaaaaaaattctcctgagtgtcttttgcaatacaaacattttaattttggtgaagtccagttgatccactttttcttttcagatcataacttt

SEQ ID NO: 125472 - DNA, 119 bp, Homo sapiens
cctcggaggcctgggtatgagccccacctctcctgttccattggagggtgctcctaggaaacccacagcagaattgcagaagtatgctgtgtttattttccaaagtctcattttgtgct

SEQ ID NO: 125473 - DNA, 276 bp, Homo sapiens
tccacctcagcctcccataatgctggagttacaggtatgagccatcatgcctgacccctgcttttctttccttcttagacttaagagtttcttcgtgttgggtcagggttttgtgtgagagtttctttcttctctgtagggcattttcttaggatcatgagccttgcttgtagcaggggcagggcctgacgctgatttatcagctttcgtgcagtaagcacctttgaattccgagctagaggctggcgctgaagtggtgaacagcagacagcatcc

SEQ ID NO: 125474 - DNA, 285 bp, Homo sapiens
cagcctctgtaggccacagagttcttaaagtaaagctttccaggcccaccttcggcctcccagcagcctcagcaatcaaactattcccttactgcggccaccgaaagccaagtttctccctgcctcacggcatcctccgaaaactgagcatttgcctcacggtggcctccccaggccacgaatctgcctgcctcccaggcagctgctgtctcacaatggtctctttaggcccagctcatgctaaaagacagactctccaggcacagctcttgcctcctggcagcc

SEQ ID NO: 125475 - DNA, 457 bp, Homo sapiens
ttaacatggtatatgtattgttattaaagtaagtgacccatgtcaaatgtcttttatttatttcatgaggaaaagctttctgtagaggaacaaatttgagaacaagtttcaggaaattgtcttttttgttgttgttctctaatcatgttctcctttctgtttcaacgattttaaaaatattttactttatggtatgttttattttttttccttttgtgggtaatttttgttctattgattatccatataaattttttttttttttttgagacggagttattctctgtcatcttgggctggagtgcaatgacctgatctcggctcactgcaacctccgcctcccaggttcaagtgattctcttgcctcagcctcctgagtagctgtgattacaggtgcccgccaccaagcccagctaatttttgtatttttagtagaggcggggtttcaccaggttgg

SEQ ID NO: 125476 - DNA, 1924 bp, Homo sapiens
ggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggaggctactgggaaagagaaaaagaagagagcttaatatgaaggcccaggccttgaagttggcagcaaagcggtttatttttgaatactcctgtggcatcaacagagagaaccagcagttcaagaaggaattactgcagctaattgagcaagcccagaaactaacggctactcaaagccacttagaaaacaggaagcagcagctgcagcaggaacagtggtatctggagtccttaatccaggcgaggcagagactgcaaggaagtcataatcagtgcctaaatagacaggatgttccaaagaccacacccagtcttccccaaggcaccaaatcaaggattaatccaaagtaacttctaaaataacactgattaaataagaactggagcaagtactcttaagtgctacattaacctggttagaaaggctgttggattccagattgctattgtaaaatctccatcatgatgtgttggagtgaaggattagatggttttatccaacagtcctactagatatttggtaaccagcttcccttaactagctttttctttaaatactcgttaataagctattccacaaacctccagttaacctaacacatgaccctaacctagccatttaccatacatcaaactagctaaaggaaaccaacctaaggaagtgaaaacagttgtgatttatttcatctagctaaattgtatttctttatagagaaagtacctttaaggatagcattccaaatagactttgaatagcgttctgccagtttatcctcattccttttgaccaacttagcagacaaaagcagtttttacaagctctttgtgagtttgtgccagtgaccaggtagctccttctagttttctcatgagtgaaaaagcattctgataacagcaagtccagtaagtgctaggcagagtgacctttcatctgatgctaagcccctacaagtttgagaaggtaagaaaagatgaaggagacatatattaggtcagctcttacttttgaaaatgttttatttgaagaaacacctgtagcattgaggtgactgaatgcctccacttatttcaggaaaacgtatccaaaaaaagttgaaatatttggacaactttttttttaagtgccatcgatttccctagcagcattctaaaagatagcaagtaaaatgatgtttgttatcctaaatgctttagttttaggtcatttattaattttcttacaggtgcactttctagtacatgaagtatcctttgtaattaatgtgtgccatatgtttattcccatttagtataactataaattatattttaaattatatatttttaggatagttatattttttttgggttctacgacattgaagttggactagtgatttatttgaatgctgaatcctagtataggggaatataatcttatattttaacaggggtcctctatgggaaaataggatgaactttgtttcccagaaattgttaagtgatgaaaaacttcaaaataattttcctgcattttctgctttatttacatgtaaagtgaattccctgaaaattggatttaaaaagcattctccttcaatgtgcctttaccttggagctttaacaacttttctgttaaatatgtagttttttattaaacaatgttattaaataaaaacatttatccactgattttattactgttccaatgtaacacattttctacttcatcactcttctgttaccactcttaaatgtcttat

SEQ ID NO: 125477 - DNA, 896 bp, Homo sapiens
cgtcctgagttaaggcgagcgccgtaggcgcgtactacagatatccctctacgtcggcctctattgcgcctacccagtctgacatgtttcagagtggattccatagtagatgatatgttatgatcagctctgctctggacgactgtttacaagatcgaagacctggtgaaaacctggaggctatcgtgatctgccgtccagtgaatcctaagatctgcttgtgtgacataattggacatattagcctacactatatttaaaaggctcctcagtggtaaatatctaatacaactgtataatgtgtgtactatgatgttagtgcttgctgcttgcatagattttgcattgtgatctgtagtatgaattatgaaacataggtgcactttctagtacatgaagtatcctttgtaattaatgtgtgccatatgtttattcccatttagtataactataaattatattttaaattatatatttttaggatagttatattttttttgggttctacgacattgaagttggactagtgatttatttgaatgctgaatcctagtataggggaatataatcttatattttaacaggggtcctctatgggaaaataggatgaactttgtttcccagaaattgttaagtgatgaaaaacttcaaaataattttcctgcattttctgctttatttacatgtaaagtgaattccctgaaaattggatttaaaaagcattctccttcaatgtgcctttaccttggagctttaacaacttttctgttaaatatgtagttttttattaaacaatgttattaaataaaaacatttatccactgattttattactgttccaatgtaacacattttctacttcatcactcttctgttaccactcttaaatgtcttat

SEQ ID NO: 125478 - DNA, 859 bp, Homo sapiens
ggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtt

SEQ ID NO: 125479 - DNA, 434 bp, Homo sapiens
aactgcccattttgaggagagaagtctgcaggtatagttagtgctgctgagacatttccactctggcattctagagttctctggcttgcccttgttgctttaaagctggttccaacttcgtgggctttatgattgagcaacactggtgattgtgatttctaataccaccctccagattcatgtcacaggtgaaagtctgcctgtggggagagctttcacattctcctggagttgaaccaaaataaggaaaacatcaacaaacacagttaccaaaagcttccaaggagggatggaggagaaattctgttcattgcagatggggagaaattaaatgacatcaagtgcataatggaactgggtaggattcaaactcaagtcccctggttcaagtccttgactccactctgggcatggctaagtctggcctgtgtctc

SEQ ID NO: 125480 - DNA, 345 bp, Homo sapiens
atctagaggatcccagctcaggggcgagctgtaactcaggtgcgagctgctaactcagtgtgcgagctgctaactcaggtgcgagctgctaactcagtgtgcgagctgcctgcctttggagagttgggttgtagggagttcctgctgggtttctggggcaaaatggtccccctctgcctccaggttctaccgaggccctgcttgggctgtgacaggtggctctgtcaaggtgggagtctgtgtgtgcacatgtgctggctccaggcgagggaccaggctggcctgtgcagcagctctggcacctgcctgcctccctggtgggtccccctcctctgtgcagctcct

SEQ ID NO: 125481 - DNA, 695 bp, Homo sapiens
tctgtacttactgttaatattacttcaagtgtaaatggattaaactccccaatcaaagggcatagagtggctcagtgaattaaaaaaagacatacccaaccatatgctgccttgaacagacttggctgaacacgaaggaatatcttattccatgtaaattgtaaccaaaagagagcagaagtggctaaacttagacaaaacagactttaggacaagaagtgtccctagagaggaagaaggccattaaataatgataaaagattcagtttaacaggaggatacaacaatttaaatatatttgcacccagcaacctaacacataaatatataaaacaaatacaaatctgaagggagaaattggcagcaatacaataacagtaggagacttcagtggtccactctcaataatggatagaatatccaggtagaaaatcagtaatgaaacagctgaattacaacagtatacactaaatgtgcctaagaaatatgtacaggattttctacccccaaatcagcagaatactcatccttctcaagtgcgcatgaaacgttcttcagaatagatcatgtgttaggtcacaacacaagtctttagaaatttaagaagatggaaatcataccaatatcttttagaccgcagtggaatgaatctagaaatcaataacagaaaataggaaaattagcaaaaatgtgaa

SEQ ID NO: 125482 - DNA, 296 bp, Homo sapiens
cactgcacctggctccagaattgcttaatctgacgttcggtaaccgagaatcctagtttttaacgatcatctatccttacttttcctttaaattagggctccattatcttccaccccccccccctttctgagacagtcttttgctgtcactaaggctggagtgcagtggtgtcatctcggctcactgccacctccatctcctgggttcaagggatcctcatgcctcagcatcctgagtagctgggattacagacgtgtgcccccacgtccagctaactttcagtagagcaggtttt

SEQ ID NO: 125483 - DNA, 306 bp, Homo sapiens
gaaattgtgagtgattagaggatcccatagtcacggttggtactagtccacggtgtatagtccacggttggtactagtctacgctggaatggaatgccagtcaggtatggtacatgttgaacagcaggcagatactgcgacaggtagtgtgacagtggatgttgccagcacttctgcaaatggaagggaagatcatatttttcagcatgatctgtgtactacacactgccaaatgttatcttaacgctcccaactcatactagggatcaaatagagttatccccatatcatcaaaaagaacaaggt

SEQ ID NO: 125484 - DNA, 378 bp, Homo sapiens
gggaggaaacacgaggagaggcgacgtgcttagataagtgagactccagggatctcggaggtactcaagtagaatcgaattttcctcactgtttctaaggagccttttaagcgaatcacggaagcggcttcacaacaggggccagatgagatccgcatggattagaatctcggtgcagccaccaacagcctcaggctggccccaaacatgcccgttgttcctctgtaaataaaacccctgcttcctctcagccctgagagcagcacgggaagccccgtggacaggccctatggacgcactctggacaggcactgtgaacactcctagacccacggcacaccgtcacatgtgtgtgtgcacacgcgtcaagcacacaca

SEQ ID NO: 125485 - DNA, 283 bp, Homo sapiens
aaagtgaattggaatggataggactattaggagatattacattccagacgaagaattgtgacggctgtgaccaagacagtgcagtgagagtggagaggaggtcatggattaatctgctgttttttgtggggggcagggggtagacaacagttggttatcaattagttgtgagtagtgaggggaaaagagaaaggttggctccaaggctcttggcctaggtaattggttgagaatatgggctattcatcaaaataggaaacacaggagggaaaagacaatgttg

SEQ ID NO: 125486 - DNA, 315 bp, Homo sapiens
accacattctggaaaccccatgctggggcaccatcctatcctatcacctcctccgcaacagtgccaaggggctgtctgtgccacagtgccttctatccccactgaaaatcttggtcccttttgggagaatagataaatctgtcagatagaattctaaataactaatgtaaatacaacccctacaggaggtacagctgaactccctcttccttaaatgacctccttccaaagactgcagcagtatggaaagaagggaaaagagtcacttgacagtggagtcacttgacagtggagtcccctgacaaacactacctg

SEQ ID NO: 125487 - DNA, 777 bp, Homo sapiens
agagtgacattggtggcaattagagaagaaacacctatctgacagtgaaaatgaaggcagtgaaaatgaacacaagcctgaagaaataacatgaagtgaattaacaggacaaggcagcttgtaaattgtagtttcgcaatagtttttagaaagaacaaacaaacaattttacctaaaatgaccattgatctttgttgattggctaaatggattccactagcaatgatagtttaaaggatgataaagcatcatattgcttcaattaaatatataaataacatggtaattcttagaatgtgatttttgatagttttatctttcaaatatatcagtagcatattcacatcccttgtgattctttgaagctgtttggaaggctgtacaggttataacccataggcagcattttgctctagtttttttcgaccacagaacattgaggcctacactgaatcttcacttgtgccattgtttttcacttgtgtcagtttaaaaatgcatttcacatcttctgtaattggtaatcccattttatatctcttttatttattttctttgcttcagtttattattacatacaatcacatgcagtcctaacagattttggtgacaaatacagtcaggtacaaacatagaaggaattcccacctttatatttgtagaagtattttcaattaccatcactcttgaaacaaaatcacaaagaacatacgggagaaattgttattctcattttataaagacacaaatgcccaaagaagtgatatatcctatgta

SEQ ID NO: 125488 - DNA, 417 bp, Homo sapiens
caaagcaaactgcatgtggaaagacagctcttgtcatatgtgctgagggtcatgtgtggcttgcaggtgaacaggggaaagggggcaaagtggttgaaacatgagagtttaagaagggctaagctttagagaaatgtgtcagatgagactacaaaatatgcttggactgcggttcttggtgtgaatccacagaagcccccactaccaaactcagagctaaggaaatatgttcactgtggcactggggcatccatttttgtccttggcatctccttcccgtcactgaacacacaaacgaaaaatcatctcccctcctccctttccgtttcatccatctttttcatgcttggtccaagaaacatccaaagacagcaagagagctcattttattgtttttagcatttgcttggtcccatt

SEQ ID NO: 125489 - DNA, 151 bp, Homo sapiens
gtggtttacttttacatatgataataatcacaatgcttctttaaatgtcatattttagacgtaacattataaatgaatagaacttcattaatataatactcccaggtcacagcaatctatctgggttttgtttcccctggtgtgaccttgg

SEQ ID NO: 125490 - DNA, 286 bp, Homo sapiens
cttctgagagtactcactggtacctttagtacctgggatccagtatcttccctaatgagattccttagaatttcatcccatttctcatcagggacatccttgtccagccctgttacctcggcagtaggctgaccagcagctgcatcattatatccaaccagcaaagcattaaacttgttagaaaatgaaactgtgtgcccagactttcactgtgttttactgaaggcttgtgtcagagactgtaagatcagtgagaaggaattcctaaagatactattaagggagg

SEQ ID NO: 125491 - DNA, 222 bp, Homo sapiens
agaggcatttagaatgggaatgccaaccagttagagttaaggaagatatttttcagagcatggccaaagtttttcctgtattaagatactttcaggaaccctgcaattagccaaatcacagatttccagttatttcggtcttgttaaaaacaaggctgatcacatctgtcttaagttggagtatgtgccttagcaatagaagctcttgcaaacctttaatta

SEQ ID NO: 125492 - DNA, 403 bp, Homo sapiens
tctgcttctgaaaggagaccaggtggactgatttgggaaccaaaaacaaccagaaatctagagggaaggggagaaggcaaggagagatcttgatctaggtgcaccagaacttatatgcaaaatgctgtttttaagtgcataggtattaatatttattagaggaagagataccatagcccacatcagcttctcaaaggagtctatctcacacacacacacacacacacacacacacacacacagacacacacacacaatagtttaaaaatgactgatctagagaaattaagagccaagagaaagaagcagatgagacaagaggcccacaatcatccatggttggaatgagccatctccatggacctaagacttgggatcaggggtggcggaaagtataaacaga

SEQ ID NO: 125493 - DNA, 248 bp, Homo sapiens
acgagggcagactcgagtcagccaatcccaggttcagattccggctcctcctccccttctctttgtggccctctctgaaccccattgtgaagcacgggtgacagtagcaggtgattagaagcttcagtgcaatggtttgtgttatggtgtcatgtgctctgcacagggcctggctccccgacagccctgggtcaggggccagttaggatgatggatgattactgccagcagctgggtttcccctccac

SEQ ID NO: 125494 - DNA, 779 bp, Homo sapiens
gattacatagtgtctatgagacttacttcatatgtaagaacatatatagactacaagtaaaggaatgggaaaaaagttccttgcaagtggaaaacaaaaaaagaacaggagtaactatatgtatataacttactatataactcagtaaaatatgcttaactaaaaaatattataaagagacaaggttattatataacaataaagggtaatacaggcagaggagatgacaattataaatatatatgcacccactataagagcatctaaatatataaagcaaatatcagtgaaagagaaaaaagtgagagacagactgaaatacactaaatactgaaatacagcaaatacagtaatgcgagatttcaacataccactttcagcaaggaacagatcatccagataaaaaattaacaaaaacatgctggctttgaactgtactctagaccaaacaaagtcaatatgctttgcaatagataccttgaaatttatttttcgtgtctaattagttctttttaaatgcttggtgggattctacagttaaaccaggtcctgggcttttctttgatgagagacattttattactgatttagtttaaagacctgcaaagacaatagcctctcgcttatcagatattttattactgactgaacacatttacacaatattctatccaatagttgcagaatatacatttttcacaactgcatgaaactttctccaggatagaccatcttttagcctccaaaacaacatatgcagaagactgaaatcatatatt

SEQ ID NO: 125495 - DNA, 270 bp, Homo sapiens
tagcctggcccggattccttcactaataatcatctgatttagacccacaaagactttagattctgtaattataatatacgggatttttaaaaagaatcagatttaaagaaataaaagatgtaatcacaagaaaggtctgcaataacagcaataaattacaagtaattacgcagacagattttaaaaaagcaccaaataaaacttttagaggtaagtataattgtcaaaataaaaaatggagtggttgagtgaaacatcagattattcata

SEQ ID NO: 125496 - DNA, 466 bp, Homo sapiens
caaaaaagaaatagtgctatacaaacaaatgcaagtgcaagatatgatgatgaggtaaatctcatatagtctagaatgggagctctgctataacaggaagggaaagaatgaggcaagagaattcaggatgagttctctccacaagcaaatatttcatgtcactttgtccactggatacaggctaggagacaattaaacaggagacaatgccgatgacagcacaaagtcattttcttctatacttagcactggccagactttcatcataaagtgatattagaggatttggcctgtgtccagaggacaatggtcataagatctaaaggagatagaaggggaaaaaaaggcttgagctttttcaaagtaaaacaagaagacaatgagtattgggccaaaatggtccatgttaagctgtacttggtggcgagttcacattctctcctcaactagtaatcctgttttcaaa

SEQ ID NO: 125497 - DNA, 230 bp, Homo sapiens
gctaggcctggccagactcactgtggacagaggaggccttgaagacacgggctcagcaggcaaatacctgggccactccaaaaacccgggactggggagtccaggactcaaatcagggctcacatggagcaaaccagctcccatcccccgagacccccacaccctggggaggagcctcagaaatgcacccgtcccctacagtgaactccggctgccccaagatgagccct

SEQ ID NO: 125498 - DNA, 717 bp, Homo sapiens
gaggttatgtcccaatacgcccaaagtaaattgaaaatactgtaagtcaaaaatatatttagctaggcgcggtggctcacgccagcactttgggaggccgaggtgggtcacttgaggataggagttcgagaccagcctggccaacatggtgaaaccctgtctctactaaaaatacaaaaattagctggtcatggtggcaggcacctgtagtcccagctactctggaggctgaggcaggagaattgcttgagccttggaggtggaggttgcagtgagccaagtgccactgccctccagcctgggcaacagagcaagactccatctcaaaaaaaataaattgtatttaatacacacctaacctaccaaacatcatagcatagcctagcctgccttaaaagtgctccgaacacttgcgttagcctacagttgggcagaatcatttaatgcagagcctattttataataataaaaatgttattaataatacaaaatagaaaagatcaaaatgcaaagtacggtttctactgaatatatattgctttcacaccatcatcaagtcagaaaattgtaagtcaaaccatcgtaagtcagggagtgtctatatttgtatatatcgtctatatttgtatggctgttgtgagaaattaacaaaataatgtctgtgttggtacttggaaaaccgtaaagtgccatggaaatatattgtcttggttatct

SEQ ID NO: 125499 - DNA, 705 bp, Homo sapiens
agggtgaagttagggaaaatgacttttaaagttttgtagaaactcctgggctcacctctgatctgggcatgaatagatctgaccctcaacagtatatacaaaacttgagaactaaactgcactgcaaagtctttgaaaactgaaatcatgttgggtcagtttaccaaaaagatccaacggtcctaaatgtatatgctcctattaggataattttaaagtacataagcaaaaatggacagaatggaaaagagaaatagacaaatccataattatagttgaagacatcaacagtcttctgtgagaaactgacagaacagacagaaacagatagatctgatggaaaatcagtaagagaaggaagtactgaacaccatctatcagctagatttaatttacatttatagaaccctccaaccaacagcagaatatacacttttttcaagtgcatggagcattcacccaggtagaccacatcctgggtcattaaaacaaacaaactaactaaatgtaaaagaacggaaaccatgcaaagtatgttccctgaccataatagaattagactaaaatttaataacagagagatagcaaggacatctctaaatgcttggaaggtaacttcttcaaacaaataaagagcatctacaataaccctacagctaaaatcatatttaatagtaaaagactgaacacctttcccctaagatc

SEQ ID NO: 125500 - DNA, 520 bp, Homo sapiens
agcgcataaccaggactcaagtacaaccccagacctactgcccatcaaccaagtaacctttgaaatgcacttccctcattcttttgctgatgaactcttgtgcatcccttaagacccaactcaaacatcacctcattcgtgaattatccccatttcctccagggggaaggagtgtcctccactctgggcttctgcgctcacattcataactctcaccacagcactcgtccccctgagctgtgattcctgctgtgtctatcttccctgctagatgctgagctccttgagagcagagactttgtccaatttatcttaaggcccccagcccctttccctccagtgcccaacacagtgctggcctagtacatcccaggcattaatcaatgcagaatgaatgaatgtttgatggaatgaattcactttgcttgctaagttgctcacggagcagaccctttgtgctgagtgactaagtggagcaggtcagtcacctgggattcaccaattgttgatggcctctctc

SEQ ID NO: 125501 - DNA, 252 bp, Homo sapiens
caggaaggctgagtgcaaagtttgcaatcaggcgtgtaaacttagccagctccctagctagatgggagcctcttggaggcaacctgcttcacgtaaaaggaatcgtcagcgtcgctgttgcaaccttggaaaattcccttttaataacatcttcacaatggagagaaaggtttgttgttcttcttcttacttgaaaacactgttaatcctaccacctggtggagagtttgatgaataaagaccgttgctcag

SEQ ID NO: 125502 - DNA, 554 bp, Homo sapiens
tgcgtaaaccggcacttgttcccttggggctcctttctccatagggtaagtatcttaagtgttcaatatactgaatgctggtgttatttccccacaactgcagtaaatcttcaaaaatatgctgaaagtagtctgtagatacattaacccataaggaagtccaattccctgtgagttttaacaggtaagaccccatccataccactaatcagactttcccaggcaggaagttgggtttttctctaaaacaacaaaggtaacgcatgctaagtgggttagttattttgctacctcaagtacagctggcccttgaacaatgtgggggttggcgcacagaccccctccacagtcaaaaatctgagtagaacttttgactcccccaaaaattaactactcatagcctattgttgaccttatcagtaacatagccagtcaatgatatggtttggctgtgtccccacccaaatctcatctcgaattgtagttcctttcatatggagcaaagaaagtatctaaaattcaggcgctaatgttcttttcatgtgtttggcccc

SEQ ID NO: 125503 - DNA, 426 bp, Homo sapiens
cgcagcacagctgccaccgggtatcacagcccatgctgtggccacaaagccaacctgggagccctcagggactggggccaactcacctcatcccattctcatcaccagttgtcaggtcccggggtccgggtccagcccatgctgaagtccagagggagttggtggatgagcagaaagaacactcggggctgaaggcaggtgaatgtggttttattcagcagcagcttttattaacagctttctcacactagctctctcacactgtttgccctgtcgcagctgcttgagccagtggctcccacaaacagctgtgcatctggctcttccttgccttcagggtcagcggcttaactctttttctctctgggcatgagcaagccaagctgtgtgctggctccctcctgtccatctgcaagacggacagct

SEQ ID NO: 125504 - DNA, 631 bp, Homo sapiens
cgcagtggctcacgcctgtaatcccaacactttgagaggccgaggtgggcggatcacctcaggtcaagagttcgaaaccagcctggccaatatggcgaaaccctgtctctatgaaaaatacaaaaattagctgggtgtggtagtgtgcacctgtaattctagctacctgagaggcagaggcaggagagtcgcttgaactcaggaggtggaggttgcagtgagctgagaccacaccattgcactccagcctgggcaacagagcgagactccgtctcaaaaaaaaaaaaatgtttacagaacactgcttcagggcactacggtgggaacagtttcatcccacaggttcgcctgcacacattagagaccatgcataatagttaaggcgcatgaggaaaacgaagtgaggatgtggctgggctgccatcaggctggaaaacgaggtacctgcttctgtacataggggtgatggtgtaccctggccaggcccgtcctgggcaggaatataaagtgttaaatattctggagagtgggaggcaaggagttcatggaaatcagagcttgcagagacttagttcagagacttaagaattcatctacaaaggaatgatcatgagtccacagtagtataaat

SEQ ID NO: 125505 - DNA, 665 bp, Homo sapiens
gtaagcatctatgacatgacaaggaaaactgaaaaagaacaaaatagttctcaaaataagaatgaataactgaacggatgacttaagagcaggaaagatacaaccagggagagaattcatgaacttaaagaaatgatacaaaatagagttcaaaaagaaaaacagaaaatagaaaacaaaagctacacaagataaacgcagaagtaaaacattaagacaaatcaatactctggaagagaagaggatgagacatagccaacagctgtttttaatactctagctatctcttaagatttctaccttaacttcattcttggtctgaaaatacagagaacttcccagaactaacaacagatacacattcacacatttaaaaggaccaatgaacgcaaagcaaaataaataaaaagaaatctagaagttctggctcccagtaacaggcacactccaccctgtctctccacaacgagaaaatacctctataaaaccaggggagaattcatggagcgctatttgaggaacctagaaagtagagtagcagatgaaatgggatagaagattctaattaaaagtaccaccaaaccagtggtgtgtttgagtttgttcctccattatcactcagcatagactcaaggcagcccaaatactggacgtggacatcagca

SEQ ID NO: 125506 - DNA, 453 bp, Homo sapiens
atctgtctccatgtggctctggtttacacataaagtataactggcaaaataaggctgaaaatcctagaatttctgaagtagcgacacagctttcaattcaagtcacacatcatttctgacacaaaaataacagcagttgagtacgtgagaggcctttccctccagaagtgtaggctctgatcccacaatgtcgtcattcatattccagtccagaaggacagaccttctcccagcactttcagctagatctgctggcttcttttatggttctaaacttacccaatatggaaagcagaatgctggtccctgaaagatgtctgcatcctagtcccctcaacctgtgactacatcaggttacatggaaaagggggagtcaagattgccagtcagctgaccttgaaatagggagatttttctggaggatcagggaggctcaatgtccttaaagtgtcc

SEQ ID NO: 125507 - DNA, 252 bp, Homo sapiens
tcaaagaaaactgtcacgtccaggctgttcagaagaattcaaagatgactgttctctgtccttatttcttctacattatgtcggttccacagcatcagttggatataagttccaccattatatccctagcacctaatttagtgctaagtatacaaaagaaccaaaggaaatatttgttgagtccatggactgaagaaatgaatgagtaaatctaccttttctgccactaccagcttacttatccaatgaagg

SEQ ID NO: 125508 - DNA, 191 bp, Homo sapiens
gagcccagaagtggaggttgcaatgagcagaaatgcatcccagcctgggtggcagaatgagaccccacctcaaaatacaaaaacaaacactctacaaaaactattttcaaaaacagttgtattcattaaagcaaaaataaacgtctgcaatcaccaaagcaaaagcttctgtgcttatacatccttggctt

SEQ ID NO: 125509 - DNA, 109 bp, Homo sapiens
ttgagaataaaacagaaccctaaacaaacatgtccccagtgaacaatctttagaaatcaactcatttttctaaaaacaatgaaacattgttgcttaatctatgtgtaaa

SEQ ID NO: 125510 - DNA, 612 bp, Homo sapiens
gcattgtgcattgagtgagactataaaaaacatacttttattcccgcatagattttctgtatgttttttctcataaaaatctattctgaaaacctgttttcattttatgctatttttgtatttgaaggacagtagaaataaaaaatagacagtttttggttttgttttcatttttctttttataaatgagtctatgaaaaaaattggaaagaatctttgaaaaggttggaatagttagaacccatgctgctgttttcttatgagataaagcctgtctgttctcaggatggcagaggtagtttgtcatttagtctgtgtttctttaaattcaaatgtaataccaatggttaaagtaaaatgtggttttatatatcttcatgtaaacattgctaaaattttaatataatctctgacagcagtaagagaaaaagtaaaccacttttgctttcagaactttctccaagatatctatggatttggggtggtaaaaaaacatgcagcaaagtgagtatgtgccttctggcccatggacttcactcacagtgttattgccaaggaagccgcctcagtagtactgcccatcacagggcagcctttcaaatgcttggtgtt

SEQ ID NO: 125511 - DNA, 641 bp, Homo sapiens
aaagtctctgtccagagaacattctcagagttttggggattcttcccctttcttatcttgtatttagtccaggtcagttaccaggtttttcttccataagggagttaagctattttggtaagggaaagctttgtatttatggtttatgagagttccatctatgctgaggtggtcttacctcctggaaattcccaagccagggttggaaatccctagaccatgttgcatcatactgctaattgacacatagtgtcagccctgcaagatgtttgcatgggccttacggctatcattaatcttatagccacaatatgtctctaacagtgtattacaacatgtcagatttaaagacataaatggattaaaagtaaaaggatggaaaaagatatttatgctagcagcaaccataagacagttggaatgactatacttacataaaataaaagggatttaaaaagttaccagcaatatagttggacattttataatgataaaagaaccagttcatccataatatataacaaatataaatgtatgtgcacctaacaatagagcaccaaaatacacgaagcaaaaactgacaggtttgaagggagaaactgattaatagtgtgatcaactattaatcagaccactgatta

SEQ ID NO: 125512 - DNA, 332 bp, Homo sapiens
aatttctctaaaagtgaaactgctttaactgcatcccaaagatttttatatgttgtattttcattcccttcagtgtatttttacatttcctttgagactttctctttgaccattggagtatttaaaagtgggttgtttaatttctaattgttttgtgattttcctggtatctttctgttattattgatttctagttagattcattatgaacagataatatattttttatgatttcagtccttttaaatttgtgaaggtttgttttacatgacccaggataggatgtggtccatcttggtatctatttattagttgccaaggccattttttcc

SEQ ID NO: 125513 - DNA, 276 bp, Homo sapiens
ttattaaataaattgtttttgactgtccttgagttgatctatatttgctgatatggaatgatcaggtgaagggacccttagtacccctgaactcctagaacactcctagcgcattctctgcctctctgtctcactcctttccctggaagaaggagtgcctgatctaagtgctgagagactgaactgagcagagagcctgaaatgagcagaaagcccaacccctctgaactccctttcagatctgcctgcagtggagcaagctgaaagagtatgaac

SEQ ID NO: 125514 - DNA, 303 bp, Homo sapiens
gactgcagtgcagtggtgtgatcatagctcattgtaacctcaacctcctgggcttaagggatcctcctgcttcagtctcctaagtcactgggactatagacacacaccaccatgccccagctgcatccccatctttgtgacacaatccttgtcagcctgaccagaaaactcttccctcccccatccagtcagtctcgagtcccctctattctctccccatcatctttctgaaatctgtcccctcataataatagcagtgatgaggataatagcagctcttgccaattaagcacttgttatgag

SEQ ID NO: 125515 - DNA, 789 bp, Homo sapiens
gttgttttgtggccattaccttctttctatttgggtagagatgaatggaataatgcgttttgttctcagggatccttctgtcaagaggtgacacttactgcctttcctaggacatctttcgctatttctctgttttagcactttcttctgtagaactagcagagtgcacttctgtgggggcaagatgcaagggaacatgtgggcttaagcacagataaagccaaggaaccagagtgcatcaagtctgggtgttagagatcatattcctgtccatgagttttcttgaaatggaagtttggaaagttgtgaatttgggtggtcattcttcattttgaagctctgattaacttgaaaaatactcctccccaaaggctatctctagttaattgcaattcttgttttaaaagcaaaagaatgagaatgtatatatcattcggtttgcaacatatatagagataatatataacaataattgcacaaaggggggaagagggaatagacttatataggagtaatatttctatatttcactagagctaatttaatataaacttgaagtaaattctgataagttaaaatgtatactggaagccctagagcaaccactaagaaaataactaaaaaaagtggaaaaatcttttaaaggaattaaaatgttatactagagaaaatattcaattagcactacacttatcagcaacataatacacattctcctcaaatgtacatggaatattctccaagacagaccatgtgctaggccatataacaagcctcagtgaatttaag

SEQ ID NO: 125516 - DNA, 168 bp, Homo sapiens
ttagagcatacaattccatggtttgtaatatatttccagagtcacgcagccatcactgaaatcaaattgtaaaatactttcatcacccaaatgaaaaccgcatccctctcagtggtcattccccacccactggcacccacacgtccccctcctgtctctgtggatggg

SEQ ID NO: 125517 - DNA, 708 bp, Homo sapiens
ggttcaagcagttctcctgcctcagccttgtgagtagctgggattaggtgcccaccaccatgcccagctaattcttatatttttaatagagatgggctttcactgtgttgaccaggcttgtcttgaactcctaacctcaggtgatgtgtctgccttggccttgcaaagtgctgggattacaggcgttagccactgtacccggccttttcttattttttttttcaatatttctaagctatgttgttcatctgttttctctaattgtcacaaattttctaaaaattttccaatactcatcatttatgttaaaagatccatatatattaatgagtagaccagtgcagttcaagcccatgttgttcaggggtcaactgtacttgttactgggaaataaacataactttaaggaataaaattaggtgatgtgtccagcttaccttcaaatggttcattaaaatgacatatacatataaacagagatacctgtaaaaacaaataggcaacatctaaacagttgatatatctggataaacagtagttcattgtattatttttgcacctcgtctataaatttgaaattacattaaaatgtaaagtcatacacataaaccaaccccatgccacacactccccctcaagaaaaaaaaaatagcttttagttcaaagtgtataggggatgaaaaagtacctcgagtgccagtctgatgt

SEQ ID NO: 125518 - DNA, 309 bp, Homo sapiens
tgagccactgcgcccgaccttatttttgcttttttaaaaaagatactaaaacatgtttgtaagctgatgagatgatccataaaagagcaaaatgatgatacaaatgagagggcatagttacaggagcaaaatacatcttacacctttggctttaagcattaaataatggaaaatactactatttacatttctgtcttattatttataagtgaggttatctttacaacttttggttaatgattctaaatgtaaatatgactgtactatggtatagttctctaatgttctaaaaatcctacctgcttttgt

SEQ ID NO: 125519 - DNA, 171 bp, Homo sapiens
acttttccttcaaaagaataaagattagaatgaggagagagatttcttacttgatacagtgcaagccagaagacaatgaagcatcattagagtgctggaaaaaaaaatcaaactggaattctatatggaatttaaaaatgaagttaaaatcttctttcaggcacacaagag

SEQ ID NO: 125520 - DNA, 306 bp, Homo sapiens
aataggtaggcctctcatccaaggttgatgattacgttttatttgtataaaaagacaggttcatttgcctgtagtctacatgtacaacattactgatgggaaaataggatgctttgttaacctcttttgttaaaatagcaaaacattaatgtattttaacaggaaatggttctagaatggtattttaaagcagtttactgccaatcacagaaatgactctagaatggtattttaaaacagtttactgccaatcactgaaatgactctagaatggtattttaaaacagtttactgctaatcacagag

SEQ ID NO: 125521 - DNA, 343 bp, Homo sapiens
gagacctagtaacttgcccacaacactggaaccagagcccagattctaggattatgtcctgttgttcacttgaccttgaagaacggctaacatttcagcagcataggtgatgggaagggattgcagagaagctaagagaactccaggtagagggatcaacagaagaaatttcacagagtctggctctgaaactgagagactaatgattgtgttcaaggagtgtcagagtaaggaggctggaaggcaactgaagatgaggctttgtgatgggagaagagatagtcttagactcttgtaacacaaaagatcagaatagagggttagaggttttgggggtttgttt

SEQ ID NO: 125522 - DNA, 792 bp, Homo sapiens
tagtttccccatctttgacataactatataggactaggcaaattctcagcttagtccttggagtggaagggagcacagctacaaatccttgtctccttatcaggaatttacctgtaatccagatggggatggcacatatggcattgtgcaaaatgccagggaaggagcctgctgttcggaggcttgtgaggagggaagggatggtaaaggcttccagagccagagagctaaatggaagcccccagggaatcagccagtaccaggaggaaagagtcagagcctttcttggcatccctggaaagaggcaaggcagagggaatcatggaccctagggtgatggatttaagtgtccctgatacaaggacacagccactaaggagtcacgctctgtgttgctgctagctccccaaaggaaaaaggccagagattgaagttgtattgcccatgaaatgggaccactaccctccctgcactcccattaccactcacatccagcaatgacaggccacctgtaagctctcaagcttcctgagccaattgtctcccctaaactgcagaacaggtgcccccaggagactgtccttgcccaaagtccacgtcccttatgattcccccgcctcagtccagcctctgcttcctgattgagtacatctgtgaaacctgagctgttcgtacccccactcttccagcatcctcagcagcttcctgctgtccacgagataaacttcagctccttcaggtgtggcatttgaggtcctcttgcatgccatctcctttcttactgtagcactt

SEQ ID NO: 125523 - DNA, 512 bp, Homo sapiens
ggtggcctatcagagtagtaaggacaaaggacagatatcagagcaaagggaaaatgaagagcatgaaacgctgttgcagagggaaagagcaagagaagttactggtgggtaacaggatcctacttcgtatttagataatataattatggctgccttatcattttcatctttccaaacaaagattatgggcttctggaatgaggattattcaagaaatttaatgcatacttccacacacaataaactatggtaccttgggtggccaaatttaattcaaaacttgggacaatttttcagttacccaagtttacactaatcttagcataaaacttttagctttcacctaggtaaagattaaataaattctgatttaatgtattttctttttgctatttctgtaaaacagcccaaacagtctaaaaagtgatgatacactaataaaagacagattaacccacagaaagagctatggtatagtctgactcgccttaatcctaggctacattatatat

SEQ ID NO: 125524 - DNA, 382 bp, Homo sapiens
ctaaatacatgtaacttatataattaaaaatcatctttcgttgtagaaagtaataaatgggggaaaagagctatcattcaccttaagcagtatgtctgctaatattcccataattcacttttacctcatctcaaatgctattacttctcactttttttaatttaatgctaagtgtataattttgatgtttacacatgtatataccaacaaagccacaaccaagataaaactatagtacatttctggcatcataaaagttttcctcatgtggccttcacagtcaatacctaatgacaccatttttttctaatttctattatcaccataaatttgttttgccaggttttgaacactatataaaatggccatttgcagccgggta

SEQ ID NO: 125525 - DNA, 559 bp, Homo sapiens
tcatgtcactatggcagagaagtgggtaggagacttgagaacaggtgcgtctttaggctgctctaactcacccaatctggtaattgccctgctttcttgtctaagtgttgggatctgaccttgaccttggactattcattgccacctatggagaattaaggaaaggcaaaaccttggtcatctccctcttgctcgccattgggaaaatgccttctgatttagcgcagcaatttctcctcattaagctacaaggggctgggtaaaatgaggcaggagagagcacaaattctgatgtcaggggatgaagtttgaagccaggctctacaatgtcctagctttgtgcatttatccagatgggactcagtctgaccttcagtttcctcatctgtaaattgggaatagtaccaagacctactccatggaattcaaggaatcagcgaaactaaggtgttcagaatagcagttagccactgttgctattattcaatttccaaactgattctctgattttgaaaatgcaaagacaccactcatgggaccaaagaggactgaggtgtga

SEQ ID NO: 125526 - DNA, 655 bp, Homo sapiens
actctagaggatcgcgtgtcatacccctatcgtacgtagtgagtatctgaaaactggaagagaagacagcttctaagcaaccagaagttatgtagccaagttcatgcacaaaagccaggatgcttgacacctgtcttggctctggttttaggcactcacacgtacgaagcttgagattcttgtttaccagtccccacaaattataagccacagattaaaatgtcccagggctggcttggagaaggccctccaaatgcaccagagaagcttccggaaacttggcacctgagactaacgaaacagctttcagcagagtgggtggcagatgggaaggcttcagaagcaaggtgcctccctgagtgatgtcccaggagaaaaatgacatcaacccagccaacgagaaaaagccctgtcgtgctgtgtgggaaggcaggtgccgggccttacctagctccacatgctcatgccatacttgctggaagctgggatgatgggatcccttctccagggccacaggaagggagaggttcatgggtcctggatggctaggccctggctgggactagagagcctgggtgagagaattgccgctggggctctggaggtgctcgctggggaaggtggtccgcggcaccgaagaggaaggcaggccatc

SEQ ID NO: 125527 - DNA, 256 bp, Homo sapiens
gagaggctgagttatttttgcaaccccaaattaaatgatgcatggtcgctggctgtgcatgccacggggcttgatttccattcccctgattcactcttccctcctccagggcgctcaggctcatggaaactgagggaagctcagggccctgacgacccaccaggccctggccaggacactgcatcctgctggaaaggaatgccccgtgaggggctcacggtggatttttaatccctgttcaggttccctgccctca

SEQ ID NO: 125528 - DNA, 385 bp, Homo sapiens
agagtattggtgtctttaatctgttctggataatccttaaccatcgtgtcttagaatattacctttgtcctattctttctgttttctccttccaattatatatgtattagaccttctatttcatcttaacatgtcttttattttctctctcataaatttcatttctttgctgtatgtgctatattctggactcttcagatttactttctagtttactaataattttcagctatactgagtatgctgtttattgaattttaagttttaattattataaaaactatttcattcattttcaaatctgtctagttattttttgatagtttcctgtttctcacccatactttctatttcctttaaagttttaaaaagcatattgaactgg

SEQ ID NO: 125529 - DNA, 363 bp, Homo sapiens
gcatccacagggacacacccatgtatataaacaaataagtggaagaaaggaatcagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaaccc

SEQ ID NO: 125530 - DNA, 805 bp, Homo sapiens
tcatttagggttattagcactgggcagacttatcttcttggcttttagcataatggcctgcagatgtctgtgggataacttaagcctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtttagacagagccatgtgggatgtagggctttgcctgttagtgtgaaacatttcttcagtgtttcctacagtgttctgatttgtactttggtgcttggacatttcctgttggatggcttaacggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggacatcaggaagtaagcctcccctgggggaccatgcagataaaggcagaaggagtaggtcagaccccagaagatgggacttttctgattcaagaagttcagtatctttgtgaggaactgcgccacacgaatgttgatgcgcagttcagtgtgacaaag

SEQ ID NO: 125531 - DNA, 400 bp, Homo sapiens
ctgggtcatagatgtgcagtctgtatagccaaaaaggacctgtgatcagaagggccctgaaattgatttaatgctcattgttattttgacattcttaacagttttatctttaaacttgtgttctgtaagataagtttgatgggacagtggagtatatgtgtaggcagaggagataagcacaaaatatatgcttacctttctggctactgtatttgctactgtacatcagtgtttctgatgtcccatgagcacagaattcttgtgggcccaccatgtgtggatgttaggcgagtacaaggtaagcatgttgtatctatgactgtgcaagcaggtgaactgatagccctgagatgctaagctttctatttaagccagaatttgctttaaatgtaaaaagaag

SEQ ID NO: 125532 - DNA, 532 bp, Homo sapiens
ctgcctcgcatcccaaagcccgggattacagtcatgagccacaggcctggcctaaaagccctatcttcctacacaggcgtgtagtctttcttcttgattttgcttgaggataaagagtcagaaaaggcttttataagagagatgcttgagctaaatcttcaaaggtgaatataagtttgcctagatgtctcttcttcttctcaaccagacttcttcacttggcagcaaaaatgtgaaggtgtgaaactcaatgatgtgtgttaggggacttcaaattgttctatgtggctcaaatagagggtggggttagagttgttacatgagataaagttggttgggtgggctagggctttgcaggatagatttggattttgtcttgtcagcagtgggatttctttgaagaataaaatcaatcaactttacatcttagctcattctggcagcattgtgcaggatagattagaagggtacatgcatggaggagagacactaggagatgaaacagctcaagaagcaaagtttgagggctttg

SEQ ID NO: 125533 - DNA, 703 bp, Homo sapiens
cagcctcaggcggaatgtttgagggcagctgacctgaacagactgatccgtctgcctggaagattcttctaactcagctggagaatggctgctcaataatgcaggtatttttctgtatttacttgtcacttgctacccacgtggatgttaaagtgaccaggagccacacctgaggcctctcgtgaatgaacggagctacttctgtgtcaggttttggggttccacaggcatgagcaggccatgggtcaggctggttccggcatggctgtggtcggcccacttccacagaccaccaccgcatgctgtccatctatccactggagatggccgcagtggggaccaggacaagaggacaaatgaggccctgtgtgtctgaacactgaccacttgtaaatcagctgctagatacaatgtgcttatacacaacatgcttatcctcctgccttggaaaatacgttttcaaatgagagaaatcacaaaatacgtgcaaagcatgatttgcatggaagtcatcaacatatcaaaagaggaccagatttaatgattcttatgtacgtctggcattctattctgagggggtagcaatgttaggatttgcaaaaaaatacagacagaataattcataaagtacatatttatcctatgaaatattttgcctttaaaaaaatagaatcactccatatcctgtagcaatcaagatttt

SEQ ID NO: 125534 - DNA, 516 bp, Homo sapiens
cgtggtgcctcatgcctgtaatcccagcattttgggaggccaaggtgggtggagctcctgaggtcaggagttcgagaccagcctgtccaacatggcaaaaccctgtctctactaaaaatacaaaaaattagctgggtgtggtggtgggcgcctataatcccagctacttgggaggctgagacaggagaattgcttgaacccgggaggtggaggttgcagtgagctgagattgtgccactgcactgtagcctgggcgatagggtgagactctgtcttaaaaagaaaaataaaaaaaagattaggatgatgctaaagtgtggaaggatggtgggtggtcagctgtgattaccactgtctacatctgcatggcctttaagtgcttctcactgcacttgggtcaagggacttttgaaggagtcttcctgcatttctgtctgcccagataaacccagagactatactgggacgtaggacctgctttcctcatcagccaggacctatagacctttctcatcc

SEQ ID NO: 125535 - DNA, 204 bp, Homo sapiens
atttctgttttcattaaagtttcagcctctatggattttttttaacctcctgccatctcagcaatgcatgaaaaaacacattttagcatattcagcacttcagtctgagagttgtttaggatatgtagcccgctatattgctggatatagaagtcttttatcaactccctcctgcccaataaacattgactttctagagacaag

SEQ ID NO: 125536 - DNA, 189 bp, Homo sapiens
catgcaaaacatatatctgataaatgatttatattcagaatacataaaacaattcttaaaactcaatttaaaaaacttaaaaatgggaaaaagatttcaatagacacttcacaaaagatacacagagagcaaatgaggttttgaaaaggtgctcgtcagacatggtggctcacgtctgtaatcccagca

SEQ ID NO: 125537 - DNA, 544 bp, Homo sapiens
ctgggccaaaatgtggaaaatccatgtaaacagcctattctctccctgagggcagacctatatggtagccaaattgtaattaggcctcttggtgaggctgtgacagagggaatcaggtgaccccaagactggattgggtgcctttcttctctgctccataaaatctcaggttcacattagatatgccatgccttcaggaatgcctgacagaggggatgctaaataaatatttattttataaaggaacagattcttctcaaaatagagatgattttaccagtggacaataatttctttacttgtcttcctgtcttctagagcatcagaagatcatctaaggtcaagcactagacttgtcctctaaacaagtctagtttagaggatcagtttagtataggctgaatgtagccactatcaaccttcaagtaaatcaaagaccttggagaaagagcttaacttgatgatcttccaatcagtcttgcaatgtgaaatctactgtcttgcatcttactgcttctattgaaattgtctacccatccccagt

SEQ ID NO: 125538 - DNA, 813 bp, Homo sapiens
gtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctggctaacacggtgaaaccccgtctctactaaaaatacaaaaaattagctgggcgtggtggcaggcacctgtagtcccagctactcgggaggctgaagcaggagaatggtgtgaacctgggaggcggagcttgcagtaagccaagatgccaccactgcactccagcctgggcgacagagcgagaccccgtctcaaaaaaaaaaaaagtcacctcttagattatatggaaattcattgtggctgacaccatacaaattatttcacaggcctggcatggtggctcatgcctgtattcccagcattttgggaggccagggcaagtggattgcttgagctcaggaattcaagaccagcttgcagcctgggcaacatggcaaaaccccatctctacaa

SEQ ID NO: 125539 - DNA, 710 bp, Homo sapiens
tactgtgcctggcctgaacatctttttaaaaaagatttattgcttatttatttttgtagcgatggggtctcactaagttgcccagtccagtctcaaactcctgggctaaattgatcctcctacctcaacctcctaagtagttgggattacaggcatgagcccttgacccaaactgaacatctttgttctcttttttttttttttgagaccagctctcactttgtcacccaggctggaatacagtggcatgatgatctcggttcactgcagcctcgacccagtctcaagtgaccctcctgcctcacccctccaagtagatgggactacaggcctgcaccaccacacccggctaatttttgtatttttttttgtagagatggggtctcaccatgttaccgaggctggttttgaactcctgagcttaagtaatctgcccgcctgggcctcccaaagtgctgggattacaggcatgagccatcatgcccaaccttattcttatttttgagcgttggtgaaaatcacttcaggatattattcctggaagtagaattgttgggtcaaagagtagggacatttaaaattttaattcattgtcatttacacttgccaaaggtttttaccaatttatgttactgtgatacaaaaattacgtgcttgccaacagtattatcaatgtttaaaactttgccagtctaagtggcaaaaacaga

SEQ ID NO: 125540 - DNA, 293 bp, Homo sapiens
cttaatcctgctgttagaactatgtgacattgggaggttgcttatcctctccatgcctcagtttccttttttgtgtaaatgggataatgatatacctacatgagtggtgattgtgaagtttaaatgagttcatatatgtaaagtaccagaaaagtgcctgccatcaaatgctcattaagtgttcctcataattgctatcaggaaactgaatgtcacagaggttaaattacttgtaaagataatgttagagtagctgaatttaaactagaatctttgactcctagtacaattgt

SEQ ID NO: 125541 - DNA, 538 bp, Homo sapiens
tggtgatagttgttctagaggatcccaactcagaggcgatctgccatcgagtgcctacagcgtgcctggcaccgacatccaagccagggatagaacaggaaggaaacccggggttgcatcccgagcgtagccagttaattgcaatagcagcgctgtgggaactcagtttataagggggtaggaggagagatttgtgcagcggggtggagaacggcattccacctgtcttcgttttattaatgtttcctgagcgcctgttatgtgtcaggcacagttctaagagcttaggactagagctgtgcacacgacacgtcaggtccacgttctgtctgatggaggcagacaattaaccagcacgttaataaaatgatttcggataatgttaaatgccatcaaggaaagaaaaggtgttgtgccaagaacaactttagatagggtggtaacatttgatctgagacctgaatggggagtattaaatgggtgtagacttcattctacatttcatcttttaatcagttctaaaaacacaaccattgaa

SEQ ID NO: 125542 - DNA, 599 bp, Homo sapiens
catggccggaacgccagaggctactggggagacacaggagcgaccaccatgatccacagaccaggactgtacagagcacttgaaggggcggcctcaagaattgtgccggaacagtgaacatgagggctcctggctcccctctgaggacaagggttaggtaggaggggacaggggcagggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacgaatctctcaggatgtgaagtgtggcccccagcctggtgcctttgcagtgggcccaggacggagggtagccttggcacctggggaggacaggtgaacctggatccagactctgcctcaggtgac

SEQ ID NO: 125543 - DNA, 204 bp, Homo sapiens
gcagtgacccccccacccccaatattgttaaatccatgaacctattctaacttagtcctcatcctacttaacttatcagctatatttgacagagttgatccctctttccttcttaataactttcttcacctgacttcagaacaagacactcaccaaaagatttccttctatctcacaggttgctccttatcagcttcccttgct

SEQ ID NO: 125544 - DNA, 532 bp, Homo sapiens
gaacctcgtctctacaaaaagtttcaaaattagctgggcctggtggcatgcacctgtagtcctagctactcatgaggctgaggtagaagaatcacttgagcccaggaggtcaaggctgcagtgagccttgatcacaccattgcattccagcctgggcaacagagcaagaccctatctcaaaaaaattaaaaatttaaaaggaaagaaatatcctaagaaaataatcagaaatatgggcacaattttatatgtaaagatccataaataagttatttataaatagtaaaaaactggaaacagtctaaatgattaaagaatatctaaataatgatatgaaattatgaaatgaaatattttgcagcttacctttacaaactttttgatgtcaaaggaaagtgcttatgataaaataagtttttttatgtgtgtaatattatattctgattgtggtcacaatttcaaaaaaaatgttcattgaaagaacgagcgtatcagcctgggcaacgtggcaatacccgtttctacaaaaaaa

SEQ ID NO: 125545 - DNA, 200 bp, Homo sapiens
atgaattggtggatgccagagatgttggccttggtgcttggtttcaagcacacatacctagtgttgctagagcttctgatggacagtcacgtggcaaaactccactgaagaatggcagttcttgtaaaaggactaatggaaatatacatcataaatcaaagagaacataaataaattggacaatgtactctctacatcta

SEQ ID NO: 125546 - DNA, 519 bp, Homo sapiens
gcctacagtcacttaatacatcgtttgcccatttccaggtatgttattaatagtattttaggtagtaattacaaattggtattatatatccgtggtggcttaggcttaaccagcaaagcaatccttgtttgagttggtaatcttgtctgcttttcttaccttatttcagttatattgtgtgttagttgaacaccagaggcctagttttgctgaattgctgcataatcacagagtttgggggtcactcaattcatgcttctgggtcccagttccatatctagaggttcaacctgataatttgaaaagggatttctagtaaaacctcttgtagtgcataatcagttttgacaatgagaaattaatgcctgagaagcgtgtatatgtaaaatcctccctgtccacttttcatcttctcctgtttcgtaaactcaaaactaaagacacaaagcatgaactcatgtaagtgcagagatactggagattacagagaatcacctgcagagcctggggcagggattg

SEQ ID NO: 125547 - DNA, 254 bp, Homo sapiens
ctactctccacttaccttgctttctctcctctccccatctatttccaggtggtggagaagaatatgccattggctgctagctttcacttgtattcctatagtggtcacaacaaatattgggtgggaagggccctagatggtgcttaaaaatgaatgaagcttattgttcatgttaaatcttcacttattccacttccagcctcacatccttttcctcccccacacttataaggggaaaaatcagcaactagatg

SEQ ID NO: 125548 - DNA, 260 bp, Homo sapiens
catgtataaaatgtttaaagaaagacattcaaaagtgaccagatttgaaacacaaaagaacgtttagaattaaaatacatgaaagactgagtaaattaaacatagattagcggccaggcacggtggcttacacctgtgatcccagcattttggaaagccaaagtgggaggatggcttgagaacagaagtttgagaccagtgtgggcaacacagcaagacctcatctctacaaaaaataaaaataattagctgtgtgtgac

SEQ ID NO: 125549 - DNA, 268 bp, Homo sapiens
acctgggggcctttgctttgcctggaacatgttctctgcctcatggcctgtttcgtccaccttgtcagcgagacctctcctgacctctctcccaccccattcccttccttgctatagttttctccatcgcatcttttcagtactctatattaatggtttgttttctgtcttcctccactaaaatagatgctccaggagggagaacagcatgtctcttgggcctgtatccctccccagtgccaggaagagcacctggaacctagcagcc

SEQ ID NO: 125550 - DNA, 475 bp, Homo sapiens
tccccccgctgtgcacccaccccagccacccttctcacctacactagtgcaatcctctcccacctgggcctattaccagtgccacctccctattcaaactcctccatgcttcccatggcaaaatcctaagtgaggttacctaatgctttcatccttctaccattttcacttacacacgagccccctttctgggtctggaacacgccctgtacattcctgcctaaggacttcacagttgcgccctcaatctgggtctctcttccttggatggttacatgcctggcttctcattcttcaagtttcgatgcaagtgtcacctcctcagagaggccttccccctgggtagactcctgaggctacttcttcattgactctgtgataccaccatttatttccttcaatatccttatgtagagattactctgcagaactttatataaacagactttctaaagaatacctaatgcatgaagaa

SEQ ID NO: 125551 - DNA, 218 bp, Homo sapiens
gtgtgtattagtttttttgttttctgcttatttttttaactgctttgtaacaaattatcaccaacttagtggcttgaaacaatgctcactgagtagctcacagttctgtaagtcagaagtgcaggcatggtgtgcctgggttctctgttcagggtctcagaagctgaagtcaggtgcctgctgattagttctcttggttcctatttccagcttaccca

SEQ ID NO: 125552 - DNA, 763 bp, Homo sapiens
aagctgaagtattaatacacacaaccaccaccactgcaagaacaaatccagatatgcaaaataagttttaaacttcatttatgttttctgataataattaatcagggtgtttcaaactcattaagttattaattagcttgaccttacagggaataaataccttggggtcttttgacttttttgttgttgttgttgttataaactataaagtatctaggaagtttctaatttcctgtagatggtaaccaaaagatttatcttaccacatattacattaggatgtggtaactgaatcagaacttgaattactctctggaaggggagtaaagggacagcttttaatttttatgttgatggatggtcttagtgcagagaagaacccagccaaatatatttatatttgatgctgttatttttgatgtactgtacctttgagcaatttgtattgatttaagtaagatttgatagcactgagaatcttttggagaagagaagctcattttaatacatgcaattctattaaattattttcctgtaccagctaatgacctttagacatttatctagtcatctaattctattgcataaaaactcctatagaataaatgtttttctgcccctttaaaaatattttgttttcattaataattatttgcatataaatgaaatagataaaacttaagaaacaaaaatctaacatgtgtataaaagttggcattgccactgttagatggagtcttccaggcagagaaaaactgaatac

SEQ ID NO: 125553 - DNA, 287 bp, Homo sapiens
atttggaataatggattttctggtacaaaagtaagttttctgaattacattcaaaagcgattgtatgctaagtaaattccttcaaaacttggatcttaaaagttaagataattgcaaaatgttattagactatgatgtagctcaacaaaagaacttgtggcagagtacttaatgagaagtgtactggaatggtgattccacatttactatagtcatatgctaaattgtgcttattggactagtggatcacaaatattggccatcccatacctactaaacattctaga

SEQ ID NO: 125554 - DNA, 192 bp, Homo sapiens
tttagatataaagttattaaacagaaaaagttactgaaggtagataattattggctatttcatgtgatttttctggtggttactgtagtcaattttatagtattgccaagtttctgaatccattctgaataatgtgattgtttattcttatgctttgggcctgataatttttgtagagcagcagttcttatc

SEQ ID NO: 125555 - DNA, 491 bp, Homo sapiens
agggggcttggctggggtaggggtagcgggtggaggcatggctgggagaggatgtggcaagctaggaagtggctgttcagggaagagtgctgggctctgggaagggcaccaaggggaagggctaggttaggtgagagatgggaggtgggacgtgggggtcccctaggctctgactccagctatttttaactggtgtgaaactgggtcagcggctgagggagcaagatgggggccaagtggcccagctccctttcttgacctacttaaggcggggcagtgcaggggggggccaccagcctctccttcctcctagactcccaagccactgcctctgaggcatagacaccccctgggggaggaacacacacagaagcacaggtaactttcttctccctcatctctcgcttgtctcttcctctgagcagcacctctctggatctctctttgggaccctcccaggctgcccacagcaaagccgactgaccaggccc

SEQ ID NO: 125556 - DNA, 376 bp, Homo sapiens
gatttggatatctgttctggagatgttgcacaaaatgtgcacaaattgttttactctgttccttttaccaaaagagaaattaacattctccttccttcctctctccctccttccttccttccttctttctttctgagaatgcactattatactgcatactcaaaatgggtaaggtaaattttttgttatatttttgacaatctaaaaaaaaaaaatctctgaacaccaaaagcttggggagctttgggttggcaatattctgcatactgccacacattaagatgctagcaagacaaaacattcctgagaacagtggaaacttagtgtttgggaaccctcccagaccttgttggctggttatgatttttatatcctt

SEQ ID NO: 125557 - DNA, 421 bp, Homo sapiens
aggccaaggcaggcggatcacctgaggtcaggagttcgaaaccagcctgatcaatacagtgaaaccctgtctctactaaaaatacaaaaattagctggggtgtggtgacatgcacctgtaatcccagctactcaggaggctgaggcgggagaattcgcttgaacccaggaggcggaggttgcagtgagcccagattgtgccactgcattccagcctgggcaacagagggaaagggacaccctgaaaaaaaagaaagaaagaaagaaagaaagaaattttgcctcccctacatatcatataggacagcgcagagaacattttcatcaccacagaatgttctagtgaacagcactggtctagaccctagaggcttgctagtcaaagtgaggtccacagaccagcagcatcagcctcagcatca

SEQ ID NO: 125558 - DNA, 448 bp, Homo sapiens
ttttgagaggtttcatatgcagacacaattttaaattttattttttttgcccccaatgagatgtttggagatggtggtactagaacaggaaggaatttataagtattggggaatttttcatcccaattcccatatcctcctataattcaaggagtgaatgggtagtgtttttgtttttgtgagaggggtggcggagggtagagagagaaagagagagagacagagagagattacatagaggtgtccaaaatgaacacagtaaaaaccagttttgattaattctgcaatattaagtaggcagccaaaaattttggtctgcttaattcttagctcatctaagtctccagttgactgattgattgattgaatgacttattcaacatgcgctagccagacactggtctagggcccaggaattcagcaataaatgaaacaagaccaaaaaaaa

SEQ ID NO: 125559 - DNA, 186 bp, Homo sapiens
catcctcaagtaaggggcctaaaagggtgaaaaggtctagtgtcctttaatttttactgtgcttttgaatgtgccccattaaagaatcaaattatgagtatatttttacagtactaattgggaggctggccagcataactaaatatcaaggagacatgtttaatacttttgtacccagtagaattt

SEQ ID NO: 125560 - DNA, 879 bp, Homo sapiens
tagccaggcgtggtggcacatgcctgtaatcccagctactctgaaggatgaggcaggagaattgcttgcacccaggagacggaggctgaagaaaaagtagttaagtcttgcttctgtctctgagctctggagttcattccagtttttactgtgtatattcttattttcacattcttagaagaaagttggcatgctgtatatgcttgtgacacttgatttttttttttataaattgtgataaatgcatagcaatagaaattacccaaaataaaaccaaagataaaaaattccaaaaaaaaaaaaaaaacggaaattgaaaaaagggctcgcgggagtggcggaaaacacgaaggggccaaaatatggggataataaggggcccacagggacacgacaggaagggccagaaaacttttttggaaggaaccctggcccaaaagtttcccaactgtgggccaaggcgcagggggccaccctggaatcccaagattggggagcccgagagggtgtacaccctgaaggcagagttgaacaccagcggcaaatgtgaagaaaacccttttttataaaatttccaaatttgcgcgcgcggtgtggcacatggcctggaccccaaaaattggaagcggaagaagaaggaccggtgaagatcagacaggggtccgacaaattcggcctaaggccccgagtggggaactggggaccgacaacgccggaaattagggtgcaacaaaaaggggcccgggtgggagagagccacctaggattgagtacagccacgtaaggtggtacaggagacccgcggaaattaaatgaagacccacttgtgaaacgcacaaagatgcgggccacaacacaagaacaggggacacacaacaa

SEQ ID NO: 125561 - DNA, 268 bp, Homo sapiens
acagaagatagataatagatggataaataggtagatagatggatgatggatggatgatagatgctgcatgcatacacacataacatatattttggatggatgatagatgatacattagaagacggatggaagatagaaggataggtagatagatggatgatggatgatggatggatgatacatagatagatgcatgcatgcatccacacatacacagatgacagatacatagattatggatggatagatagatggatgatagatgata

SEQ ID NO: 125562 - DNA, 266 bp, Homo sapiens
caaaaggcacacaagcattgattacagaaccaacttgtttgaaaaaccaaaaaaaaattccagatgtatctgtaatcccaatttgtaatgaatcctgatattttgtccattgtgattcaaaactcaaaaaatgttaaaccttccccctaatgtctagtcaccagttccccagtgttaaaagcaggtagaatacatacaactttctaagaagcgtcagtcccagagaacctgccttgtgcctacaacccccaggtctcgccagcaat

SEQ ID NO: 125563 - DNA, 797 bp, Homo sapiens
tttccaccttgttaagccaggaaaatttggaatttcccggccctggtgaaccgcccccctggggcctcccaaaggggttgggatttcaggcataagccacccacgccggggccaatttacattttttaaacttcttcctcttctcctaaacctaagggctccaatgatactacttatcagggaagaaagtcctgtatctagataaactacccttaagtattacaggcttagcaagttgaatttctagaaaaaactcattcataatttatttatttatttttttttgagacagagtcttgctctgttgcccaggctggagtgagactccgtctcaaaaaaaaaaaaaaaaaaaaaaggaaaaaagaaaaaaaagaccaagtatactttgtccacatgccacactttttttttttacccaattaacatcttaactatgtattcaaccaagaatgcaatactctcccatgaccaagacacaactcaagttaccaattgtgtgaaatttttcatctgcctcattaaattataatgaattatttccactatgcatccaaacacacctcaatgtagtgcttattactgttgcattttgattttcacatgactccctcctcctaatgaactgattccattgatggccaagtccaggtcataaccatcttcattttcctagtacaccagatataagatagtaatcaaatctaagatgccactgactaagctaccaattatagtgacatgccattaacccattcatgctagaggttgcaaattttttctgtaaaaaaaaaaaaaaa

SEQ ID NO: 125564 - DNA, 231 bp, Homo sapiens
atagtttatataactcctaccacctgccattcagtcacctttgtaactatcatttttaataatgcacattctcagtttattctttacttaccgagttccatttaccttggaagtaaaaacattttttccaaattcttacagctatctgcttcagcaaatggttaaatacaccctaaattaaatactttatttaaatgaattaatcatatctaccaagtcatatatgatttt

SEQ ID NO: 125565 - DNA, 509 bp, Homo sapiens
tgagctcggttccgcttttggggtctttgctggcagacaaatctaggtcatgtcagtgtttgccattaaattaagtcctcccataacccctaaaatagttttcagaacttttgggatttcaaattataagtaagagaatgtggacctgtagttaaaaatagtcttttcccttatccacccaccaccaaaaatagtcaagtcagaaaacatttctattcatgttaaatgaaaatctttaaattgacattttctataaaattccattgcattactgcaaatgaagattagttagttgttagggttttgttaggagaatcttattaagccatgtggtttttttctaatataacctattataattcataacagctgtcagtcccctgctgatacttttttccccattaaaaatgcatttttaaaagaatataaaagtacatcacattccactaatatatgcaacaatcgaataatttttcaaactagaaaatgatgagcaaagaccccaaaag

SEQ ID NO: 125566 - DNA, 409 bp, Homo sapiens
gaatacttcatgcttctccatgaccataacaaacagaattgttctacttcctttactaattgttctacttctttctataatatctaccaagtattatcctattgccatcatattttcaggttggtactttcttcctgctatcctttttatgggggagacagagtttcgctcttgttgcccaggctggagtgcaatggcatgatctcggctcacggcaacctccacctcccaggttcaagcgattctcctgcctcagcctcctaaatagctgggattacagccatgcgccaccacacccagctaattttgcatttttagtagagagggggtttctccatgttggtcaggctggtctcgaactcctgacctcaggtgatccacctgcctcggcctccgaaaagtgctggga

SEQ ID NO: 125567 - DNA, 350 bp, Homo sapiens
aaggcagtcaaggggcctgggcgccaccacagcgatggcgatgagcccatttacagggacgctcaagtacaaaggcacattacatgtgcctaagaccttaacatcagaggctttggcagcgtctcctgaatatggtgcaggaggttggtatggtccaggggccccacgtgagccagacaggtcccagaaacaagctgagggagccatcatagttgttgtgatagatgccagtcagctctatctcgtctcctggcttgcagctgtccaccagatctgcgaggagaatggcgtccttggagcggggcagccggccagccgccactttgcctggactctcctggattcggata

SEQ ID NO: 125568 - DNA, 489 bp, Homo sapiens
cagactctgaccgagttccaccattagattcatttttaacattttctatgttggctttatcaatatgtctatattaataattctttatgagtaattttaaagtaaactgcagatgccacgacatctttgcctttaaacgtttcatatgtttatcttctcaggatatggacagtcttctatatagtcataacaaccatgtgtgtacattttgtatgtatgcagtaggtgacttgttgccttagcaggttaacgtctgctactggtgtgtattttttgacatggttaattttcttggtgtttacactttcgtccccatggttagttattaaatatatgtaatacaaagtatctgttttatttgttaagatctccttccttccctactttgcaaccaacccctgagggcaaatcaacaaaaatcatttagttcattaaaaacaaagttgctctagacaaaagtacccatttgctgactgctgtttggtattg

SEQ ID NO: 125569 - DNA, 332 bp, Homo sapiens
atcatgtacttttagaaacccaaatgatattacactataaaaataagttatatttcccatgcaaaataaatggataatgaaaacatctgagagttatttatacaatattataaatttatgaaatgctatcatttggtggggaaagatttgccaggaaatgagactgaagctgtcatatagttttggctagattgtagtttataggatatcgttagactttatttatccatgtactctcttatctgttattagggtaacttaagatttgaccaggatttgtttttgaattttttggagcgatggaaacgttctgcatcttgattgtggtgatg

SEQ ID NO: 125570 - DNA, 581 bp, Homo sapiens
ggcggagggtgcagtgagccaagatcgcgccattgcactccagcttgggcaaggagtgaaactccatctcaaaaaaaagaaaagaaaagaaaaaagaaaaagaaactaaataaagaagggaaaattaaacccaaaacaagcaaaatggaggaaataatagataaaagcagaaatcaatgaaattaaaaacaaaaacaataattggtgatatgaaaggatgattgcttgaaatcattaataaaattcataaacttctggttaggctgatcaagaaaatgagaaaggatacaaatttccaatatcaggaatgaaagagggcatatgactacagaccttacattcaaaggataaaaagttaattgtggaggaaatgggccaatttcttgaaagacaaatcctaacaaaactcataaagaagtagataacacaaatagtcctatatctattaaagaagttgaatcagtatttaaaaccttccaacaatgaaaactccaggcctagatatttttgctgttgattgcaaccagccattaaggtaataatagtaatcctattcaatccatctcagaaaataggagata

SEQ ID NO: 125571 - DNA, 225 bp, Homo sapiens
ctggagacagaaccctcagtcttgagatcttcatgacagtccatgagtggagaggggaggctagaaaggaaggctcagctgtgagttactatttggggaactgacaggacacagactagcagtacaggattgggctcactggctgtgagccctgtagccaagttacctgggttcaagcaccgaggtggcacttcctgttccccttgggtaggctcctaaatttat

SEQ ID NO: 125572 - DNA, 172 bp, Homo sapiens
ctctttcttcagctaggcataatctcttaggtatatttggtaaagtgttcacttctggaatttctatttggttttttgcaaatctattaagttgggtttttcccccccttttcttttttgagacagagtcttgcactgccacccaggctggagtgcagtggtgcgatctcag

SEQ ID NO: 125573 - DNA, 229 bp, Homo sapiens
ggcatttctaggaaggcagaggaaatttcctgggtgtctgataaaattggagctagttccgtattcagatgcacttgacatttcactcttgaccgggcagcagtgtgtattgagatgaggctgggcagtgtcagagcatacctgctagaaaagaaattggttttgcagattatattttagtaaaatctgaactgctcagtgaagcacactattactatctatgtacaca

SEQ ID NO: 125574 - DNA, 377 bp, Homo sapiens
gaccaataaggaggataatcatgaatttaagtaactttaagtgggagaaagtaacctaagtcacatttaatgggaggatcattctgaggaatatgagagttgtgggaaactgcttctcataatcgtgataattcacatgagcaggccatctgctttaaattggagatgaaaaattggagaagtattgggaaagagggggacaggtaatatacccggcatggatcaaaggagagagagccaagaggagagagaaagacagagggaatcatttgttagggaagccagagagaaacttccttctactgagctggagaaacccgtgttcccctcgtttagcatcagaatgtcctgctgtgctatcaaatgttgttgaagtt

SEQ ID NO: 125575 - DNA, 960 bp, Homo sapiens
cagatgacctctatgaaagatggaggattagctgtggggagtggctcattgagctgtttgtaggataaaaatattttgtttagaatttagttttgagtcaagttctgtcctgatgtagtcacctttcttctgtcagatacctccatggcccacatctagtcatccattacccaggatgactgattccaagcttgtggaggttgtttggtgggaggaaatgtgtttgtgtgtgaggggggtgttttcttacattaaaatactaagttttataaacataattttattggcccttctcagtgcctagcaaggaaggtaggttaggtatatgctccttttttcgttgaggaaactgagctcaatgtttttgtgtgtgtttttttatttgtttgtttgtttgttttgagatgggcagcctttgctgcccaggctggagtgcagtggtacaatctcggctcactgcaacctccacctcccggggtcaagcagttctcctgcctcagcctctagagtagctgggattacaggggcctgctaccacacccagctaatttttgtatttttatttttattttatttattatgattattttttgacatggactcttgctctgttgccaggctggagtgcagtggcgccatcttggctcactgcaacctacactcccgggttcaagtgattctcctgcctcagcctcccgagtagctaggactacaggcacgtgccaccacgtccagctaatttttgtatttttagtagagacggggtttcaccatgttagccaggatggtcttgatctcttgacctcatgttccacctgcctcagtctcccaaagtgctgggattataggcgtgagccaccacgtttggcaatttttgtatttttagtagagacggggtttcaccatgttggccaggctggtcttgaactcctgacctcaagtgatccgcctgcctcagcc

SEQ ID NO: 125576 - DNA, 739 bp, Homo sapiens
ggggtgtgcacggctgcaccatctcaaagggcctcgccaggatgtgcccacgatgacagcggcaggggctggagcaccgtttcctctgcacccatggggcattcttcttcccaccagaacaaaccttccaagtaattgagcacattcctcagttcccattttaaccattttcgggacgtttttttctaaaacacttcttgaatgtttcccactcatcttcttgtgggactgaccataggctccaggccatgggatgccttcaggctcctccctcccacccaaacacccagcggcctcccttcagaggtgctccctgattggctgttccctcttctggtgcccctgcccacatcccacttccagtcagccctgatgagacaaagcagccagccaggcccaggcaaggcgctctgtgccacctcgcccttccagggcagttaggcttcgcagagcatgcttccggtcctctctcccctgctctccaccccagctccctgtcatgcattctggatccccagggcctaactaagcggcaggtaagaatggggccgggcctgtggatctgcctcctaatttatggaaaatgctggggacgaggagcacagcaaaacccagtacagggatgtaaactgcaaacaaagaactgtgtttcttcaacttaaaccccaagggaaaaaaagacattgcagggaccagagagattaattaaaagagatgtcagagacacataaaccaatca

SEQ ID NO: 125577 - DNA, 814 bp, Homo sapiens
aatcttagaaatcatatttctttttctttcatagtcttttcttgtgtacgtgttttctttcactctattcattttttgctcagctatcctcctgtaacctcataacattcttaatgaagatgatgggatggtaagtgtctggcaaagcgggagataatatctttttccctcctgtattctactgaactcattgttccttctcagccttacttaatcaagttaaacttatacaccacagctctgcatttagtttcctgaccctgtgggttaggtagaatttagatacgaaaatggctggaaagatttataaaaatctattatgttaatcattggtggggaatccataacatggcatagaacttgaatgtatggatttgagaaaaaatatttacattaacttaattatatgatgatggatgctaattgataagcagtaggttgaaattcactgttacataattcactattatgtcatggttgctggttgcccttaactgaatgattttgaaggaaagctgataactattttgagttaaatttttacaagtggttccttatatggtgcaatgccgctgcaacaaacagtaggaattttgtagcaaaaagtcttaatagtatccatttaaataactgctgcttatttaatgcccatcagtgctaggcccccatctaaatgtgattgttacagtcattaattttcacaattctacaatggctttagaaagaggaaacaaaaatttaggttaaacgacttacctaacatgatttctctagtaagagataaaactgtgattcaaatctatgttagacatgt

SEQ ID NO: 125578 - DNA, 203 bp, Homo sapiens
atcccataaagaaaattctttgtctcctttggccctcaaatacaactgtcaagtcttatgaatgctaattatttattactggaacttgtcaattatttcctattctaggttttcatttagataaacaccaaaggcctacttgacttcctggtttgacattggcaatctactcccacaacaagattcttcttcttctttttttt

SEQ ID NO: 125579 - DNA, 423 bp, Homo sapiens
tcacctctccctatgaaatgcttgatggtgttttgtttaggacctgtgggaaggaagaggagtgaggcataacgcggcctaggagaaggaggggagtttgattaagattctttagtgagtcctgaagcataggtaagagttctccagaacacggaagaggcaaatgaaacagttcattgtaaggtttagagtaagaacaaagtatgagatgtttaaggaaccacatggagtgtcttgagtgacaaaaagaaaaccagtgaccaccagagaaaaaacaaaaggacttttaaaaaattcctgagtcatagtttcaggcaaaacactcaagggagacaattgccaggaaataacatcaagaggatgcctctgagcattcaggtgatgtcatgtttagctcactcttccctggtagggaataccacc

SEQ ID NO: 125580 - DNA, 517 bp, Homo sapiens
aatcacctaccactgcccttcctgaatgtgggggcatcttggtggctaggcagtcattcccttcctcccctattgctccatgtgtgtctcttacaaaatcacaagctcagttgaattttgtgtatttatcacacagaaaatccttccttccttccttcccacaaatattcttcagcacccaccctagagtgagtgctgttttagatgctggggctggagcagtggacaagaccaagattcttctctcagagcttacatttgggtttgagctaatggtgatgggtagagaaagaaataaccaaggcaatttcagacattggtaagcaccgtgaagaaaaccaagataataaaatagagagtgactggagatggggaagcctagcagattgggtggtaaggcgaggggtctttgaggaaggagctaacttgtgagtgaagagcaggagctgctttgtgagcattaggggatagagtgctccaggaggggcccccagtagtgcaaaggccctgagacagg

SEQ ID NO: 125581 - DNA, 483 bp, Homo sapiens
gacacaaagaattttattatcgtaatgtagcaacaacatgagtaacatatttgtgtcagttcccccttgcctcccaagccccatgggcatgatgctgagaggcccaggtagatgctgcccacacagcagattcacatcacagctgaggaccctcatcttagtgatctgaatgttttgtaatgggcaagtaaacaagccttcctgagctttgctgcagtgggaggcattgtgtattcatgatactggacagtaagcaaagctgtcctgtgctcctgaggaacagtgctgtccgctatacaaacaattctcctgcctcagcctcctgagtagctgggattacaggcgcataccaccatgcctcgcaatttttgtatgtttagtagagatgggtttcactgtgttgttggccaggctggtcccaaactctcggcctcccaaagtgctgggattacaggtgtgaaatcctcgaagatataatctgga

SEQ ID NO: 125582 - DNA, 204 bp, Homo sapiens
gcagaatcaagaagatgaaacagccatgcttaaaacagaaaaagtgacaagtgaagatgggacagggagcaagaaagagaagaaccaagggcaagacagagcaagccagatacagtgaagcatctcctcccctgtgccactgaagtggtatgggagtactatgagttctctgagtagttagccagttgggcaggtcatggttag

SEQ ID NO: 125583 - DNA, 356 bp, Homo sapiens
aaataacctgagcaagccctctgctctggatctgttaaagtcagaagagtctgcttttctctggggcctacaaatacaggcacaactccttgctaaggctaggcttcctggcaaccaagggagtgaccgagtagcaggccctgccaggtacaggatgctagaagtccacctgcccaaagtctctagaaggacagccccaaaagccaagctctcaacgactgggaggcaaacctgttccaccatgctccactgcctcaaaagaggccagattagagcaaagcagaagaatatgatgagctgaagcagaacccaattcaatgtccagcatggttggtccctgggctgcggtgagaaaa

SEQ ID NO: 125584 - DNA, 726 bp, Homo sapiens
ttgagcagatcatctcatctttatgtcacagttccgtcatttagaatatgtggatattaatagcacttactactacctggctattgcatggagtaaatgaactagtgcatgtaagggacatataacagctcctagcacctaggaattactatagaaatgctagttactattaagaatttatttagagcactgactcttctactgaactgtgaggatcttgtaggcattggtcattccttaatgtttttatatttttttccccaaagcaagcttagttactgctggttaaaagaacagagtgactttcatataaaagtgactaacacagcatctgacaattaatgaatccagtgagtgagtgaatgggtgaatatggagtttgtggaatagtagttgacacagaataggcattcgctaagtctttcaagatgaagaggcattgtcttcatcaccgaggcatccgctggccttacagctggatcccactgagtcttcaattgcttttattgaggtattctgcggttgtggtgtcctaggtcagattcttcttgtgtgggatttcagggtccagggaccagggtggtctggagttgtcaaaaagcatcctggagaaaacacgtgaagtgagcttcaagaatagaccagtaatcaagagcctggggaggagagagggcctgccagcgcacagcttgggtctccttttgcttgatgctgtgtgacaaaaca

SEQ ID NO: 125585 - DNA, 396 bp, Homo sapiens
cttttggtgtctttgctctttttgggtctttgctcttttggtgtctttgctgtaaattagaaatacaagaaaagcaggccgggcacggtggctcacgcctgtaatcccagcatttctgggggctaaggcaggccaatcacctgtggtcaggagttcaagaccaacctggggatccaccagccttagtgctgggattacaactgtgagccactgcatgtggcctaaaatttcgaattttaggactattccacttagaaatttttgttacaaattgaaattttcataagtatgcatattaaaaaacagtgtcttgatatattaaaactatccaactattttaatgaaacattacattaattatcctcagaggatacttaggtgtagcccaattgttct

SEQ ID NO: 125586 - DNA, 369 bp, Homo sapiens
cccaggagttctttatatattctgaacccaagtcctttgttacttttatgtgtcacattatcttctcgcaccttgtggcttctcgtttcactcttttcatagtatcttttgataaccagaacttttttttttttttttgagacaagagtcttgctctgtcactcaggctagagtgtagtggcgcgatcttgactcactgcaacctccgcctcctgggttcaagcgattctcctgcctcagcctcccgagtagctgggattacagacacatgccaccatgcttggctaatttttttgtacttttagtagagacggggtttcaccgtcttagccaggatggtctcgatctcttgaccttgtgatccgcccg

SEQ ID NO: 125587 - DNA, 352 bp, Homo sapiens
ccaggctacaacagggaggggtctggagagctaactgtgtctgctgtggtctctctcagctggagagcaggaggcaggggccatggcatctcaacagtgtgacagcccaagagggttatgagggaccccagtaaacactagcagctttcagttagagccaggatggggcacaaaaaaggaggacgcatttgcacccggaagctcagggcatacaggagtataggggctgaaggtgaaagttgtagggtccaaggagaaactggcacattctcccctcacaggcagatctgcaataagtgacggcccaggcatgactgtgagtaggggtgtccaatcccaccgagggggaaga

SEQ ID NO: 125588 - DNA, 128 bp, Homo sapiens
gaagcctgccctctgctttatagtcttggttctaggaaagttgcttaaccttttgggaccctagtttcctcatatgtaaaatagggtttctggttggtcagaggagtgtcttaaagaggggttaagct

SEQ ID NO: 125589 - DNA, 418 bp, Homo sapiens
ggagggccgggggaggcaggaccgtgagctgcaggaggttggtgttggccctgggatgttgggacagagatgttatcctgggagaacagcgtggccaggctatgctgggagcagggtacacgctgccccactgggctgcatgacttcccctcccgcgcccctcagattcctgggtggccttagaacttgggccaaggccacggacgggcagggaggccaggccccccccacagctgcaggcccaggacctttgcccacggtcctattcttcggtgttatcgcttactaaatgcaccccttcttgtccttggctggcaggttgagtgttatgttctccatggcccctggctcgttccacctgcaccaccgccgctcccgtcaggccttttccccatccccactagtggcacaggggatg

SEQ ID NO: 125590 - DNA, 729 bp, Homo sapiens
ggcataagccacagcccctggccggcatcaggatttttaaaagctcccaagtgcagtcaaggttgagaacagctgctatagtgtgacttaatacagcattcaaagcctctcataatctagcctcagcctaatttttccttccagcaccccatctcagcctgtacataagccacagagacattctcactgttctctgaatgtacttggctcattcatatttccaggctttcttgcacacacattgtctgactctgggcacctaaggaaagctcagctccaatgtcctctcctcttccgtgaaacctttcctgtcaagcccaccttcactactaagtcactccttgctcctagatcagatggaagaatgctttggcatatctctactggagcccttctcactttacattaaagataactgtatataggttagcccactcctcctccctaatagcatgtggaccctttgtagtttcagcagtaagcacagggcttggtttctatgaatacttattgagtgaatggatgaatgaatgccaatcttgtacattgttgatgttcaccacattgaacccagttctcaaaccaggatcacttgggagattctgagtcaataatttgaaggtctgtatcattcctactcaaagtgtggtccataagccagcagtggctatattatctgggagcttgttgcaaatgcagaatatgtattttaacaagatccccaggcaa

SEQ ID NO: 125591 - DNA, 515 bp, Homo sapiens
aactttcacagggaggcaagcaccctggcatctgctaatactctgctgcagcagccataccttggtcccaccatcacagtgggctgctaaccttgaggagccagagaacaaagttggggcccactacaagtcttgcagagttacagcatgcagaccaggagttgggagctaagtgttggccccctacagtctttcagaaatgaagccagttggtttaatcaaccttatgccacaatcaaactctcaaggtcatcaaataggataaaaggggcaaaaaatccaaaggtcagcaacctcaaagattgaagatagataagctcacaaagatgagaaggaatcactgcaagaaccctgaaaactcaaaaagccagagtgccttctttcctccaaatgaccacattacctctctagcaagagttctgaactggctgagatggccaaaatgacggaaatagaattcagaatatggataggaatgaagaacactgagcttcatgtgaaacccaatccaagga

SEQ ID NO: 125592 - DNA, 224 bp, Homo sapiens
cccacctcacagaatgaagtttgtgggaagccttataaatgcaccagtcatgaatgcacttcagagtctctggggtgctgtataaatgctccttatgggaagggcagcatatctgcagctctctcactgagcactcaatgtgtgctgagtgctgggccacgggaatgagggctccatgaagaaagagactcgtctagttcaccactgaatccccagcgtctaga

SEQ ID NO: 125593 - DNA, 244 bp, Homo sapiens
gagttgagtaaagagagaccattgggacatacaacccaaaatatttactatctggttctttaaagaagaatgtttaccaactcctgttctaaatcataaaaattatcttgcggggaaagtttcttcttttcagccctttaaaatttttattcgcttcttatgcctcagggtaactagacaattgaagtctcttaggtgctattctggagaagatttctctctatgtattaattgccagataaga

SEQ ID NO: 125594 - DNA, 181 bp, Homo sapiens
tggtgactctagaggattccgtctagcctgccagtgggaagctaagagcgtgcctgcctcccatcctgacctcctgccccttcagaagcgtccctgcagctcctgcctgcacctggcagggagcaccgctacagagtttgctgctgtaccggctcagaaacgggagttcccggcacagggc

SEQ ID NO: 125595 - DNA, 867 bp, Homo sapiens
actaatgagcttaagctgcttggaatattaattatgtagtttttacattccattttaaaacaaaaacttagaaaaggtgctggcattctgaggcctgcaattaggccacatagcagaagcttgctccttccttatctgggtgaaatattttatttttgcactttgagtcatattcccacccctgtataagctacataggagcctgaatgaattgggtaggaaaggaaattatgcaaacaagtctcagctagtgctgaatgaccccaatttgggtctgctgtgaacatcatttttgtatttctcacttgagaaatgctgcaaggcaattcaacttttatgcttttaaatctcacaactcagaatctgatatcttaaatcactgattctgttacatgctaggaacaaaatgccaacatctcatgtaaagaagttgcataatcatgaaaaataaaggatgtttcctatgccagttagagtggtttgacccttcaggtaaaaagatatgttactgttatttttctacgtgacagaacagactgaatttagctagggaggcagtgatgttggcttttgggaaagggttcaaaaaactgtatggcaacattaatgctaaaatgttaagccgagtgcagtggtgcaaggctatagtcccaggttctgaggaggctgaggcaggaggattgcttgaggccaggagttagaaactagagtgtgttataacgcctatgaataaccactgcattccagcccgggcaaggtagcaagacccattctcttaaaaacatggctgggtgcaatggctcacgcctgtaatcccagcactttgggaggccaaggcaggcggatggcttgaggtcaggagttcga

SEQ ID NO: 125596 - DNA, 860 bp, Homo sapiens
actaatgagcttaagctgcttggaatattaattatgtagtttttacattccattttaaaacaaaaacttagaaaaggtgctggcattctgaggcctgcaattaggccacatagcagaagcttgctccttccttatctgggtgaaatattttatttttgcactttgagtcatattcccacccctgtataagctacataggagcctgaatgaattgggtaggaaaggaaattatgcaaacaagtctcagctagtgctgaatgaccccaatttgggtctgctgtgaacatcatttttgtatttctcacttgagaaatgctgcaaggcaattcaacttttatgcttttaaatctcacaactcagaatctgatatcttaaatcactgattctgttacatgctaggaacaaaatgccaacatctcatgtaaagaagttgcataatcatgaaaaataaaggatgtttcctatgccagttagagtggtttgacccttcaggtaaaaagatatgttactgttatttttctacgtgacagaacagactgaatttagctagggaggcagtgatgttggcttttgggaaagggttcaaaaaactgtatggcaacattaatgctaaaatgttaagccgagtgcagtggtgcaaggctatagtcccaaagtgctgggattacaggcatgagccaccgcgcctggacaaatatacatgtttttataccttttttttctattttttttgaggtggagtctcgatctgtcgcccaggctcgagtgcagtgacactatcttggctcaccgaagcctccacctcccaagttcaagtgattctcatgcctctgcctctggagttgctgggattacaggta

SEQ ID NO: 125597 - DNA, 746 bp, Homo sapiens
tgctctctctcgcctgctgccatgtaagacacgcctcttccccttttgccatgagtttaagtttcttgaggcctccccagccatgcagaactgtgagtaaattaaacctcttttctttataaattacccagtcttgggtatgtctttatagcaatgtgaaaatggactaagataccaggtgaccctctcatttctcaaagatataagccctcatctcaagcatcaatgaatagcttcagtgattttatatttgtctactaggttctcactaaactcataaagaaatatttttgtgggtactgtgagtatttctggactgtggacatgtgagaaaaatcccaaaatgagtggctttattttacagccatgaccagctgttcactcatgttactatgtcagatctgtttgattaatggtgcccacacatatacatacatatatatctttgaagaattgcactattgattagaaaattttaaatagcttaagactaaatcataacaggatttctctatactgctcgggatttgtctagcttttaccaaccagaaaacacggccattagaatgttaaaatataaaatctacacagtacaacataaagttgggcatttggggttaattcattaattttcatcacaggaatcatgtgaagcaaaatttccatattttcttgagtaggagggcaatttgagtagaggaaggattccccttcctcctgcttttgactcacgcagtgtctgtgta

SEQ ID NO: 125598 - DNA, 576 bp, Homo sapiens
ggggtttgatagggatggggttttgccatgttggtcagggtggtcacgaactcctggccacaggtgatccacctacctcagcatctcaaagtgctgggattacagatgtgagccaccgcgcccgaccaagtacaaactttttaatgcgccacaaatcactgtgaggttgtagttggggatttgaccatctttgccaaaagtaccagaggcgacaccctccttaatctgatagcacagataggaccaattttcttagttcttaccagtcctagctacaaggctcaaagccttccccttcctgctacttgacagaatttcctcatacagtagcaacttcttggaaagtgggagggaaggagaaagggagatactggaaagaaagccagagaatgacctgcagacaataccacgccctctgtctcctgtctccccttttccttccataaaccttggagttgctgacctctgcagtaattgttagagtcctattttatatatagtagagattaaaaactcaatccttatattttgtatttctatacatagaatttatttgatgttaataattgtttagtg

SEQ ID NO: 125599 - DNA, 409 bp, Homo sapiens
ttccagtgagccgagatcatgccactgcactccagcctgggtgacagagtaagactccatctcaaaaataaatatagatatattttctcttttcctttgtaattattttccctgtccaattaaaaggcatctagttaaaacagtaattacaaatttgtattgatggatataaaagtagaaagatacattttatatgacagtaacaggacaaagtagggggtgaggaaataatgtatgtaggagcttttatacagtattgaaattaagttggtattcgtaaaaactagattgttataagatgttcactgtcatccctaggttaagaattaagaaaatttatacacacacatgcatacatatacatacatgtgtgtatatgcatgaactgaataaggaagtaaaaatataa

SEQ ID NO: 125600 - DNA, 322 bp, Homo sapiens
accaggtctagaggactagtatcctttttaaagcctgatcaatatgaaggactctttatgtaatgccagggggtcaagtccaaattacatttccacatcaggagaactttcaaggctaatgcagatgccacaggcctctagggaggggttactgctgtgcttggtagatttatagtcacatgtctactgtcccaggaaaggaggaagggacacctcttgcattctgggagtgctctcggctgctcaccactaatcaggagtttcttcaagctgagagacttctggcttcattcttttcatcccaaacacaatttatttatat

SEQ ID NO: 125601 - DNA, 425 bp, Homo sapiens
tagccgggctgtggtggcacatgcctgtaatctcagctactcaagaggctgaggtgggagaatctcttgaacctgggagacggaggttgcagtgggccaagatcacgccactgcactccagcctgggagacagggggagaccttgtgtcaaaaacgaaacaaaacaacccccccgcacaaaacgtatccacaatctacatagaatttaaacaagacccagcaccttatcacataatatttaagatgtccagaatacaacccaaaattgctcagcatacaaagaatcaaaattgcaactcaccaagagaaaaagacaagcagtagacgcagagatgacataagtgctggaattgagtgcaaagaggttagggctgtgagtaaagcatttaaagcagcagaaagcaacatgcctcactgacaatacc

SEQ ID NO: 125602 - DNA, 142 bp, Homo sapiens
tagaaattttcaacctttgctataaaatgttaaggtcctcacaggtgggaagttaattgctatctgagaagattcttagggataaatcccagatagcagcagtcactagttacataacagttttttaagagtcactgctcat

SEQ ID NO: 125603 - DNA, 353 bp, Homo sapiens
ccaccacgcccggctaatttttttgtgtttttaggagagacggggtttcatcctgttagccgggatggtctcgatctcctgaccttgtgatccgcccgcctcggcctcccaaagtgctggaattacaggcgtgagccaccacgcctggccgaactcctgacttttaagtgatctgccagcctcaggctcccaaagtgctgggattacaggtgtgagacaccacgactggccatgatttcaattttatgagttttgacggggatctatatggaaattttttttagagtatttaagtactaaaaatctacagcctttcatagagtaatagtctggaaagtatgtgacatgagcat

SEQ ID NO: 125604 - DNA, 474 bp, Homo sapiens
gtggtatgagttgtaatgtctccattttcatttctgattttattgatttttgagtcttcccttttttgtctttgaaagtctcatggtttttcaatgttgtttatcttttcaaaaaatcaactcttagtttcattaatcttcccatattgtttatttagtctccatttatttttattccgacttttattattcctttcattactatgagtgtcatttgttctttttcgagttccttgagaagtaatgtttgtttaaggtctttctcctttcttaatgtaggtgtttattgctataaacttccctcttagaactgcttttcctgcgtttctcaagatttggtatgttgtttccttttgcatttatttcaaaatatttttaaattaaacttttaacttcttccttgacctactggtacttatcatgttgtttaatttccacatatttgtgaatttacctaaattcctcctgttattg

SEQ ID NO: 125605 - DNA, 557 bp, Homo sapiens
ccctgggctaggctacccatggcagccagccactcgggcccccaggcagccctggcttgtccatgccttcagtcctgctctgctctccctgtctgccactgtccaaaatgggaagcctgcccactctgcaaggctcacctccagtccagcctgtctcaccctctacacggggttgtgctttggtgtgcctgggtcagggtgaaccctgggttctaggggtgccgggaactgctctcctctgcaactggcccatccacaggcttcatccttcacttgggccttctgttcctgggccctttttagggtcaccttctttgagcctttggttaagatgatgaaacctctttcctaaagcaattgctttgacatacgtagatagttttgcataaattttaaggtgttcatagagcctaaaggccaaatataaaccaaaggtttttaaaaaagaaaaaaccgcggcctatacacagtggcttcccctacctaaacatgaacttgttgttaccaagccaccactgcatttataaccaaatggccatgtaaaaaacacgacagca

SEQ ID NO: 125606 - DNA, 246 bp, Homo sapiens
agtcctttcatagctttattttatcttaatctttgaaccatggtttgatttgtttgatagtaaatagtagggcagaggttaagcctcttgggccaggtgttctaacacaattggatgagtaactatcgtttcctaattctaattgtctcctttattgtaaaccaaattctcatatgcagtcagtctattccttggctctcttttcttgtacatttgtttaagttctttgtagattctggatattag

SEQ ID NO: 125607 - DNA, 255 bp, Homo sapiens
aaaaaataaagctgtgtctttagggagacccaataaagaatgcaatccatgccataagcaggagttgatacaccaccttattagctaaaaatatatataacacaatatgagtaatgtttaagatctgttttaaatttaaaacaatgaattgaatgctctaagaggctcctacaggcgctccaggccactctcagagactcccaggagttgttgaactatatttggagaaaacagccactgaatattatcatttct

SEQ ID NO: 125608 - DNA, 228 bp, Homo sapiens
cgttcagaggatccagtggaagatgtgccaggcaaaccctaagaaaccttatcctgactgatgaggaagaagattcagagaagattatatattttcaatatgagggacttgcccttatgttttgtttatgtagtggcaaagaatgggaacttaggagatatataagaaccagaacaagaatttaatcttttcattatcaaaaataagtaacagagcacttcttccaag

SEQ ID NO: 125609 - DNA, 368 bp, Homo sapiens
cctcccaaagtgctgggattacagacgtgagcctccgtacccggccccacacacttcttttgatgataggaatacatgggtgaacaaaacccatgcagtccctgttctcatggagcttagggtcgctgggggaggactgacattcaattagtaagtagcacaataaagactgaggagggatggtataggtttgcttatgcatagctaagtgtgttattcttcagtggttttccttcatctttgggataaaatctaagcttcatagcacgtacatatggctattctggaactgacgggagcctcttgatatacttacagatcctctccacgctcccgccccatgtctgcgcttcattggaatgccttgg

SEQ ID NO: 125610 - DNA, 371 bp, Homo sapiens
ggagacaaaattgctttatttggaaaggaatttggcagtagttactaacattactcataatctttaaaccaaaaattctacttaccctgaagaaatatccacccatataaacaaaaatgttcactgaaacagtgttggtaatagcaaaggactagaagcaatctaaaaacccatcaattacaacataatgtatagtacacctttactatcattaccatgcagcacttaacaaataacatggcaaatctctatacactgacatggaaatatctccaagccatactgttaagtgaaaaaacaaagcaaaacaaaaagaaccaacatcttggaatatttagtatgattcttttttttttttttttttttttttt

SEQ ID NO: 125611 - DNA, 377 bp, Homo sapiens
agtaagaccttgcctttaaaaaaaggaatgtgaaaacattattaatatttacttatcttagcaaggttttctatcctaatgcagaagtcaatattatgttagcctctcttcaattacaaaagaactattaaataagccaaaattttctgaaagtcaatctccacttagtagttttcttaaagaattgattaatggctgatataataaaccatttttcttttggctggaaaaatactgttaaaccattcaatttcataccaataaagcagtttttagacaaatgttataattgaactggataactattaatttgattcagacttgctaggatcagccaagcaaccagtatttgctagtctgttacaataaaggcttaa

SEQ ID NO: 125612 - DNA, 613 bp, Homo sapiens
gtgacaagcagctgggaaagtgtacattattcatcgttccgccttcctcactggaaggaacgtgggtgtaggataaataacattattcccagtgtctaggccaatttgggatgctttgcatattttattaatcccctgctattgagaaagataattcatttggactcatgagcactgaactatgaaaagccaagattttccttttgttggaaattttctggtatgtcaaagaaacaaagtaatagaactaaagacatcatatatccaggagggttggattcaggtctcaatttatttgaagaaagattagacaagtatcaactacagtattgttgtttttttcagcaaacgtttaaaaataagtgtgcccctttaggctgttggggttctttgggaatgctataatggttcaattcaggaaggagcaactaatgagaccctgtagttctccgcaccccaacccccgccccagttcccgaatatttgcaattagttaatcttccctacaggaaaccaaaagtttaatgattccttacaggtaattcggcatggggcatgagtgaaaaggtgagttgaaatgaagcacaaaatagaaaacagtggattcccagaa

SEQ ID NO: 125613 - DNA, 204 bp, Homo sapiens
ccattctggtaaggaaacgatggcagcaagaaccaaattaaaagtctttccatgaccattatcaatagtgctgtgtgaaaagctaacagggacttgggttacctcaaaaacaacacctaagtgggaggtagtaacatgccacagcctaactcacagccacaaccttctcatcctttgtacaaaatcagtctcttaaatacagct

SEQ ID NO: 125614 - DNA, 335 bp, Homo sapiens
ccctcctcccaaggttgtcttcctcttgtatttaccacacttgcttttgcctcctgagaggccccagggctcctacctgtgggcagggatgctgcctcgggccagcgcatagcagatgtgttccaagaacgaatgagtgaaaagccatttggggaaagcacatcatgtctccaatgcccttcccggaggaagtcaactgtggttctgcaaacacagcagcctgggtaaatgaacgctgtctgctggtttatcttttctatgactctggatttccacttattcattgacatcaaatgaagtattactgtgggatcttatgtaaggtcataaaaaga

SEQ ID NO: 125615 - DNA, 373 bp, Homo sapiens
tatgtttggagagttagaggggcttggcttaaatgggtggaggggatgactgtaggtgctgggcaatatttggggtgatgagagactgtagacggaagcgcagctgagcccctctgggagaggggaaccctctcctgcccctaacgtgctctccagggagcatggaaaatgagcaagactctactttgccatactctgtcttctccactggggaaaacaaaaatgggcagcagacctcagagtaactcccatgaagcctgtgacccctcagagatccaccactatgaatctctatgggattcccatgatgtcctatgggaggacatcagcggcctaacccagcctctcacccaaagcaggaaaccttctatgg

SEQ ID NO: 125616 - DNA, 470 bp, Homo sapiens
aggaattagaggctaattattctattaatgagtctccgaagcaatactggctggatcaaaagataagaaccccacaagttttcctaggttgtcaaaccaagattaatggcacagcagtcaggaggagctattgccagtgtagtgcaacatgacagcatattctcttttttgcaagtaaagcaattcactcggccatctctagagactttcaaaagcgggtagatctccacattttcaacactaatagcgttccatcctgtcaaccataagaagccacagctgtgagacatgaatttactgtagccgtccacatatccagttggttctaccacccaaattttacttgcaagtatctgtttgtttccatctctcatgatcataatgaccacatcctgggatctcacatggattactttcacctcttggtctcccttcttgccctcttcgagtccattctccaccagcagcca

SEQ ID NO: 125617 - DNA, 336 bp, Homo sapiens
tttgctgccgtccctgatgtgacatattaccaacaagaggactgattttagccatagtgatttgtataacttccctcctttgggtatggtcctctgtccccgtttcctggttacatgagtgacatccactcattttcaatagcaatctgagctgactttaaaaattcagctttgtcttaactagaacaactcagttaaaccaaaatggacatttatggctgggtgaggtggctcacgcctgtaatcccagcactttgggaggccgaggcgtgtggatcacttgaggtctggagttcaagaacagcctggccaacatggcgaaaccccatctctact

SEQ ID NO: 125618 - DNA, 412 bp, Homo sapiens
gtcttacccgtaatggcatgttgatttcctgtggtaggccagctgtggttggttggtggcggctccctagaccactggattgactggggttcagagtgcatgaggaagaagatctggcatgagggaatggtgacatgtgtctgggcatggaacaggggagtggcggataatgcttggggtctgccatcttggacagtttatcttacccgggtttgttggtttttggctactctcatgctgagctcagacaacttctagtggaggctctgacttaaagattggcctcagaggtagtcccttgccatcagctgttgacattgaaatcctcaactgtcactctctaaagtaaagcccccttttgttcctctcaccccagtgtggaggcctgtgcttgtttgccagggccagccat

SEQ ID NO: 125619 - DNA, 443 bp, Homo sapiens
gtcctgccttctaagctgtcagcagcacagaaatccttcagtaatacccccttatatctggttctgaacacagacactgtacaaagaaaatcaaggagatgccggttttatggcttataagagaaacctgttgttttggataagtaggaaaattgcacacatctaaccacatggaatcgcagaatttcagagctaacagatctttagagattagtctaatatcctcattctagaagagagggacttgaggcccaacagggttaagggtacaggtggggggcgcttgtttaaagtcacccagttaacccagttagttatagcactgtgaggactagcaaagagaactcgtgaccttggttcagggcctttttcacttcaccattgctgagcattgtaccaaagcaaaactcactgtcaaaaatcaaggataccacagtcgtccc

SEQ ID NO: 125620 - DNA, 195 bp, Homo sapiens
ccacctgtctacttaacatctatctgtccatctaccgatgatatatctatttacctacctaacatctatctatcatctgttcgtctacgtcttatctatatatctatctctccatcatccatctacctgtcatcagtctagtccaaggaaactcttttccctattctgctccaaacctattggcttacttctgca

SEQ ID NO: 125621 - DNA, 509 bp, Homo sapiens
ctcccagctcagcctcctgagtagccaggtctgtaggcacatttcgccgttccctgctaatttttatacttttggtagagatgaagtttcaccatgttgcccaggctggtctcgaactcttgacttcaagcaatccacctgccttggcctcccaaagtgttgggattataggcgtgagccactgtgcctggcctgaagtccttttcttagcataagtgactttcctctgctgcagatgaaaaaaataatgtttttcttccatctcttctattcctttgctctaaaggcaaagagagaagaagatgccaagagcaaaacctgcactaaagacgtctgttttctctttctagcctgggacttggaggtagtaagaaaccagcctgtgttttttccccttctggtttgtagcatctctgagaagtggacagaaagtcagcattccttatttgttgaactggctgctagaataaaggatatggggcaccatggggtcagtggaacttgcctac

SEQ ID NO: 125622 - DNA, 529 bp, Homo sapiens
aggggagaaagtcacttccagggaaagctgtcagtaaggggaaaagagtacatagaaagcctggcatgagccacagatcaggggctgctcatagctcctaaattgggactggagtgaccatgaggggagtagggtgcctcatcaacacttcccctccccacctgcccccatcaatgccctctatgcaggaatcatcactgaggggaaacttcctttcctctccagacactactccacactcaaacaaaacacctaggacaaatgcaccatcctagacccactttccccttccacacagagtcaggagacctacaacctgaccctctctgtgctcccagcctgggtgctgactctccccagggaagccagaatggagggattcagagccctcccaggctcaagagcctgtgactccctgccagtcccacccctgcaaaaccccagtgccagctaatggattcccatacatccctcagaggctagctacaggctaaagtgtgtgttccccacaagacagaggtcagagcaa

SEQ ID NO: 125623 - DNA, 653 bp, Homo sapiens
acctcgtgagggggcggagcctcaggggcggagtcttagtgtccagaggggagtcagggcagctggaggtccagggcgggaaccattgaggctgggaccctacgagaaccccctaccccgtgcccttcggcctctcttggtcttccaaggtgcccccgtggcgcgcgggctcagttctccatgatttcttggatccagtcaaggtagtggcatacgctggtgtagactgcggggcgccggggtctggagcagggctcagcacccccagacaccacgcctgccaaggttccattgcaaaccagggggcccccagagtcaccctgtacgcgagagaagggcagaggaactgttaggccactctgttcatgacaattacacgggccacttcctccctcccagaaaggccccagccccttcctcctccaacatccgagagtcctccatctccagcctcttcttcctcagacccaggagtaaaagctcagagggcccacctccccgcaggacctaacctcctcctccccgaggactcagactctggacgcccagcccactcctcctgtagatccagaagtctggacctccagaccttttctcttttacactaaggagtccaggccctggtcccgtcctctcccaggaaccaggtatcc

SEQ ID NO: 125624 - DNA, 390 bp, Homo sapiens
atcaaatttgagcatatattggaatttgtttcaacaatcctattaaaacacagattgctcagccttactctcagagttttgaatctatcaggtttgggtcagggccagagaatctgcatttcatccttttttctttttttttcagacaaggtctcactctgccgcctccttttgagtcccgcttgcacgcttcctagctctactgcatgccccgtacattcctagaactgtctctgtctttgacaaccctctctgattcccctgcctcaacctcccaaagtgctggaatttcaggcgggagccaccctgccagccaaatctgcatttcaaacaggttccctggtgatgcccatgcttctggtgaggtggaggagcacacattgggaatag

SEQ ID NO: 125625 - DNA, 514 bp, Homo sapiens
gcaccagctgcaaagtgagaagacatggagggcaagtgaaaatgggatcagaccacaaagcagcatttactgcaacaaccacatgctttcttgtctatctcttttcacttacacattaggtaaaccaaacttcctttacattttgtggtatcagctagctttttggtgttaatcataataatctccaaggcaacaaataaatctggggctctatgaattcacaacatttcccacaatttaagaacattctctttttagagacaagatagatacaggcaaacacaaataggaattagcatgggaaagatggcccaagataaatcatatgtggtaataacacaatttcaagaacgattatgtaagaaagaacgtgactgaaatatgactaaacctatagtgtgtaaaaaacagagtatctaaaaatctttaaatttaaatattattttcattgcttttttttttttgagatggagtctcgctctgttgcccaggctggaatgcagtggtgcgatct

SEQ ID NO: 125626 - DNA, 280 bp, Homo sapiens
catattccaacatgggcagtgattaaccaggacacatacaaaccaactgttttatctagcttgcatgcatcccaagctacaagttggtgcattcctcagactaccagcctcttctccataaacgcaggtgaaaactaggggctctttttccctcagctattcaatccaacatgaatagctgcaatttgcaaattagaggaaaatgacagtgttttctctgaatggttttactccccagccataacgctaacgctaacattgggttactttctcctcagct

SEQ ID NO: 125627 - DNA, 617 bp, Homo sapiens
gaaattttataatgataaaagggtcaattcaacaggaatatataacaattacaattatatatgcatccaacagtagaacacctaaatatataaagcaaacattggaaaaacagaaaagagaaatagggagcaataaaataatagtaggaaacttcaatactatttgcaataatggatacatcattcagacagaaatctgtatccataagaaaacagcagacttgaataacacaatagaccaaatggaccaaacagacatatgcagaatattccaccaaacagcagctgaatacatactcttctcatgtgcactcagatccttccccaggataagtcacatattaagtcacaaaataagttataacaaatttagaaagattgaaatcacaccaagtgtctttctggccacaacaaaattaaactataaatcaataacagaaggaagactggaaaaataaaaaatacatagatattaaacaacagactcttgaaaagtcattgagtgaaagaaggaatcaagaaggaatttaaagtgccttaatacaaatgaaaacaaaaataaaaaacactaaaattatggtattcagcaaaagcactattaagaaggaggtttactg

SEQ ID NO: 125628 - DNA, 580 bp, Homo sapiens
gtcacagtttggcagtgagagggggtggcctgtcgggttaactcagaggtcacaagtcacagtttggcagtgagagggggtggcctgtcgggctaactcagaggtcacaagtcacagtttggcagtgagagggggtggcctgtcgggctaactcagaggtcacaagtcacaatttggcactgagagagggtggggttttaaaaatatgtccaggatagttagaagggcaaggtgttgaagagatgttgatcaaaggaattttttttttttttttttttgagacagagtctcgctctgtcacccaggctggagtgcaatggtgcgatcttggctcactacaacctccacctcccaggttcaagcaattctctgcctcaacctctcaagtagctgcgattacaggtacccactaccacgcctggctaatttttttatttttagtagagatggggtttcaccatcttggccaggatggtctcgaactcctgacctcatgatccacccacctcggcctcccaaagtgttcggattacaggtgtgagccaccgtgcccggccgatactcctcctttcaagaggta

SEQ ID NO: 125629 - DNA, 542 bp, Homo sapiens
ggatcccgtctgagcaagctgggaggtaaggtaggttagagacacttcagagatggagatgagcaggtgtgagtcacgttttcaggggaacatgtaaactggtttggtcagagggtttgctggatgacgtttaagacatttttaacctcaagattctgtgaccaagggatgtgagtacaagaaaggagaaagaaaatttagagggagaattgggaatatttatatgtgctagaaactctgttagtttaatcttatgaggttgactatggcatggtagatctgaaatgtacaaatttaggtcatgtgtgtgtctgtgtttggcctgagactctgccagtggatggagaggactgttaggtctgtttgcttgctcagcccctctgctggccttttcttctccctccaacctttcctttccgaggtgatctcgtctcctcccatactccagggctcacctctgagctcatgggtcccagaatctcaaggtcccactcccagctccttacctggcactgacccatccataccatagcttgttacac

SEQ ID NO: 125630 - DNA, 705 bp, Homo sapiens
gcaagtctgcccctgcaaataccacctgctccccaacccacagcagggagcaggcgaggtcagacagcagcagcccgggaaggaccgagccccagcagggaaggcagggcccgagtgaggtctccacacccaacgcacagtgctgtctctaactggggccacctccgagtccccgccacactcttggccctttggagtcctgggctccaggtgtctcccaagggcccatctgtgcaggggatgcaaccccccgaatgtcctcatcccactgtggagctcaggtctctgtctgctccctgggtcctggcagggtaggacaagtccgccaggatgtccccatgcagactctgctccaagagggagctggagagtcagggccttggtgagggagtcaggatcgggttccccccagctcagtcctcccacctgccagcccccagagcacagggcagggccacagcccctgcttccccctccaggagagtcaggacatgctggccgctgctccactggggccccgccctccagcccccaccttggtctgtgtgctgcatgcccacgctcgctctgccagcccaggactctgaggaaaagacctcagagtcccagccctgcccagcctcggcctgtgccacccgctgcatcaggcttacaaggaggcccagcccatgccctgggcagtgcccgagcccccctgcacttgct

SEQ ID NO: 125631 - DNA, 839 bp, Homo sapiens
agctaattgttttattttttgtagagacagaatctctctatattgtccaggctggtctcaaactcctggcctcctgctttggcctcccaaagtcctgggattacaggtgtgaatcactccacctagttggaatgatgtttagaatcatgttatgaatctccgtctgccaaaaaaatcctagcttcccaaccagggaattccacctgagctttgtgtccagagttttttgttgttgttgttgtttgtttgtttgagacggagtctcgttctgtcccaggctggagtgcagtggtgcgatctcggctcacagcaacctccacctcctgggttcaagcgatcctcctgcctcagccttccgagtagctgggattacaggtgcgcaccaccatgcccaactaattttcgtatttttagtagagaaggggtttcaccatgttagtcaggagtccaacaccagcctggcaacatggtgaaaagcccgtctctattaaaaataccaaaaattagctgggcgtggtggcaggcacctgtaatcccagatactcgggaggctgaggcaagagagtcgcttgagcctgggaggcagaaggtgcagtgagctgagatcgtgccatgtactccagcctgggcacagagaaggagtggaagactcatgtctctcacgaaacacagaaaaaggaacacacgacaaccggtgttgcgggccacgagggcccgaaaagggattgtaaaaacggacagcgtgaggaacggcagacccagaacggcaaggcgacgctggacaaacgggtcgccacaagagacccggcgcaaacacaagggagggaccgcccagatac

SEQ ID NO: 125632 - DNA, 339 bp, Homo sapiens
tcctggatagagagggcatgcttttcttggggcttttcttttctgggtctcctccattggcgtttttgcgttgctggtgtctccagtatccagtctgaaatacatgagacaaaaagaaaacccaaagtattgatcatcattttgttccttggatcctgagctcccttgtcagactgccaccttctctccttcttctgaaaacagttttgcaggaacatataatttaatttacaaaagttatattatgcataacctaagaagagttgacactgtagttgctcactaattacttgttgaattgaaatcaaaaataggtgcgtatttcttgagatatttgta

SEQ ID NO: 125633 - DNA, 444 bp, Homo sapiens
taaatggcaaatggaagggaatgggttctggaaggccccaggtgggctggggtgggttctggagaccatcttccaactcctgttcaggaggagggttggtcagatcagctctgtggccacctgggctctggaggggcgagatacgggcaggtgcggccacaggagggagagcaccatgtgcgggggaagcccacagctggaaccaaaaggccccaggagggatcctggctctgacatctcccagccgtgtggccttgggcaaggtccctgacttggacctcagcctcctcatctgtaaaacaggcagaacagtaataccgaccttgtaggttgtatagagttcatatacatcaagcacttaccacagtgcctggcggaccgcatgccctaaacacacaatccgtgaaatgaatccatcagcaagcagctgctaggggcagtgtg

SEQ ID NO: 125634 - DNA, 673 bp, Homo sapiens
tgagttcaaggtgactttgagaagcatgtggggttataagtaggaatatctgagacaaagtagatagccaggtttagaggttggaagacagttatgggctggagatagagttgggcaggaaatgtctcccctatgagccttaggttccttatctgcaaaatggggatgtaatctacttcccagagttagtgtgatgattagattatgtaacattgatggcagtggtggcctgtctagagtggccactgccatgatgcaggctgcagtgggggaggtgctccacagaaccagcaggagccgggaacaggcagaagccctgccgtcttctgagttgacagggtggaagcttcatgctccttgggcgcagctgcagctgcccaagccagggctgcagacccaggcatctctgcactcttgggggcccaggaaggcccccctgcccctgcaggctcagaaatgcctgcttccactgcctggcctttccctgctcctggcacctgcttcgatttcagagcaaagttgaggctgatcccaggcactgtcgcaacccagctgggtgtgtgcatgcttggggcagcactgacacaccagccccctgccaccttggcccacttcagactttgggcacaaactaacatggaagggagaccaaggaagggctgagggcagctca

SEQ ID NO: 125635 - DNA, 219 bp, Homo sapiens
gaagctgcttataagcatgaaattcaaacacttgtgctcaagtgaccttttcacacagtaaatacagatggaaggatatgtaagagcaagtacatgactttgccttagaccttttttttaactcatcatgtctgtcaccaaacatgacaaatatttacccttccaactgtatggtggactggttctaattaaaaagaaaaataatctttggaaacctgt

SEQ ID NO: 125636 - DNA, 765 bp, Homo sapiens
tccgatctgcactgttttcacgctgacagtagattagcattttccactttcatgtaatcagctagcacctgatccacacagctcatatcctctccttttttcaaattcaacctcacagaagcaccaagtgaaatcatcaatacctcatttttccatttccacttcctcagtctgtcaactctagccatttcctagctctcttatctgtgagtcccttttcttattttttaatcttcataactcagcccatataactcctctaggaaaaaattataaaacataaaaactttcagactccgaaattaacacggcaatgcataattttctaagcacattaagtttctaacaataataaataattacatcattaaatagcataaaatactaaagtttgagtgataaacattgtaattcttttgctagtgtcttgtttgccttatgataaataactgactttgacttttaaataggtcagtgtgagctgagtttttatttgacaggttgataagttagtgttttctgtgtaaaatgtgagtttcaaatgtcaattttccatgcatatacataaaatgttaatgcatatataatgtgaagtattttaaagtacttgagatttatctaaaacctatagtatactaatttatttattcatttatttatttatttatttttgagacagagtctcactctgttgcccaggctgttttaagtcggacaactaatcttttttggtttagagttcctctttggatatatctaagaata

SEQ ID NO: 125637 - DNA, 252 bp, Homo sapiens
gagcaccagtgggggtctagatgagcgcagcggcagtgtggatggagcatgagagctttagaggtgggtgtgagaggtgctggcacccaatgggtctcttggccagggctcaggctcgttatattaattattaaagccaatgtgtactttggcctgggtgtagagagagagtgcataggtatttgtgtcatagcacggccacttgggatcaatcactggcaactgaacaatgaatgatttggggtcagagct

SEQ ID NO: 125638 - DNA, 405 bp, Homo sapiens
gtctgagatgatttgctttgataagactttaattttaccaaaactgggatttgctctagtttgccttggatcatcatagtcaagtgcatatctcaccgccaagaacttcacacatttggagtgactacggtggagccatgtgccctagaaatggtcaaactggtttgtgcttagagctgtgggaaaaaatgcattcattcatccattcaacagatattaatgagcatttactatgttccaagcactgttctaggacctgggaatgtggcagtgaactaaacaagaaaaaaaatctctgtccttgtgaattctaaaggaaagagacaggcaaacataaaaataagaaaattatacagtatgttaagaggcaattaactatggaaaacataaattagggtataagga

SEQ ID NO: 125639 - DNA, 120 bp, Homo sapiens
ccagaccaggatttggaagatcactctggtagcagctcaaagcaccttaaggagcctgcccttttcagccaggtgcagtggcccacacctgtaacctcaacacctgggagaccgaggtgg

SEQ ID NO: 125640 - DNA, 324 bp, Homo sapiens
gggaggtaaagtctgcagtgagctgtgattataccactgcactcctgcctgggtgacagagtgaagccgtgtctcaaaaaaaatgctttggaggtccaggaaaggggaccttggaactgtggtgctgtatcctgcaagactctcctgaaaactttagagaagtgtttgtctcccataattgatttctgtgcaacagccatgggttgagaccaatttaagaaaatcttaagtgtggccgggcgcggtggctcacgcctgtaatcccagcattttgggaggccgaggcggtggatcacgaggtcaggagatcgagagcatcctggc

SEQ ID NO: 125641 - DNA, 285 bp, Homo sapiens
gatggaaataaaaaacacacctaagctttctacgtagctgggaggatcttagttcatttatttcccttttcagtgtttttttccctagtaggtagtaaggattatggatgtgcaatccaccagctataaacaattagaggatgtaacaatttttgtggagggtattgcttttatcctccttgctgcaagatattttattaggcttttcatttataaacataagaaattttgctttcctaatatttagtatacggattgaatattaagttgtttttaggctttaag

SEQ ID NO: 125642 - DNA, 732 bp, Homo sapiens
gtacaagcaataaaagaataaataaaacagacttcaaaatttaaacgttttgtgccaccaatgataccaataagaaagtaaaaaagtaacctacagaatggaagaaaagttttgtaaattgtatatctgatgaagaacttataactagaatatatagataactcttataactcaataaaaagataaacaacccaattaaaaatgggcaaagatttgaatagacatgtctccaaagaatatacaaaaattgacaataagtatataaaaagatactcaacatcattagtcttcagggaaatgcaaatcaaaactataatgagatatcattttgcacacacaaggatggctgtaataaaaaggatgataacaagtgttggtgaggatatgaaaaaactggagccctcatacattgctggcaggaatgaaaaatggtgcagcctctttggaaaacagtttggcagtttctccgactgttaaacttagagctaccatatgactcaacaatttcacttctaggatattcccaagagaaatgcatgtctacacaaaaacttgtacatgaatagtcatgacaccattattcattacagccaaaaagtggaaaaaaactcaaatgtccatcagctgatgaatggataaacaaatgtggcatactcataaaatagactattatttggccataaaaagacgggagttgtgatacatactataccacaggaaaaccttgaaaac

SEQ ID NO: 125643 - DNA, 385 bp, Homo sapiens
ccctttccttctatttattcataatttcttctctttattcatagttacactgactgtcactctggtcatttcttgtgtctaaaaccctactaattatagccatatgttttgtacaaagttcaaattatagctgctgctaaactaacctttaagtgtacttatgttagcaaacccagtttgtggagaggcattagtttccttgccataattacgtgatgtgatttcttaaaggtcatctggttcatggtaatttgaaggaccatgcatatctcaaagcaaaaccgtaatggaaaggaaagatgaagtgttaaatgccccacttttttccccaagttatgctggaaatcattctccacttttacaaaactctttatcttaatgctta

SEQ ID NO: 125644 - DNA, 760 bp, Homo sapiens
ggggatggaacccatgtgctaaacataaaattcatttatgttttatatacaccttatatacatagcccaaaggtaattttgtacaatattttaagtaatttgtacatgaaataaagttttggctgcaacccgatgcatgaggtcagttgtggaatttacttgtggcatcatgttgatgctcagagtttcagagtttggagaattttagatgtcagatttttggattggggtgctccaaactatgtattctgatcacatgccttggcttcctttactgaagcatcattttcctctatacacagcattcctgaagaattcatcagttctgactgatgtctttctgcctttttgccagagggcttaagatagcagacattgtaggccataaggtaatagatttacctcctttagtagcgataccatcactatgcttaaagttgggacaggggaaatccaagccatgggagaccgatagcaaatagaaggggaagaagtagtgaagtgtacatttatttgatcctgcatgtatattattttttggtgagaggattttcataggaaatgatattaatgttttagagattatctttaccagccatttgttttactgagggccacaatgaataagtgacttaaggtcacatagccagttaacagtagagccaggatcatataaagaattcctaacttcacatcaaatattattcttactattagaggttttttattaaaaaatttaccataagtgatagatccccct

SEQ ID NO: 125645 - DNA, 257 bp, Homo sapiens
tgactggtcatggttgtccttgaccaccagaatcaggattttagagtgacatgatcagagggagcagtgtttagtatgggttggagaaaggagactctgggaattgagaaacctgttaggccttgcaggatctcagagttggggtaaagagggcctggacttgggtactggggttaggagcggagaggaggggtaggatttggagaagtagtacaacctggattaaatgtggaccttgcaggcaggtggtagagggg

SEQ ID NO: 125646 - DNA, 560 bp, Homo sapiens
gttggaagagatcgttagtattactagtatattaatgttttgcccattgatgttttctgggttcatccactgactttttctttaacttcacagatgatttggatttccctatagcaagtggcaaagccacaacacttctgaattagttatcacacttaaaaagtcaagatgacaacaaccatagtggatctatttattgaagcagacaggctcttttagcggaatgatcaatgtcttacctctttctgaaaggcttttcagaggtaggaaatcatcaagcatctgatataaagtaatgaacaaggcttttgattggtcaagtttctggagcaggcttttaagtatttctgcctgtaaatgtagaaatctgagtgtgaaaagtaaaggcaacagcaaagatttactgggtgcatctatcaccctggcttttagagtctttgtgattaatacctgtttaattggggactgatctagatgctttggacgtcagaaagctaaatgttacagcattgtctcatgggttcctaacacagcaggacgattagcagctgtctgagtaa

SEQ ID NO: 125647 - DNA, 834 bp, Homo sapiens
caggggcagcctgtcccctgggatagtcacccactaaggcatggagttaaagcaagtgtgctttgcccaacttgactgtatgatttggagtgctttgagattcatgtagtcttggtctgattttcacacagttacagaacaggtatgtagaagcaaatcttcatgtgctaaaatttgcctaagaggaattcaaagctggagacaagtagtttttattcatgaagatgttcattgggctttatctataacaacaaaaattgaaataattgaaatatccaaaaataggataatgtttacaaaagttatattaccctaatggaatgaaatattatgcaatcattatgtgcaagttgtacagaaaacaatttggcaaagtttcagaaatttagaaagttcctattctccaagccaaaaataccacttatgaggattataccaaggaaacagtgtgatgtaaagaaaaattatgcacaaaaaatattaattttagagttatttataagagtgaaaaataggagaaaactaaattttcaataatggggtatggttaaataaaattatgatatagctatgtaacattgttaagttattaaaattagatgtgcagaggatttttagtggttttttaatgatacataatagttttatatattttgggggtacgtgtgatattttgatatattccaaaatgtggaatgatcaaataagggtaatgggatattatcatctcaaacaatctttttaatgttggggacattctaattcttctagctattttgagcaacacaaaaaactactaactacaccctactgtatattgaacactagatctta

SEQ ID NO: 125648 - DNA, 479 bp, Homo sapiens
gaatttgcactttgaaattgcaaatgttcctaagacacaattggaggtagaggtaatgcctgcaaaaggttagtgaatgctcataagtagaaaacatttattactaaagcaaattattactaaacattttaatatgctttgatcactttttaaggatacagaaaaggtaattgagatagtaaagataaggtgtttgagcagaagagcaagcatgcactggatagttctacttagagtgtgatcacggttaacagtcatttctgtagcattcagagtacctgaactcattataaaatgtgttacaatagcaaagatctcagaagacataataggtcataccttactttctgaaatccacacgcctgcacagacatgagcagaatgtcattgacatgtactagggaagctcagtatttataggaactttatttataggaacttctttcagtaaattttctccattaggtgaaaaaattttt

SEQ ID NO: 125649 - DNA, 428 bp, Homo sapiens
ccttttaaagtctcacactactaggagagtcaatttccaaaatagtttcttaaaattgttatcattaaacttgaaagaaacagtttcaagtttaatgggtaaggaagatgtgaagagtccaaaagcccaaagctgtgactagacagctgcgtgtcacttccatctacaaggcagatagaagcatcagctcagcagctcagcagattacaagcaagatttacaaactgcatatggattccaaagcaaatacactttccctcaatattgcttcatggaagctagagtttaccagaaatagacgaaactccaaaaaaataactgatgaaattcagtgtggccttggcattccacacggatgctccctggaaacacaaaatttcactgaaactatttttcttttctttttttttttttttttttgagacaga

SEQ ID NO: 125650 - DNA, 376 bp, Homo sapiens
  misc_feature (113)..(113): n is a, c, g, or t
agttgtataatattgtgaatggtacctcaaaggtcactgaattgcacacttccaaaaataactttatcttatgtgaattttacctcaataaaaagtaataacaataactatcngggaacaagaattgataattatcaataattatcaactgtagaattcctctcacaagaaaagtccaggaaaagtccaggaattttagtcagtcatcactgaggtcatagaattccctagagatctggccatctgtgaccctccccccaacaccaccaccctgtaccgtttgaagccagctggatttaatgtaccacttaaagattctatttttaaaaacaacttctaacagcaattttttggcacaaataaatagccataatgg

SEQ ID NO: 125651 - DNA, 153 bp, Homo sapiens
ctctgagcctataattattgtagaatgaaaaggtttttaaaaagtcatttgaaaataatgattttgaactgttaggaggctgtgcaactcaatcaatagagcagtgtacacaccacacttatagagctaatttttatttagcttaccttaaaa

SEQ ID NO: 125652 - DNA, 474 bp, Homo sapiens
cacctataatcccagcactttgggaaggaggcagggggaatcacttgaggtcaggagttggagaccagcctggccaacatggtgaaaccttgtctctactaaaaatacaaaaaattagctgggaggcagacattgcagtgagccaagatcacaccactgcactccagcctaggtgacagagcaagtctcaaaaataaataaataaataataaataaaggtgacattgggaatgtgacttgctatgcatgatttccccttcctcacctaaaagtaaacactctggctgggcgcagtggctcacgcctgtaatcccagcactttgggaggccgaggcgggcagatcacaaggtcaggagttcgagaccagcctgaccaacgtggtgaaacctcatctctactaaaaacacaaaaattagctggccgtggtggcaggcacctgtaatcccagctactcaggaggctgaggcaggaga

SEQ ID NO: 125653 - DNA, 483 bp, Homo sapiens
cttatttaaaagataaatttagctagtatacacaatagtggccaattagattgtatgctataatacttgtaagaaaaatgattgcatactctttgttttcttgtttgagacagagcctcactctgttgcccaggctagagtgcagtggcacaatcttggctcactgcaacctccacctcccggtttcaagctcttctcgtgcctcagtctcccaagtagctgggactacaggcacacaccaccacacccagctaacttttgtatttttagtagagacagggttttgccattttggccagactagtctcgaactcccgacctcaggtgatccacccgcctcagcctcgcaaagtgctgggattacaggcatgagccaccacacccagccaattgcatactctgaatcaaaaaaccatttccctcaagttagaatatgcaatatttattgtacattgagtgccctctggtgcttacccaaagctt

SEQ ID NO: 125654 - DNA, 316 bp, Homo sapiens
gaaagacttgcccccatgtttcaattatctcccaccgggtccctcccacaacatctgggaattatgggagatacaagatgagatttgggtggggacacagagccaaactatatcagtgcccaaaggaaatgctcaccggagctctgttgtccagtgaactagaaccacagggaggatggcctgaaggaagctggagagaagggctctctgatgggacatggaaccataaaaagattcaactactgccagcgaaaataaaggaagtagagagagatggaaaaaacttcccaacatagatccaactcccacccactgg

SEQ ID NO: 125655 - DNA, 144 bp, Homo sapiens
cctctgcacccaccccaggaaaccttgttcctacccctcagaggagctggatcctgtacgggttctctggagactctcctgtcccagctctttgtctcatcacaacctgggagggtagcgtccccaggggtgggtggagagcgg

SEQ ID NO: 125656 - DNA, 518 bp, Homo sapiens
gtatttttagtagagatgggaattcaccgtgttggtcaggttggtcttgaactcctgacctcaagtaatccgcccacctcggcctccgaaagtgctgagataacaggcttgagccactgcaaccggccgtgaaacattttaaaaggagttgtacatctatatcttttttgtaggtgaagtttggaaagtaacacgatgtacaatttcatgattaaagaacataaaaagcactaaaaacctgtgttagcatttaactcaaatatagcagcataaaaaatatagcagcataatgttaatgaaactgttcaaatgcagacatagtatttggctgttgtttttcatttagtgaggattgctttgaattgcttcctgaagtcttccttgcaaccttctacattcatttgtaagaaaaatggctggaaaacagtgcatctgtgactatggaacagagtaggccagagtttcatttcatcattaacattgcagcaacaaatttggtcagctctgtaggaatatag

SEQ ID NO: 125657 - DNA, 340 bp, Homo sapiens
ccagcctctgccttcttattcataacttagggatgcagaaagaccttatcttattcccctactgtcctgtcccgaccattttccttcttctggtaaaatttaaattcctctctgcccagcatcttctcctttcctagaagcagtgatcttaaccatctttcttcctgaagccatgcttgcgtagatcctggtcatatatgagcttacaggtcatgaaagccatcactgaggttacaagccaacaattttaaggggttacacactcatttctacctcaagccttgatattgggcatttgccaaaatgcgagtggtctcctaataacaggtcactgattcgc

SEQ ID NO: 125658 - DNA, 491 bp, Homo sapiens
gtgcaagtcggcgggggagggaagcacggggcgacctgagactctgtgaagtccgagcttcgtcgcaaaacacgcagttcagtctttaaaaatcagcaaacaccgtttccaagcacagtaatgacgtgatcgactgcgaataaagacctgggaacagcctgcccagcaaatggtaacactcggcagaaagtggggccgtcacgaacgctggacaggagggttcaagttaaaaacagtctagaaggtctgaaaggacagggagggcatctcatggtgcccaccgaacggtcattaccgaccgcctggcaccccacagccaagctgcctgcgatgaggaccacggcagacaaaggacagtcggctggggggcggcacggggcccacccactgcaacagggtacacgcacgcgtgtgagtgtggggtgatgatccacggggcccacccacagggcacacacacgtgtgtatgtatgtgcatgtgtttgagtgtg

SEQ ID NO: 125659 - DNA, 223 bp, Homo sapiens
ggaggcagaggttgcagtgagctgagatcacaccactgcactccagcctgggcaacagagtgagactgtctcaaaaaataaataaatacaactacttaatgacataaaatgtaaccaaaatatattaagttataaaatgtattcataatgttacaaaatgatcgaattttgtgaaaacccaaactatgtgaaaaaaatggaaagtaaatacaccagataattt

SEQ ID NO: 125660 - DNA, 301 bp, Homo sapiens
aagtgtctctctgtgtgtttgcaacttgcacccaaatgactgacagatggtaaattattttaaaacccttttttctctttttgcatatatccttcacctgcggcttgctgtattgccagggtaccaggcctggatcagggatgtcaggtttgagaactggaacctgttcaaggggagctatttgtaccgagggagaggggcacagcagagaagaggatggagttgggcatccagatgtttgctgaaagtttccaactggaaatacagtggactacagtggtgagggatttatgctatgctt

SEQ ID NO: 125661 - DNA, 758 bp, Homo sapiens
gtgcttttaaatcagcattccccaacatggtctaatagtttctcaagatgatccatgaaaataaagtgtttttttcattagtttgggaaatgatgtatgggatagctcttcaacccactctcaaatagatacaacgtatgttagcatattaaggttcgtgatcaggccgggctcggtggcttatgcccataatcccagcactttgggaggccaaggtggacagatcacttgaggccaggagttcgagaccagcctgggcaacatggtgaaaccccatctctattaaaaatacaaaattagccaggcgtggtggtacgcacctgtagtcccagctactcggaggctgaggcaggagaatcacctgaacccgggaggtagaagttacagtgagccacgattgggccactgcactccagcctggggcaacagagtgagagtccatctcgaaaaaaaaaaaaaaacaaaaaaaaaaaaatttgggggcgcgcctttgggagctcggggaaaagtttttctaacacatcatcttgcgttggggcgcgcggcgccccagtgtgttaggtcacacactgggccaagaagcggtctcccacagggaagaaccgggcgcgaggacaaagggggtcggttgtccccaccaaataaaaaaagcggcggcgggaccacgcagggtttcggaaccaactccgaggggctcggaggcacacgggcgtctccacaggggtcaaggaacgtattcgcgcgcctgggggtgggct

SEQ ID NO: 125662 - DNA, 351 bp, Homo sapiens
ataaaggttgttttgctgaggatgggtgacgttgggcgcgggacccaaatgagtggtttgagcagaaagtcgcctccacgctggactaatgcttggcaacattatgggaaaatttctgagcccagaagtttatcatctattcacagttcagagggatccaggggtcagatacgatgcttcagttcttttttaaaaatatatagtacacaatctttatcaacaagagaagacaagggacatggaggacaaactgtgcactctacataaagtatacatgtaatgagaaaagtcactgtccactgtttaaggtccagggaagaaaacaactaggaaaagagaaacttcaaaaac

SEQ ID NO: 125663 - DNA, 425 bp, Homo sapiens
gggatgtgagtgaacagaacatcaaacaacactccctctgctgcatttacatttcagtggtccctgacttcagttcatccacacgctgtcaaatgccagtcaactatttggagcattgcagagataggaattttcctaggagatctaaaggttgtgtgaattatttttgtattaatgaaaaaaccaaggtttgataaggtgtgaggtgcaagacagcaagcctgcagaggggaggggctggcacggccagcttctgaggaggcctgtcccggctgccccagggagggtgaggtcacgccttgtgggcaaacatgcaggccctccgtgggctgaaggctgtgtgtgcagcaggctgagggcctgcttgatgaacgcatcctcacacacacctcacacagaccaagacatacatccgtgggtggttt

SEQ ID NO: 125664 - DNA, 299 bp, Homo sapiens
acagccccgtacacaaggagagcatgatccagcacccggcgccaggtctgctctgacggcacggccagaacagcgggtcccgcacgttcccgctcatggaaatccagcgcccagcgccacatctctgactgcagggccaggacggtgggtcccgcacgttcccgctcatgtggaaaggctacaccacttagtagaagagggttttatcacagaagctagtgctaaggggactgcagcgtgaccgccatccctcatcttgtttgctcactgtgtgcgccagcacagaccctgccgacccg

SEQ ID NO: 125665 - DNA, 105 bp, Homo sapiens
gttgaaagtattgcataaactgtttttcagttagcttattatcttggaaggcatacatgaataggagaattaaaatgacattttgactttgacattgtttcctag

SEQ ID NO: 125666 - DNA, 369 bp, Homo sapiens
acctctcttttaaatgctttggctattttaacttctgatacgtagaatcaaagaatattagcattagagacctttgagggcatgcaattcagggatatggaatacgtttcagttgtgcaccattacccatccagtgacgctggtcgctgtgttgaaaaggcttcctaggctgaatctgggctcaatcagtgagaaacagtatataccatacccagtgcagcctagtgtcctcatagctgtcaatcatcattcaccatatgtttgagaacctctgtgtgccaggcacttctctaggtgctgaggatatggcagtgaataagacagagtgagcctgccttaccagaatttatgagtcagaggagcagggtt

SEQ ID NO: 125667 - DNA, 434 bp, Homo sapiens
ggtgtgagccaccgcccagcctgtcttttcattctttgaacaatatactcataaagcagaagttttttattttaatgaagtccatttttattattctgctgtggtttgtaagaactcattgactaactcaaggtcacaaaaattttctcctttatttttttctagacattttatagcttcaggttttatactgaggtctatgatttatttgggattaattcgacaaatgtaaatttgtcgaaaagactatttttctttactaaattgcttttgcacctttatcaccaatcagttgtctgtatattcatgggattatttctaaactctctattttattccactgattgttgtatttttgtatttgcgtatttatacaccaccaccacattattttgaatactgtagttttataataaatcttaaaatcatgcagt

SEQ ID NO: 125668 - DNA, 173 bp, Homo sapiens
tggaaaaatctcaagcacaaaagtagataaaaataatatgatgaactttcctcagcccagattctagaattatcaagtttgccctcttgcttcactcatcccttttacctgaagtattttaaagcaaatcctagacattttgtcatttcaacctctgccccccgccccctacc

SEQ ID NO: 125669 - DNA, 450 bp, Homo sapiens
tgagattattcagctagggtgccatagtgcgagactgacagcagacttttcagcaatgaccatgaaatgccagaactggccacctagcatttctaaatccagcactttgggaggccaaggcgggcggatcacctgaggccagtagttcgagactagcctggtcgacatggtgaaaccccgtctctactaaaaacgcaaaaattagccgggcgtggtggcacgtacttgtagtcccagctcctgaggaggctgaggcatgagaatcacttgaacccgggaggcggaggccagaaccccagagttctttttcacctgtccccttctagtcactactcttgccaaagagtagctgatttgatttccaacagcatagatgaggttagcctgcctgtacctcctatcaagtggatttgtacagtatgtattcttgtatctggctgctttgttcaa

SEQ ID NO: 125670 - DNA, 731 bp, Homo sapiens
ttctgggtgtgagaaccagtcattgcttcattctgaaaataactaacagattctaattagaagactagattctctgcaactcctaatactttctgtaattcctctgatatatatttaaaatgtttcaactatgagaggctgacaagacattcacttaaagtggtgaaatacataaacctttaaaatgactagactgagccttgaagtgaaatctattttctgccctaagtgtttccattgtgtacaattccctcggaatggtaggcagctgccatttagaactctgtgatgaataaagaaaaatctatatggaaacagaaatactatagaaatattatactctccaggcaaagaaaagtgggtgattgaggcaaatgcaccgataatttggggtcagggagaacacttgtctgaattacacagaaaatgttttcataaccttcaactttttaatcacagaaacatgcactaatatgcaaaacaagtgtgacagaatcatgggataaaagtatttacttgaaaggtctaaaatatcatcaaagtctaccatctacccaatattttaattcatatcatacaattcctatcaggaggttacctaatgatgaggacgtcactgcctcttacggagcatatttcatctttgggcagctctgattattctttaaatctttcactgaacaccagatggccatctgaagtgctgtgataccatactttaaaaaaaattg

SEQ ID NO: 125671 - DNA, 509 bp, Homo sapiens
agggttttctcattgtctggtggccctctcaccaaagcagaagtgaacatagccatgggcaggttcagcggagaggtgggtcccagagcgctgcgtggctggcctcccactcctgccctgcacaccatccttgagggactcccttgcgcccatttcctcctggcctctacctactttctgctgctgcttcctcccatacccacagagttcacgttgagctgagtgggccactgtccccactgtggacacactcttttatcgcagctacagcacaggaggtgggctctgccctctttcacaaataaatgacttgttccaggtcacaagccagaagtggcattcccaggccaggcagcccagctggtggcacccgcagtctcctaccccctcccctgccatttcctacttcaggaccaggcgtcgcaggagtgggggaaaacagggatctgtccacacggctctggtttaacacagatgcagcccagcagcctttggcgtcctgctgatgg

SEQ ID NO: 125672 - DNA, 480 bp, Homo sapiens
acattctttcaacaccttttcagatgctgacttcggatatcatcatttgtatcaacacatcctaaatgcagaaacatgggtgtacttaaaaatattttgactgccttttctgtttatctttgtccgtgaggctttttaatatactctttcctacggatccctgacctatgaattgtcgttaagtgtggtcacttcccccttctcagaagttcctagtcctggtcaaacccttgcctttgcctgtactggttgtcttccataccatctctttcattttctgcctatcatggaatacaggaaaggtggagggagggctgttgagagatcacaggatgcaaggtggtaacattaccagtcagttgagccgagaagggtctgaagtctggaccttagctcccacttgcagttgctttggggctgcagaagccaactggtattttcacctctgatggcggcttcttcagatctgtcctcattgct

SEQ ID NO: 125673 - DNA, 791 bp, Homo sapiens
aagacccacccccatgattcaattacctcccactgggtccctcccatgacgtgggaattatgggagctatgatttaagatgagatttgaatgaggacacagccaaaccacatcacccactatccataaaactgtcaccatcgccacctcctttctctctcccatctctgtcatatgatcctgtcccaagtgcctcggtctgatgggattggatccaccctggagccactctgcctgcaggtaggcggtggcctccacagccagatggccccaggccatctgtgcagggaccgctggggaaaacacacatctgggatcgctgctaaggaacaaagaaagccataagcgactctgaaattgacctagagcccagctgtgcttcagggtcactggatcactggatgggaggcaccatcttaggaatgtctcacccccactctgccccacacccatggccacttgcactggctccttcttccttctgtttgacctctttgagacctccctcccaatagtcccatgagggagggaggctcaagtgaatcctattttacaggtgagagaactcaggcttagagaagcaaagccatttgcccaaggtcacacagccacttgcaagcaactctgtccggctccaatgctaactactcctccgtgtgcctccatgtggctctggagacagagccgccagcaggagcctcccttcacatgccccgagagtggcctcctgcagagatataaagtgcctggctcggggctggccatgaaataggttcagaaagaccagtgagc

SEQ ID NO: 125674 - DNA, 446 bp, Homo sapiens
tacttttccagggaagtatttgaaagtttcaaatattaggacaggtgccgtggctcacgcctgtaatcccaaagctttaggagactgaggcaggaggattactcgaggtcagaagtttgagatcagcctacgcaacatagtgagagctcatctctacaaaaaaataaaattttaattagccaggtatggtggtgcatgcctatagtttcagccactggggaggctgaggtgggaggattgcttgagctgaggagttcaagtccagcctgggtaacagtgagaccctgtctcaaaaatataaaagttaaaaaataaataaataagagagttttttgtttttttagtttttaaataggtcctatagcttttgaggatttgagatttctactaggttaaaatttattttaaaatatacgtgacaagatttcgaaagtacaaaaagataa

SEQ ID NO: 125675 - DNA, 343 bp, Homo sapiens
cctcttacctcagcttcttaagcaactggaactacaggtgggtcccagtatgcttggctaatttttttggtgttcttagtagagacagggtctcactgtgttgcccaagctggtctcaaactcatggtctcaagtcatgctcccacctcagcctcccaaagtgctgggattacaggcgtgagccaccgcagccagcctcagatggatttcttgttctgacgcgatgctgtgtggaatgccatgatggtgggtgagcatgctttgagtctgcagatggtagtgacagcaaacgcattaaaggcagggaagcacgttcgtgtctgggatatctgtctattccagt

SEQ ID NO: 125676 - DNA, 323 bp, Homo sapiens
ctttgaggccattatgctaagtggaataacccagtcacaaaaagataaaatactctgattctacttatttgaggtatgcagagtagtcaaattcatagagacagaaagcagaatggtgattgtcagaggctgcatgatggggagttattgcttaatggccagaaagttttacttttgctagatgaaaagaatactagaaatgggccaggcacggtggctcatgcctgtaatcccagcactttgggaggccgaggcaggcagatcacgtaaggtcaggagttcgagcaatccccccacctcaatgagtttttttaaatatgata

SEQ ID NO: 125677 - DNA, 229 bp, Homo sapiens
agcgggaccgaagtggggggggggtgcggggggggctcttctcgaagcattcggctgtagccagcgtatggtggtagtctgtgaacctgccgcaccgagacaaacacaaatagaaacagttatgagagcaaggaatttggagccaggagacagaaggcagtggggcacaactctgctgcctcttctttgccaccccaatacactggcctctttctccttcctcctggct

SEQ ID NO: 125678 - DNA, 334 bp, Homo sapiens
caatggctgtgggcctggatacaagtcttagcctctccacttctccacttcctggctctgtaagccttagacaagttccttaactccacacttccatttccatgtaacaaggggttataggccaggcattggtggctcatgcctgtaatcccagtgctttgggaggccaaggcgggaggatacttggggacaagagttcaagaccagcccaggcagcacagtaagacattggctctagaaaaataaaaataaaagaaatcatccaagaatggtgacttgcctactattctactcgagaggctgagaggggaggatttcttgagcccaggagttt

SEQ ID NO: 125679 - DNA, 421 bp, Homo sapiens
tatgcactacttaagtccccgcacttgacaccatctatggataagataagcaagccctccttaaatgtaggtttcacatgccatgaagactgtattttttatctgcatttggtttgggtgcggatgcaaaacccacagagagagccaagtatatttttgttaagacaataatgtgagagagaagcacactaatatattttgtttcaagaaaagcaaatttcttgtatttgaattattaccatcctaaattaagatacttgtagaatagtgattatcttgaaatatttttcttagatgataattggattttttctggtttcagaaaaataagttgagcaaggataatatttcaagagttcacatttaatacaaaacatttctttgaagtagcactttcagttttgttcttttttttagttct

SEQ ID NO: 125680 - DNA, 419 bp, Homo sapiens
  misc_feature (31)..(31): n is a, c, g, or t
  misc_feature (33)..(33): n is a, c, g, or t
ctagtctgagaagctgggaagaggactggcnangaatttccaggtggggtggagagaaaataagaaaagtcactgaggaaggcagaggggtatctgagcatatgtcaacatagaaacagggtgcgcataggcaggagaattcaactaagttacaccataagcagttaaggccgactcggcagggatggagatttggagttggagatgtgtggtgaactcatagccagctctcattacctggaagcctgctgaggcagaagctccacgagtctcagctgggagcaccagttctgaccaaaatcagccctatcattaactgtgtgactttggacaacacactcaacttcactaggccccagcatcctcatctgtaaactaagggggttggatatgatgagctttcccaggtagagttagca

SEQ ID NO: 125681 - DNA, 552 bp, Homo sapiens
tcttagtccactgaggctgtgacaacacaacgctgtaggacgggcagtttctatacaacagaaatctgttcctcacagttctggaggctggacgtccaagatcaaggtgccagcaggctgggtgcctggtgagggcccacttcttggtcaaaagacaggtgtcttctgtgtccttacatgatggagagggcaagggagttctctggggcctcttttaggagggactaatcccactcatgaggactttgcccttgttaccagatcatctccccaaaagtctccacttcctaataccatcatcttggggattacaatttcaacacaaattttggggagatataaacactgaaaccatagcattctgcccctggttcccccaaattcatatccttttcacatgccaaacaaattcattctatcccaataaccctcaaagtcttaattcattccagcatcaactcaaaagtccggagtccaacatctcatttaaatatcatctaaatcagttacggttgaaactcaaggcacaattctacctgacacaaaattctc

SEQ ID NO: 125682 - DNA, 168 bp, Homo sapiens
agtgctgggattaccaccactaatcttactaatctttaaaatggcaataatattagcccttactaagtggttgtgaggatttaattcattaatatatataatcctcagaagaggggctaggatctctaaaggctacacacatatatatatttggggttaagagtcacc

SEQ ID NO: 125683 - DNA, 708 bp, Homo sapiens
agctgcaaagttgagtagctgcgacaaacactgcagggcccagaaagcctaatacatttaccagttggcttgttacagaaaaagttgctgacttctatctaaatctttttctcctttcccttacttttgttaattttactgattctactaagaactattaattgtagcaattttttttaattttttgggatttggggggttttttgaaacaaggtctcactctgtcaccctggctggagcactatcatggctcactgcagcctcgacctcctgaactcaagcaatcctcccacctcagctccctgagtagctggaaccacagtggcacaccaccatgcccggctaatttaaaacaatttttttgtagagatgaggtctcactatgttgcctaggctagtcttgagctcctgggctcaagggattctcccaccttggcctctgaagtgctgggatttcgggcatgagccaccaagtccagactatagcaacttttaaaaactaaaagcagaaaaacttttctgatcttatgtaaaggccataaaattaattggcatataaagaaattggagttaactgcagataatatttatctttgtggtttatatttatttcaataaaacttcttattattaagtacctacaaaacagaatatggcagaattatatacttttttctattgtcttatcagcctgagggcacagaatac

SEQ ID NO: 125684 - DNA, 235 bp, Homo sapiens
tgcaacaaaaaaggtatcatttataacatagcaaaaaaatataaattcactaggaatggatctaaaaacatgaaaaacttttatagagaaaactgaacttcaccaaaaggcaatgaagaggacctcaatacatgaagagacataccatgatcatggaggaaaaaaacactctactataaaaatgccagttccatcaaactcatccataagttcaatgtaatcccagtcaaaatct

SEQ ID NO: 125685 - DNA, 438 bp, Homo sapiens
ggaagaagaaaagaaaattaattagattttaaagcacaacaattaaatagaaagcaaaccaagatagtacaatatgtggagggcaagagaggagatcatttggaatggtgaatctttaccgggacagttttgccccctaggaacattcagcaatgtctggaaacagaaacacaacccagtgggtgttaatgcccactgtaggtaggggccagggatgctgctaagcatcctacattgaaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctatcctacattggaaagggtagctc

SEQ ID NO: 125686 - DNA, 459 bp, Homo sapiens
tatatacagctcctatgagaataatcaatactgaatatcaacaaactgacacgcatgtggctaccaagtctctagaatgacccactgaaattcagtaaaagcttagagagcacagggttaactgccatgctgcactatttcccctcttacttgaacaaagtaacacttgctgatgtaactgtgcttgccaagtttttgatagtaagtccatcatgtctcgtaacttcaaagagtctcaaaagtgtcaagatcctaagacaggaaacttctggtagctgacaatgtctggttaatagggggtttggtgaaagcacaggcaatgggcacagtagagaagcaagcagcaaacaatggagatgtccaggaccatcctggcacgtgttctccagcgtttctaggaaaggtctctggtctagttatcaaccgctgtgtaacaaaccatcccaaacttagtgagat

SEQ ID NO: 125687 - DNA, 360 bp, Homo sapiens
attcattcattcaatagttatttatcacacatcaactatgtgttaggtaccatcgtatgtgtggatacacagtggtgaattaggtagacatggtctctcccctcacatagtttatagaccagtggagaggagagaaaataaagaagtaaacaaaggtgaactgaagactcagagagaggctaaattcggcactgaagctggagtccagaaggcggttcaaaccaaaggatggattgcaagctaagtttgctagaggtaattgccaagaatttctcctgagcaaagattttccagtgaggccactctggacccctggtgatcccctccctggagtagccctgtctgaaaccctgatcttca

SEQ ID NO: 125688 - DNA, 597 bp, Homo sapiens
gatttatgctttgaaaaccaaagcttttcttgggttctgcaagaaacaaatggcacccttctcgtccaggttgtagcttccttcattttgctaaattagttagattcctctatctactttccatctatctaaaaatttgttgaaatcactcatcttctactttatcttcttctaatctttttgttcttgtgggcatcgatttatctacctacctacctacctacaattgaacctcattattcttggtagctatgttctgtaaagtcattgtgaacagtgcattagtgactattgaaccattgcccataagagaaatatagggttagggtcttggaagcatctggtcgcaacagttttgcaaactgatcaatatataaccttgtttaatagatagtgttgattcatgaacattgaacttgcagccaacagcactataactcatgcctgaacaaagctcactggtatttgctttgtaaagcacatcatagcattcctgcacttaggaacactaggcaacagtacttcagcactatgcataggggctatttttaacagctaaatcaccaacaaaaagcacaaaaatgtgaaaaatgtggc

SEQ ID NO: 125689 - DNA, 291 bp, Homo sapiens
cgttgttagctttagtcaactttcatttcctgtggagattcaaataattattcagaaagtaacacaaggggaaaaaatcaggaattcggcaccatgacaatttgatcctagatgtgaattctctccctgaaagtgcagaagtgatatgaatgattttattcagcccaacggttggatatcaaggtcttaataatgaaacctcattctgacagcttttactgttggacagcaggcttcgttatattggccatgttgatttattacttttaacttcttttacatatgtatgca

SEQ ID NO: 125690 - DNA, 366 bp, Homo sapiens
aaactgaaatgtttgggatatgctttttctctctgggtgactcaatgccttgagttcataaatgcaatgtccctgaagaataaaagagaaatgtgccttaatgagcttgaggcatgaaaggtgtaagttccctctgcagcaagcaaaagtccacagtaaaagtaactgagacctaccgtgaagagagagaacagcatccaggtggcaatcatgacctaactttccctcagttatatctgatcttcagaacccactgtgcctacagcttcgtcccagtttccctttcttcagtaggacatccgatgtaaggacacaggaacacagccctctgccaggtcacaggatttcaggggaagcaggactgag

SEQ ID NO: 125691 - DNA, 567 bp, Homo sapiens
tggggcgctgggaccaggcctcactacccagggtgggtgctctctccgggcttttgccctttgttgggatgagccaacgaacacaccaacctcacctccttcaaagaagatagtgtgtctagattgagtctacttagcacctctttcccgaagactgtcgggtgtatggagaggcgcctgggggatgagcaaatgctgtgtggggagctgaacaagaagctgtggagcacacggaggcttcacaccatgagacagacgtcagggagccttccctcagacctctcaggacccctggtgctgaaggagtttcttctcctcccatgttttgaacccatctagctttaaggaagtttgacacttctctaagggcaggcctgttcagaccagtacacaccgcctgcccctctgacctttccttcccagctgaggagatggcagccctgatcctctgaccctgcagtattggcccatcaccacatggctaccagagatggaattagcctgcaaaggccattccctttcatgaaccaggagctagggtgccacctaatcacctgggcctctaag

SEQ ID NO: 125692 - DNA, 251 bp, Homo sapiens
aaagtgtcctgggcatgcctgcctgccagctccattcaccctctaatgcccctaaatgatatttggctatctttagtttgacctgaatatgagtacagtcctatataatcctaaaagcaggtaacatggggataaccatatcccatagggttaagtttaattttgtcaaaattgttatctttcctttctcgtgttagcaaaactgcgtcctgcagttcatgaagatttatatttcttctaaaacatgacac

SEQ ID NO: 125693 - DNA, 178 bp, Homo sapiens
gaggccacaaggcaggaaaaaaatcacaatggtgttgctttactaactatcgttgttaataaaataaccaccttacctactagtcttcttcttctttactttctcttttggaaacaaattctcttccggcgccccaggcggaagtgaaggggcaaaaccccgccccagggaaacttcc

SEQ ID NO: 125694 - DNA, 581 bp, Homo sapiens
tgcatacaacgcgtatgggagctctccatataggtcgacctgcaggcggcgcgaattcactagtgattgtgagctgagatcgcaccccttccctgcttcccaaatgtgggatctcctaagggtttattcccaggacaacgagcattccgcttgccattctctatttcagaaatgtttctcttagaggtgtgtattagctcattttcacgctgctcataaagacatacccgagactggacaatttgcagaagaaagaggtttaattggactcacagctccatgtggctggggaggcctcacaatcatggcagaaggcaaggaggaacaagtcacatcttacgtggatgacagcaggcaaagagagagcttgtgcaggcaaaatgccatttttaaaagccgtcagatgtcctgagacttattcactatcatgaaaacagcacaggaaagacctgcccccatgattcagttatctcccactgggtccctcccacaacacgtgggaattatggaagctgcaaggtgagatttgggtgggacacagagccaaatcatatcaagatgctacttaattaaatttacta

SEQ ID NO: 125695 - DNA, 651 bp, Homo sapiens
gagatggagtctcgctttgtcacccaggctggagtgcagtggcgcgatgtcagctcactgcaagctcttcctcccgggttcacgccattctcttgcctcagcctcctgagtagctgggactacaggcgcctgccaccacgcctggctaattttttgtatttttaatagagatgggatttcaccgtgttagccaggatggtttcaatctcccaacctcatgatccaccggcctcggcctcccaaagtgctgggattacaggtgtgagccaccgcgcccagtgactagtctttaaaaaaatgaataatataaatttttttaaaagatgaaaacatatatataccctgtaacccaagagtcccactcctcagaatcttctcaaaccacactcttacccatgtgcaccagaatacccacacagcaccagaaaatgtccaaatgaccatcaaaagtggagagtacaaataaattgtgcagtgttcctggagtgaaatgaactacagcgacttgcaataactgtaatattgtcatattggataataatactgtaataacaaatgactcatcaatgaataaaacctacaaaagaatgcatacagtataattccttttagcaaaaatttaacagctggcaaaactgtattgttaaggat

SEQ ID NO: 125696 - DNA, 422 bp, Homo sapiens
tactagtccctgtatgttaaatatttgacctcttgtcttattatcccgtattgattgtaatttcattgagaagactgtatgcatttatctttgtgtcccatgtagtgcctgggtgctgtgccttgcacatagtagtagctcagtaaatatatattaatttgaaaattgccactcaatttctccctcagcatatttcttagtactattccaaacacaaaattcaagacaagatcatgtaactttaatacagtatactattcagcatgttcttacaccattattataaatatttattcactctattaatctccatgaagataaacaggccaagcataaagtatataaattcttgctattggcattttttcatgcttcacataaaggtttgcagctttcaggtgtttgatttattcattttggga

SEQ ID NO: 125697 - DNA, 311 bp, Homo sapiens
tgctgcacccctcccaccaaggtccaagctacagcagtgtcttgccatttctgcatcattgctgctgctgtacctggcctcatagagcctggggtagtgatatgtcccaccatcccaaattacagctattctctgctccctggacccaagcttctagagaactcctttttctaccaagctgtgccagtggtgtcccatgtccaccagggtcacaacctcagctatatttcagcactctgggcctaagatggtgaggtgcacctcagaggaacagaccctgccttactggggaaactgcattcatttgtatc

SEQ ID NO: 125698 - DNA, 426 bp, Homo sapiens
agtaatggcagattttatgaagaggcagtttggagggcgagtggcctgctggtaagtaacagaggcagaaaatcggggaataaggatgttgttcattgtatttgttgacaggcaaacagggcagaataagaagcttctttgactctcgaattttagcactagaagaaatagtgaggattatatatttcagaagttctcacccaggatatcagaacacattcagagtcctgatcccagttatgagaaagggccaccttcgactacaaattagaaattgcattttctaccagaacattaaacgacaaaggctgtctacactgggatgtatcagtggaagtgtctccaatgtcaacatgggtcatagcagaagaaacatggaaaaccactacatctttagtccaattacttcgttgtaagaaggaacaa

SEQ ID NO: 125699 - DNA, 554 bp, Homo sapiens
ctctggtacaagacttcagcatagacattatactcgtgagtatcgcaaatcataggagtacatgtcataaagaatttcctgtggcacagttggagagccgagtgaacattcccatgactagtccacacatgtcttcaaacttggctggtcgtgaccgccattcttcaatctattgaagatcaatagaaagactcaagaagaacgtaggctcaacaaaagaatctgagacacagttacacattaagcggcttatgatgtcaggtactggcagttcatcttaaccattaaaggtatcatttgtctctccccaaactgacaagtattcctaaaataatgaccttacctcattcttacgctagaagggcacactatgaaagctgaaggtaccagacttagtatagtccacatccactgtgaataacatacttgtggtacatatatactatggaatactatgcagccataaaaaggaatgagatcacgttctttgcactgacatggatggagccggaagccattatcctcagcaaacttatgcaagaacagacaaccaa

SEQ ID NO: 125700 - DNA, 465 bp, Homo sapiens
aaacaagccaacaaaacatgagaagtatactgcctttcaattaaatggtatattttaaagtgcataaacccataacaaataactcgattttagacatttagttaccaaaaattgtcttataattgactttaaatatgacagcaaatgttttcataatgttcatgtacacaaatggctgctacaggattactcctgcaaaacatcattttttctaagttatgcatcatcctgattgactgctaacatccaagctctatttatttatttatttattttattttttttgagatgaggcctcactctgtcggacaggctggagtgcagtggcacaatctcagctcactgcaacctcttccaggatgcaagcgattctcctgcctcagcctcctgagttgctgggactacaggcacgccccaccatgcccagctaattttttattttttgtagtagagacgggatttcac

SEQ ID NO: 125701 - DNA, 422 bp, Homo sapiens
ctacactcatgtacacatccacttgcatgcacaggtacacatgtagatgcacacactgatatatacacatgtacacacatagagggacacagagataccatgaacactgccacatatagacacagacacgcatacatacagatgcacacacaatgacacatccacacacaggggatgcacgcagacatgcatgcacacgggcaggtatcgacacacacaggcgaacgcatgcacgcatgcaggcatgcacacagacaggcatgcacacccagagatttggtggtgtacatcagccctggcccctggcaggtgctggacatgctggctgaatggagggaactggtgcattagcacctactgtgtgccaagcccctcagcacagggtccgaagaaactgctccatgaggtcagtcagccaaggc

SEQ ID NO: 125702 - DNA, 159 bp, Homo sapiens
ttggacaaccgtgcctttactttcatataagagtaatacattgattcacatacttctagttatactacctttccacaagctatttggagcctccatattccactaaaatatcattcttctttacagggattaactaacataagtgtatcttatactact

SEQ ID NO: 125703 - DNA, 360 bp, Homo sapiens
ctgcctcagcctccgagtagctgggattacaggcatgtgccaccacgcccggctaattttgtatttttagtagagatggggtttcatcatgttggtcacgctggtcttgaactcctgacctcaggtgatctgcccacctcggcctcccagagtactgggattacaggcgtgagccactgtgcccgacccaaaatctcaactctttatgcctacttggcacaacaagatctagcccttacctacctcacccagctcatctgccagatccccacactgttccaatcaacaactttttttttcacatttcctcaaagcaagcacattcctgcctcagggcctttgcacaggctattacctttg

SEQ ID NO: 125704 - DNA, 147 bp, Homo sapiens
tagcatttgaaggatactgactacatcttatatcttattattattgcctttggctaattaaattctgaagtgtctctcaacccagacagctcagagctgccataattatatgtcctatgttctaattattgggggtgccacatataa

SEQ ID NO: 125705 - DNA, 107 bp, Homo sapiens
cgagtaacagacatgtccaccgaggaacccaaatgttctgaacttctggggctagaaaacctgaactacatccccgtttccattggccagacatctaacactctcca

SEQ ID NO: 125706 - DNA, 337 bp, Homo sapiens
aggttaaacgtaagcaaaaggaaaaagatattccaaccaatcacaaatcataaaagagctggagtggctctgttaatatcagacaaagtaaatgtcagaacaagcattaccatcagagataaacagaatgtttcatgataataaaaggatcaattcatcatgaagacttaacaattctgtaagtatacacaccaacctacagagcttcaaaataagcacagaagaagctgagagaaatgaaaggagacacggttgaaaacttcgacactcctgtttcaggaactgatagaacaagtaagagaaaatcgctgaaacctaaacagcactatcacccacc

SEQ ID NO: 125707 - DNA, 387 bp, Homo sapiens
tcactatcttcatctggcaccatttcctactaacccctgcattcaagccatatcaatgtcaatgttattgactttgtcaactgccaatgtcaattgacactgactcgtcattgtcaatgacttatctaaattgccacagtttctcaggcctccttgccttctcaattactatatcctcctcttgggaagttacttacctcctgcacttggcaaaatcatatcatccttcacaacttggctgtgtgctcccaactccacctacactcaaggcaagttaactatctcctactctaaactctcctactacactaggcatatctctattcccactgactacatagtattataattgttaatttactgtaatgttactaacatcttgtatgt

SEQ ID NO: 125708 - DNA, 416 bp, Homo sapiens
tgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggacagacatggagaagagaaacaagagaacaggtagtgagaagtcgagagtcagtaattttcttacttaatattgtgggga

SEQ ID NO: 125709 - DNA, 502 bp, Homo sapiens
gactctacccttcaggcaggttatgatgtcagcaatccttaggtttacattcttacagccaaaaggatggtaattccttccactataccagttattttgctacgtagtgacaaaatgattccctaaataaactgtaagcagtgctgaatgatagccactcagctaatcaaagccacatttttcattttacaaatatgttccacctttaattgggaaagcaagccaaaaggagaccccctagttatcacaacatcccaccatacttaatgatcccaccctggtgttctctgtatcctggaattctcagaagttatacaactctcataggccaaaaacaaaagagcttcatttcacagccatctggaggtgccttcatgacactcaattacggctgcagactcagatgacttatctacaccccaaagggtctgcctctgctgctggaaatgctagacccagaagcccttggcactaatttggaccacacaatggactacgggga

SEQ ID NO: 125710 - DNA, 364 bp, Homo sapiens
aaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcc

SEQ ID NO: 125711 - DNA, 396 bp, Homo sapiens
acagcggggccactggatgccttgacgcagaacttttcaaaaaatttcaagcaggatatatcaccaccccattaactccctgccattaatctactcctaaaaacctggagttttcccaaaaggaactggaacggggtgaaaaacggacccatttggtaaattctgtaaatcaggctggccttctctcctcggcctctccagccttggtgatgggttgctgcgtgggagggtagatctgcagccttccaggctttcgagggagtgtccccaggatggatgtcagtcttaaggggctgctgtactttatcctgctctggcctatggggtcactgagtgaagtgttctgtaggggtgtgggggtggggggactgtcgtcaggaagagctgcagagaatg

SEQ ID NO: 125712 - DNA, 817 bp, Homo sapiens
  misc_feature (215)..(215): n is a, c, g, or t
gcgggtggatcacctgaggcctggagttcgagaccagcctgaccaacatggagaaaccccatctctactaaaaatacaaaaatggccaggcgtggtggcacatgcctgtaatcccagctacttgggaggctgaggcaggagaatcacgttaaacccgtggagggcagaggttgtggtgagccaacatcaggccactgcactccagcctgggcgancaagagcaaaacttcatctcaaaaaaacaaaacaaaacaaaacaaaactacagaatattcttcaggctaaaaagaaataaaatcagattaaaataagaccttcaggaaagactggatactgccagaaataatctgaaaaaaacaaaacaaaacgaaacaaaaaacaaaacataaaagattatccattttttctgtattctctcaaaagacaagtagtgttttttttttgtttgttttttgttttttaagacagggtttcaaaaaaaaaaaccacaacggacacaaacagacccaacgacacgcagggcagcacccagaccgaactaacagacacggcaaccaacagcaaacagaacggtgcgggcgccgcccgacccgccgcacggagagagcgttgtgacaaccacacatgtgggggggggcggccccgccaagagtagctagcaggaacggcaggccgctggttgtcccaacagggaacactccgtgcgacaacacagcgcggggggggccccccaccaaaaaaagacccgcgggggggagacagcgtgtcgacaaaccaccacgggggggtgctgcggcgacgagggtaccacacggcg

SEQ ID NO: 125713 - DNA, 441 bp, Homo sapiens
gctcctcctcctcctccctcttcactgtggaccgaggggcgctgtgagtcaggaattctgtgcgactctctctggacctggcttttcttgctgagctcactacatctggggtccccagtgtgactcaacaactttctcccttgcccagcttccctcatcccacgggctgggtgtcctcttttccaggtgtgggacccctctagagaaagacatccacaacctaccctcggaacctcagcccattcatggattccttctcctgggactgaagtagggctacgtagggactgtggtttgtttggtaggatattaggtatttagttgtgatgcttttccattttggaagcagcgcagcaggaatcttgctcacgatggtgctggactagggtggggtattggatttgttttgtgttctcagaaggctgagggtaggagggaccc

SEQ ID NO: 125714 - DNA, 341 bp, Homo sapiens
tggctgtctagaggatcctcaaaagccatttctaagctatatacagtaggtgcttttttttttttctttaaggcggagttcactcttgttttgccagtgatagatgtgcatgggtgcgatctggagtcaccgaaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagcca

SEQ ID NO: 125715 - DNA, 136 bp, Homo sapiens
ttgtgttatacctcctctgactgccatgtgaaaaagtgcctgggtgttttttgttctctctgagtgtctgggcagctcttcatgggcactggctgctgattaacactcatggttgctattgctaaatttttcttgt

SEQ ID NO: 125716 - DNA, 169 bp, Homo sapiens
ttggcacgcctcctacagagctagaaccctttgcccccagacctagtcagcagctgtctcactttgccaaattcatttctggggaagctttctctaggaatgccaatcactcctggcccctaactcatgcttccagacctcggccggtgcctctgggacctgggcaccc

SEQ ID NO: 125717 - DNA, 744 bp, Homo sapiens
caggatcttgcttctcactctgttgcacaggctgaagtgcagtggtgtgatcacagctcactgcaggctcaacctgcctggctcaagtgatcctcccaccaccctcccaagtagtgggactacaggtgtgcaccatcatgctctgctaattttgttgtatttcttgtagagatggggttttgccatgttgcccaggctggtcacagctttgtcttttttctgtagtctgtaatttttttttaaaccttattgtgtgaatccagtgtcaaactacttttcttagatgttcacaaatggataattattcacatcggtatttgaagatctcttaacaagatccataaataccacttagaattgctcttactagtttaaaaactttgtaggaaagtaaaattgtagaatacataatatcaatctactgaataaaagcatttaaatgaactaaaataaaattttattatcaaatgtttgtgtgcttctcaatgttttatttttcaaacagaaaactctttaacttgaaatgttcatcaatttaaagattaaatcagctgaaataatattagaatttgatatatgatgaattttagtcttctgaactataactcaatttggtacatgtaatcagtttattatggcaattggtttattcctgatgaatgttggtatgaaattttttcaataactacaacaaaacccctaaactcttaaaaagcaaatgactgtaattttattaaaagacaa

SEQ ID NO: 125718 - DNA, 325 bp, Homo sapiens
ggtctatatgaaagtacttaatactgtgcctggcataagttattatcttagcaactttgacattatcttttaatatgaaatatgatcatcttgtatatctaaacccacaactggatagcagtgttggtgagctttgtgatcagagagaaaaagatagggaagaaccaagacaaacttttcctctgccagaactgactggtctcatgtgactgtgctgaagtacacctataagcaaaaacatactgccatgcctccttagccatgaatagcaagttatgccactgtctcatgaaatagatgttctgtgacagtgcactacactgga

SEQ ID NO: 125719 - DNA, 290 bp, Homo sapiens
gcccctgggtgtctgtggagggaggaacggcgctatgtgataagagagaagctcgctatgtgataagagagaagctcatgggggcaaagggttgggggtgggtaagccagggcttggggcagcatggggaccttagcgctccacgtcttatttggcaggagaggctggaaacgagcgggcgccagctgcaggcaaattgcaggctttcccagcccttgtctgcagagagaatcattacctgtggatggcgcggggaatcccttgccctcagtagccccgcctggagagac

SEQ ID NO: 125720 - DNA, 350 bp, Homo sapiens
tgaccatttgtcatgctctgcgactttgtgtacatccttcctgtacttaggaatcagccacctgtgatcctgctgcctggaggaagaagacatttattttcctatagcctctcttgcgtgtggagtgaatcatcctctgttgactttaagtgaaaaatattaacttttatttaagtgactgtatttgggggtagcttagcctgtgctttaatacacaagcaaaatgattagattctgaactgctttactgcagatcctaccatccctgtattcgctatgaacttacatttgtgggtgtgttagatactactctaaactgcgctacccacctccctctagaccccagagag

SEQ ID NO: 125721 - DNA, 321 bp, Homo sapiens
tctttccttccttctttctttctttccttctttctttctctcctttctttctttctctccttccttccttccttcctttttctttctttctctctttctttctttctaaatacatttctctttattctttttcttacacgcttccttatccgaaaatgggagaattgggctaaatgatcattacatgttttttggaagttttgacgattgtaagagatgtttagagaattgacttcttggactttcatttttagtggtgggattactttcatgttaaaaatttgcacctgttctaatagaacattatatggctagacattt

SEQ ID NO: 125722 - DNA, 238 bp, Homo sapiens
aaaaaatacctttatttcatttcttttcctaacctgtgtgttggtcaattaaaaaactttttaaacataagtcacaaatccataaaaaatgttctgtaaatgttctttactgagatatattactttttacaattttaaaaaagaagactttcttattcattcttcgttccttccctgattaattcctttagtgagtaggcaagaagcccggttcaaatgcttttttttccccacatta

SEQ ID NO: 125723 - DNA, 417 bp, Homo sapiens
ttgaccaaccgtcgtccacagtaagtagtacccgtgctcctaaagcttccctgggattaatattgcactgatcacattggcttcagtgatgtttttccttccacttcctgctctagtgtagaactcacagggcggggacaaggttttcatatacccagcacggggaacagcagcccttggttaacatgtactgaatgaatcacaggaagtggtggctggagctcattcacactagcatgtaaatgactaatatacatcctttcctgaaaacaacccttgatggaggagaggaaggggaaatcccagagccccgggcaagtgaagccagggaagcagccccacctggagagggacaggtccagggagttgggaggcccagcttcaaccctggttatgaaggtgggctcggttctgcac

SEQ ID NO: 125724 - DNA, 418 bp, Homo sapiens
cagtaattaaagcaactgggggattctggagcagctgttcattttgttgaacaagagtagctggggggcccactgacccaggcaagtggttctcaaacttgagtgagcccgagaacctcctggagagcctgttaagctgttgggcccagccccagagttactgactcagaaggtctgggccaggggtctgaggatttatgtgttccgtggtgctgctgctcctggcctaggggctgcactttgtgaacactcatctggcctctggtgaacactcatctggcctctggtgaagactccaacccccttcctctatccattttctccccaaggcagagaaaggaggatgggaggctagggggtgtttaggaacccacctcctctgctctttctggattctctacctgtccaccaacagacc

SEQ ID NO: 125725 - DNA, 416 bp, Homo sapiens
ctgttgtttcctttgcttcaggtaagggactctgaaacaactatttgggcagcagaacagcctcttttgtttgctttctcattgtctactgtgttctgcataaataaggttatgaattagctgttgttcatatgggtgaaagatttgcatctgtggacgcttagatagcacatatggtaaacatagaacttcaccatttataacctttgaacaactgatacacttagaaaagcagtttttggctgggcgcggtggctcatgcctgtaatcctagcacttttgggaggctgaggtgggcagattgcctgaggtcaggagttcaagaccagcctggacaacatggtgaaaccccatctctactaaaagtacaaaaattagccaggcatggtggtgggcacctgtactcccaactactc

SEQ ID NO: 125726 - DNA, 353 bp, Homo sapiens
agtctgtaaattatagcattggtctccccttgtctgccttggccatgggatcttccccattttcctgcgtggtgtctgcttggagctgtgcagtgtcctgtgatgaacctatcaagaggagccatctgcagcatgtccctgtggttaataaactgacccatgctaccaggcccctggataatacagcctgtcagcactggagcacatcttacctgggccatttctattctggggcattgcatttcaaactgttctttccagtagaaagactataggtgagcccattcccaatttgtggttaaaagtaggatgtcaatatatggcaagccaaatgatgggcaatggtagaggtc

SEQ ID NO: 125727 - DNA, 231 bp, Homo sapiens
atatgagctcggtaccgccccgtcttttggtctcagcctcccaaagcgctggcaccataagcatgaaccactgtgctcagcctgagtttttaaattatagttcgatgactatgaggaagctaaggaccaaaagacggggcctttcccaaggtctataaccagcaagtgagtggcagggttggcattcattcctttttctcccatttcagcttttattcctttttctcctca

SEQ ID NO: 125728 - DNA, 336 bp, Homo sapiens
gtttacctgtgttccccccgctccgcgtagggtctctttgcctgtgttccccccgctccgtgtagggtctctttgccttgttccccctgctctgggtagaatctgccctagagactcgcggggcctccacctcataatgtctgagccgagctcagagctgtgccctctgcggcctcgtctgttgcaggggagcaggcaggtcccaggaagtgcgtgtccttcctcccgcaagcagacacgtgctgcctcgaagcctcagcagccagccgggcagcgatggcaaacaacaccccagtgtctcgggggcaggcgcagtgtgagctacatcctctgctg

SEQ ID NO: 125729 - DNA, 2925 bp, Homo sapiens
ctcggaactcgccaggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgggacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 125730 - DNA, 3075 bp, Homo sapiens
ctcggaactcgccaggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgggacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 125731 - DNA, 2682 bp, Homo sapiens
gcaggctggtaccgctctggcgatgtatgggcacctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgggacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 125732 - DNA, 2907 bp, Homo sapiens
ctcggaactcgccaggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgggacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 125733 - DNA, 3415 bp, Homo sapiens
tgctggaggctcagtccgaggatgcctagatgttagcgagggagcacgcgctgagcttcccgaaccccatgccacaaaaacaaggcgccagcaggtcccgctcacgtcccagcgggcttctttccctggggtggggaagtgggtcaacttcgttctgatctgaaggggggtttgggactatttgggtcgctcctcacctccccacccgctccccggcttggcatggtccagagcccgggctggagccagcggtagggccagcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgggacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 125734 - DNA, 1906 bp, Homo sapiens
  misc_feature (90)..(90): n is a, c, g, or t
atgatgcatcttaaatacaggaggtacatgtatgtggcaaaaatggcaacatcttgtgaacaacgtcatgattcaaacttgacggggagnggagcagggaggaaggtaacctgcaccctgacgtcttcaggggaggacacacaagcaccctatcaggtggcctctcttgaaaacccttgcccccacgactggcgccctgctttccccattcactgccttgtctccacccctcgacctccttgctctcctgctgctgactttgggacccctaccctgcaggctgtcctggaatctcctcggggatgaggcagctgccgagctggcccaggtgctgccgcagatgggccggctgaagagagtggagtatgaggggccgggggaggaatgggacgggctaaagggggacctacatcccgggaacaccaagaggccactgggtcagtcccctgcctcccagaaagcccttccttgagttgcacactctggcctgttccaagcccctgccaggcttagttccccctgggttctagccttcagccttcccgctgcacctgccaccagtcccctgttgtcttttgggttccctgagaaggtagtgtgggagactgtgtcccctgaccttggcctgaggaagggacctaggaaactctcacacccattctcatggccgtgtttctctttcccctcccctcactgtccactgagaagcctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125735 - DNA, 3388 bp, Homo sapiens
  misc_feature (18)..(18): n is a, c, g, or t
  misc_feature (25)..(25): n is a, c, g, or t
ccaggttggttacccccncgagttntggatatcgtcgacccagcgccctcggtggctcttccgcttggacatcagctttgaaagccaacacatcctcctgagaggggacaagacaagcagggatatgtgggccactggatctttgccagacttcccggctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagtctcagggtgcaggagccgtgggcggacagagccagggttctctccctgttagaagtctgcgcccaggcctcaggcagtgtcgctgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125736 - DNA, 3474 bp, Homo sapiens
  misc_feature (18)..(18): n is a, c, g, or t
  misc_feature (25)..(25): n is a, c, g, or t
ccaggttggttacccccncgagttntggatatcgtcgacccagcgccctcggtggctcttccgcttggacatcagctttgaaagccaacacatcctcctgagaggggacaagacaagcagggatatgtgggccactggatctttgccagacttcccggctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagtctcagggtgcaggagccgtgggcggacagagccagggttctctccctgttagaagtctgcgcccaggcctcaggcagtgtcgctgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125737 - DNA, 672 bp, Homo sapiens
cgtccactatagacgatcccctgtattggtggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125738 - DNA, 5824 bp, Homo sapiens
caccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagcgacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggcttggttcggtgcttctccactctgcagtggctcttccgcttggacatcagctttgaaagccaacacatcctcctgagaggggacaagacaagcagggatatgtgggccactggatctttgccagacttcccggctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagtctcagggtgcaggagccgtgggcggacagagccagggttctctccctgttagaagtctgcgcccaggcctcaggcagtgtcgctgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125739 - DNA, 1042 bp, Homo sapiens
  misc_feature (18)..(18): n is a, c, g, or t
  misc_feature (25)..(25): n is a, c, g, or t
ccaggttggttacccccncgagttntggatatcgtcgacccagcgccctcggtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagtctcagagactccacaaggcacacagagaaactgtccttccccacactggaggcctgtgctttgggatttaagaaaaaaagaaagaaagaaagaaagaaggtttcagaggata

SEQ ID NO: 125740 - DNA, 319 bp, Homo sapiens
gactcctgcttcctagcacttctcataagtgaatagcaaactgtaggacttcatttgatcagcatttatttacccctacaccataagctccttgcaggcagatactgaatcccacatactggactagatgttccaaaactgtcgtctccctgtctgtgtccaggttggctcactgtgaccttggagcccaccacagccttcttgtcgggcagctgatggagacatgtgccaggctgcagcagctcaggtcagcgcctggaaactctgtgtggggccctgagttctctggttgaccctggtacctactccaggccatgtg

SEQ ID NO: 125741 - DNA, 387 bp, Homo sapiens
gctgacccagtgctgcctgggccagaagcagctggccatcctcctgagcttggtggggcgacccgcagggctgttcagtctcaggtacctcctcccccgctgcctccgggaggggccatggcatgaatgggagcaggggtgggcactggagtaagaggcccccaggatcatggccccagtcatttcctgtacccacaaccctgccatctggaccctgagcaaaccctgtccatctgtcccagagactccacaaggcacacagagaaactgtccttccccacactggaggcctgtgctttgggatttaagaaaaaaagaaagaaagaaagaaagaaggtttcagaggatactgaactgaggacaaaaataaactgaaacgaagttctt

SEQ ID NO: 125742 - DNA, 349 bp, Homo sapiens
cttagctggcatcactatctcccagggaggaaggttgagttggaggactcaggaggcaggtgtggggtacaccctctccctaggtcagctatgctggtctaacacctgcctctgccaggtaactctaggcacagctctacctttttgggcctcagcctcccaatctgcagatacgacagatggcagagatgggaggatgaatgagtgcctatatctgtgccccacagcctctggaataaccccattccctgcgacatggcccagcacctgaagagccaggagcccaggctggactttgccttctttgacaaccagccccaggccccttggggtacttgatggccccctc

SEQ ID NO: 125743 - DNA, 3519 bp, Homo sapiens
caccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagcgacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggcttggttcggtgcttctccactctgcagtggctcttccgcttggacatcagctttgaaagccaacacatcctcctgagaggggacaagacaagcagggatatgtgggccactggatctttgccagacttcccggctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagtctcagagactccacaaggcacacagagaaactgtccttccccacactggaggcctgtgctttgggatttaagaaaaaaagaaagaaagaaagaaagaaggtttcagaggata

SEQ ID NO: 125744 - DNA, 5861 bp, Homo sapiens
caccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagcgacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggcttggttcggtgcttctccactctgcagtggctcttccgcttggacatcagctttgaaagccaacacatcctcctgagaggggacaagacaagcagggatatgtgggccactggatctttgccagacttcccggctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagtctcagggtgcaggagccgtgggcggacagagccagggttctctccctgttagaagtctgcgcccaggcctcaggcagtgtcgctgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125745 - DNA, 1410 bp, Homo sapiens
  misc_feature (3)..(3): n is a, c, g, or t
ggnccactctagagtatccccacctcctaccccacgactggcgccctgctttccccattcactgccttgtctccacccctcgacctccttgctctcctgctgctgactttgggacccctaccctgcaggctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtggcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaat

SEQ ID NO: 125746 - DNA, 417 bp, Homo sapiens
aatgtctgccgcaggtgcccatctccggtttgcttgagtaagtggaaagcagcataaaggacagatagcaaggaggaaggctcccctaggccaaaagcatgatgggggctccttctgagggcatcccccagagcaccagaggacaaggactgtggagggcaaggggcaattcttcccttgccttcactcccctggccttgggtcctttcctctgtccctcacacccaccatgggcagatcctccaccaaacacccaagagaggctgtgattcgtggcagggtgacacacccctacagccaaactgacctggggacagggaagcaacattccatccccaaccagctgatgcgggattgcagctgcctggctcctggtccatcccgtccctgaaattcttctgacccaatctgtggaac

SEQ ID NO: 125747 - DNA, 582 bp, Homo sapiens
tgaagctgggaagtggaggttgcagtgagccaagatcatgccattgcactccagcctggatgacagagtgagactccgtctcaaaaaacaaaaacaaaaacaaaaacaaatcaatgagccaatagattccttagtaattccataatgagcacacattgtggagttggactgagtttaaatccagattatactgtgctctcttcggcagcacatacactaaacaaaacaaaaagcagattacatcactttttagctgtgtgattttgaataatcaatttaacttctctgtgcttcccatctataaaagggggagaataaaagcatgtacttcataaggtcatggtaagtatcaaatgagataattgacataaaaacttttaggaaggaagttagcacatggcaattaatcagtaaatggtttttatcattattacatctatccgcaaaacatgtccatttaacaaatgctcgccattctaatcataaccccatccttcctaaatgctcaacctcagtgtttccaccagcacaataccaacaggaaaaccaatttgtcttgcatccctgttcccaagtgcctga

SEQ ID NO: 125748 - DNA, 371 bp, Homo sapiens
aggattgcagaggaagggttgatgccccttgaccccccagcccggccccgctaccttcattcccttgccatgcccaccctgtccctctgcactctccctttgaagtgcttgcctgtttagggggctgccaacttcagcgtggcccctctcagcctcttatgtcctctgtgtcccagcctggtaaccttgggaacggagtgagcgggaatatctgtctgaggctgtgagacccttgctaaagacccttggggtccttgagggagcgcctggtggcctctgctgcctggaggcagaggatggcccagtgtccagggacacctgcaggtgaagctccccggagccacctttccagaggctggatgccaactctc

SEQ ID NO: 125749 - DNA, 311 bp, Homo sapiens
tgctgggattacaggcatgaaccactgtgcccggcctgataatatatttaaacctgaattgcacaacaagctgggccttccccttgattttctaagttcctcacagaccctgtctgttcctagctcttttatgatgttctaaaactttgtcgctgcttataaaatggaggagagacttactggtaatttgttctgtgtgagtttgcattagatgcttctaattcatagaaaagttgattatcctgtgattggagaacgaagactcaggtgagcagtaatagttttaaatacagttttttacagctagaata

SEQ ID NO: 125750 - DNA, 188 bp, Homo sapiens
agcccctggaaggaggcctgcactgccaagagtctgctgcatgaacccaggaagggaggaacccacacaccagggcacacaggcagctgccaggtcagggaggcggcttgtggcttcctctcaggaactcttctgtcctcatcagggtaataaagaaaggtcccctcacaaggcgtgagtccccagca

SEQ ID NO: 125751 - DNA, 164 bp, Homo sapiens
gctaacaaatgtgtacatcttagctaccctgctggactaaggccctggagacacggcctgctgttcgaccctggatgtccttagagctgctagtttggtgtttggcaggtgctcactcaaccttgtctacggaccggcagcccctgtacccaccaccatcctct

SEQ ID NO: 125752 - DNA, 190 bp, Homo sapiens
cttaagctaagatcccttaaaatttgaattggtcagaattcaaatatcttggagtcttcaaatgttaataaatattgctgtattcagtttgtgtttttcattttagggatcagacttacaacttgagatatggttgctatgatttggatctagtttgcccctgacaaaactcatgttgaaattatatttt

SEQ ID NO: 125753 - DNA, 293 bp, Homo sapiens
ccattctctatcttttggagtagtgtggttagtctataaggtggttatgtgcaaaagtgccaaaaacctttatgttaataaatagtttggcaacaactgtgtggtaactttatcaatgtactcatctaccctaactgcttgaaaatttggtatttcagatgttcatgaggctgttaagcattcttgcacataaacataattttcggggctcaagagtttgtccctggctttagactgacgacatttctttttttcttttttgagacagggtcttgctatgttacccaggctgg

SEQ ID NO: 125754 - DNA, 188 bp, Homo sapiens
caggcttagtttctttttccatacaaagcccattcacatccatttacatctctgattctgaatattggcccccttttattttgcacttggggaatctgagaccaagagataacttgactttttcaaggtcattcagcgagtcagcagaggagcagggaccacagccttacccctaatccaaggcctag

SEQ ID NO: 125755 - DNA, 348 bp, Homo sapiens
gccaaagaggaaaagaggcacaggtttcatagtgacagagaagtcttgatttgtaatcttgggaaagctgttcacatccaggatgccatctgcttctgggtaaaataaatagctttcctggtcagccttaccttgaggtctctgattggtatacagtctgaagagtctagagaggccctcttgagttaagagatgtggatcaaagactcgaggtcctgaaattttactgcagagaacatgttggtattgttttttccaacagaattcaagggcagtcattctaggtctttttcaaaagacctaaactcctggttctagatagtgaaaggtctgattgtcatcagttgg

SEQ ID NO: 125756 - DNA, 763 bp, Homo sapiens
acctcaatatattctctgcttcaagaaatagtgatattaggaaagggcatatacaaacaactcaatctactttgctgtataaaaagttcacttatttatagaaaatttaaatataatacatattaagattctctgagctccctactaaataacaataacccctcacatttgcatagtgctttatacaagacacgtatattatcctcctcaattcttcagaggtaggtagaatctcatttattttatggataagaaactgagactcagaaaggttaagtaagttccacaagatcatggagcctagtaatttgcaaaataaggcctccaatcaaatcctagttttctttctataccccagctgcagcttttagtaatggtctagttcagcatacatataaatatttataaacattgtgtcattgttctgaatgagtatatcttactattttgactgttttatgacagtggagctgcgtagtaaagtgaacatttgcagaagtttaatctacagccattttatattccctctccctctgctttgagattttatcctttgctagcaacaacattcttctgtaacaacaaataaagcaagcatcttcctatttgccttcaaataaaacaggtttagggattatctgctcttttcacatacttaaacacaccttgagtttctttttatagactttcctttctcctgacactgtgaaatcccagtgctgtttcttatttgaatgttttatcatctgacacctaataataa

SEQ ID NO: 125757 - DNA, 243 bp, Homo sapiens
aactgatacagtatcccgcagcccaggctggccttttctccagtcccagcctctagagggtacccctcaatcctttagtccaagcaccacttagaacagacagtcatacatcccgctgtttgaatggtaaatctttatgcaaaaacccatctaatcttcacaaagtctcctgggcagacatcaggaaagggatcttttgtcccactctacagatgatgatgttgaggctcagggaacccaaca

SEQ ID NO: 125758 - DNA, 810 bp, Homo sapiens
ggcacattgtcagtaatcagaaaatacttctgagcaacaacatctgggcttcaattaaatcacctattgagggacagccctttcctccagatgcatctgcatttagtgtgggcctcacgtgaatcagtctcagctgtgtttccagcagaggtctctggtttatctctgctcacaatggaaatgcagtatcaaaatctagaatcctattgttttattggcttttgaaattgaaaagcatctgattcatcccagatatttatggactagcaaactatactggttaccattcacactccatctgagagacaaagtacacattgacatatatggtcagttctaggcccagttgtgagacagggtaaggattgtcatgtctatctcccccgtggtcaccattttttaattctacatgttgtgacttgtgttattacagattaatgattacaaccgtatggttggaaagtgtctgaaggtaggagtgcctttttctgatttgctccaagtcacggttcaggcttacaggggctatttcccttgcaggatgttctattacctctgggtgccctgagttctctttgactcttaggttaatgaataacctcaaatgaacacagggaatatggctattttgatgtagggatgatgcaacctacaaaatgtaggtttgatgtacggatgatgcaacctacaaaaaaaaaaaaaagaccattaaactttctgcatttaaaaaaatatttccaaggaatgtacaaagcatgttacttgggagaaggacacaggcgtttcatttgcatacatatttagtaataa

SEQ ID NO: 125759 - DNA, 346 bp, Homo sapiens
aaccccctcccacccatccccaatccgaggtgggaacttcatgttgaggaataaggggaggcagtacagcaaaacctcattaatccaaacccctgtggatttggaatttcttcataatctgaagaaaaactgagcttgcattttcctttatctgtgaagaaaaggtgtactaagcaaattagtggtggaaatatgtctgtaggaggggatatttaacccataccagaaaacagacttttgaatcctatctattcattaatgcatgctccctgaggagtggaaaaagccttgttcatcgagttctgtatatattttgaagacatgcatttcattaaatagacactgt

SEQ ID NO: 125760 - DNA, 413 bp, Homo sapiens
ggcttctttgtatcatccccacccgcaaacgggattgtaagcctcatgaggagaggcggttggctactgaaggggcacagatctgggttaaaatcttgtgtccactccttaatagtcgggtgaccactctgagtcgtggtttccataacggaagggcaagggaaacatccttgacaggaaattaataagatatgagaatcaaatgtgaaaaaatatatgcaaaaaacacctcctaaaggtcatagcttataaaaatgcccagttttgtcatgtcccttgagactgggggattaagtctcatcactgatcccttccggggtcttacatctagaagcgggtctgagactgcttattggattagcagcagcagccatcagccaatgagggaagccaactctttatggaaaggaatg

SEQ ID NO: 125761 - DNA, 579 bp, Homo sapiens
attgtatgtgtttaagactctttttttttttgagacaggttcttgtctgtcgcccaggctagagtgcagtggcaccatcagaggctcactgcagccttgacatcctgggctcaggtgatcctctcacctcagcctaccgagcagccgggactacagatgcatgctaccacgcccagctaatatttgtagagacagggttttgccatgttgctcagcgtggtcttgaactcctggactcaagtgatctgcccacctcagcctctcaaagtgctgagattacaggcatgagccaccttgcttacccttgttaactggttattcctattcacttaatatcttctgcctattttttgactgagtgcttgatcttttatgacttctatttattaaagaaactagttctttgtgttttttttccctctagtttgtcatttgggttttgattttgtttatgccttgcacttgtagaaagtcattttggtgtatttgaattattaaatgtttttctttatgccttctgggtatgacgttaaactctgaaaagtcttctccaaaacttaaagtttcttccacggtttc

SEQ ID NO: 125762 - DNA, 505 bp, Homo sapiens
agcagtggctcacacctgtaattccagcactatgggaggccaaggccggcagatcacctgaggtcaggagttcgagaccagcctgcccaacatggcaaaaccccgtctctactaaacatacaaaaaattagctgggcatggtggcaggcacctgtaattccggctactcgggaggctgaggcaggagaatcgcttgaacccgggaggtggagcttgcagtgaaccaagatcacaccactgcactccagcctgggcaacaagagcaaaactccgtccccaccccactccatcccaaaaaaaggtaagagacatgccgggctgggtatatctgctaatgccagtcatcctagcactttggcaggccaaggtgggcagatcacttgaggtcaggagaattttttttttttagtttttttttttaaaaaaagacaaggccgggtgcagcggctcacgccgtaatcccagcactttgggaggccacggtgggtggatcacttgaggtcat

SEQ ID NO: 125763 - DNA, 404 bp, Homo sapiens
  misc_feature (17)..(17): n is a, c, g, or t
  misc_feature (28)..(28): n is a, c, g, or t
  misc_feature (40)..(40): n is a, c, g, or t
  misc_feature (79)..(79): n is a, c, g, or t
gctcaggggaggaaccnagtgaatactnattatccaaganactcaagagctcattttagttctcctgattatgatcttnaaggcattaagcgctcaagttaaactccttctgccccgctagccgtgtaaactgagtaggtacttgtaaatgttcattgaataagtacctgattaatagaatttaattcaagaagaatgtattgatgggcctgtgtggtcaccacagtactgagatgtaggtgggagctggctgaagggggaggcacctaaacaggagcgcagacagcggcacctacggatgatggcccgctccatcccaccgcagcgaaattgtcccagacctctgcagctccccccacacctagactgagagagagctcttcttccttctgtagggagcaggt

SEQ ID NO: 125764 - DNA, 419 bp, Homo sapiens
actgaagcaagggaggattttggtgtgtgtgtgtgtgtgtgtgtgtgtgtgtgtgcgcgcgcgcgcgtgtgcgtgcatgtgcttgtgtgtatgcgtgtgtgtgtgtgtgtgtgtgtatgcatgtgcacgcatgcagcactgcgataacggggcagggggagttaggtgattgcttaaagcacaagtgtgtagggaagaaacaaaggcaggaggggccattaaggagcctgtagagtgtttgggtcgggggctcacatttgtacagagtgagctgacagtggcctgagtgaggaggagtggggcagctgtaggtggggcagttctagtaggtggccctggagagcatgagagagcccttgggtgaaggctgtcaccaaggaggacaaggtctggggctggagggccaggctgttggacgc

SEQ ID NO: 125765 - DNA, 170 bp, Homo sapiens
atctgaaacaaactgataaacctagagcatgtgccggaggcagattaattcttccactttaattttgcctggtaatagcatccaagctagtgaaacttggccttcagtcccctagaaggcttgggacccttggcagcgaatgcggggctggtaatgacacctgaaatggg

SEQ ID NO: 125766 - DNA, 567 bp, Homo sapiens
tcaccacagtggccctctacagagggcccagaggatcccttcaaaatagatagctcagtgcaccactcctctacttaaagcttccccaaaggcttcccccggcagttagaaggaaacacagggtgccttctcagggatggcggggctccaacggcatggccctgcctactgcctctctggctgcacctcacacccgtttacttcccccttcctgttctagaccttcacacgagtctctttcagaccacaatactctaccctcactgtgtggctgttggctttttcttaccattcaggtctcaactcaaatgctacctactccaaaaagtcttcccgggctaccctagtcaaacactctctccctcaatcaattattgtggttcccaaactaagtgtcaaggtgtcccagggtaccatgggatatttttaatttgagagaaacacagggatcgtcgatatttatcagacacagagacaaaaattaaaaacaaacaacaacatggtgattgtcctcaaggacctaacaatgtagtgtaagagacagatgtgtcaagacatatagctggg

SEQ ID NO: 125767 - DNA, 237 bp, Homo sapiens
gggattacaggtgcgagccactgcgcccggcctgtagtggttaattcttaatactttgggggtcacagactcctttgagaatcttacctaagctacagaacctcaccacagaaaaaagcacataatcactttttttatcattttgtgaatatttcacattcatcatgataatttcacctggtcaagtggatattaaacgataagtaaaggctcatatatgtgtggagaactagtgca

SEQ ID NO: 125768 - DNA, 465 bp, Homo sapiens
ctcccatgaattgtatgataaattagatgagcccaaacaaaataaactacaaatgtcaggaattgtgaaggttaaatattctgggtaaggaaggtgacgtaaaacttgtaacacataaaaagatattcaagagtttgaagagtatagcatcaaaaacttaaactactctttgggaacaaattcaagagaaaacttctatagtatgctaaaattctaaattttcccactcttcccaatacatttcattctagtcatgggctcaaattatacctcaagattatgaagacaagacatcagcaatcatgttactgttataaaagtcatctccatgagtgccctgagcctttcttcatggctaatcagaactgctaccctaacaggctgcgaaaacatacagtttggctgtgtgtgtgtgtgtgtgtgtgtgtgtgtgtgtgtgttgggaggagggaaggggaaaacaag

SEQ ID NO: 125769 - DNA, 765 bp, Homo sapiens
gataaaaatctacatctaaataaatctgaaagagctctttcaataacatgaaatttaaaatttaagtattaacaaaatatcgtgtcatattttaatttgcaaagggaaacaattgactctttttgtctcttttaagaatatgcattatcacagataagacctgggccccagtcctttttctagagttgaaaatcagaaggaatatcaacctgcaaaataatgaaaatgtctgcataaatcgagtcagaaaaaaaatagaacaagatataaatttgagttaaaggtgcccttgggtgaaatatacaagcagcatattcttgacttttgctccctgtagtgtcccccaaaacactctggctcacatatgagaacattcaccatcgtttcagctctaatggtgaaagcaaggcacactacacagcttgaatgctcttttctatttgcttcttgcacctcataaatatgttcaagcattcaaattaaattgtatctaaggcagctcaacccaaaagataatattttctgctctcacagggcatttgccctatttattccagaccacattcaaggaaaacatacttctcttagcattttcttattttgctggaagcagaacgtatgtaaaggacaccaaacttaattagcgcattaacataatcacatcaagtgtagacatagaacttgacaataggaaattgagtaaatcagcgcgaatgttttcagccccgtgctttataattaggggaaataaaaggatagcttaaa

SEQ ID NO: 125770 - DNA, 690 bp, Homo sapiens
gagtagaaaacagaattaatatttggcgacaccataggacaaaagtgatcctatcaaatagactccaagtttagcactatacccttgagacaaaaagcaatgaagtgtgtaagacaggaagtggtgactccagtttaatgctaggttgtgaaccacaaaaggccacgataagccaagagaggccagggatcatagttgagaaggaggggcaggaaccctgcaaatcattattgatatagtttaatttggtaaaagtcctgctgggtgtggtggctcatgcctgtaatcccagctgctcaagaggctgaggcaggaggatcacttgaggccaggagtttgagaccagcctgggcaacatagcaagactccatctcttaaaaaaaaaaagtgttaacctcttggtataacatatcaacatttattgagtgtccagtatgtttaggactttgtattggctctttagggtgcagttattacccatgcctttggagagcttgtagtctaatattagagataaaatacatacctaagtaaattacaaggcagaatgggatatttgtccttagaaagctatgaagtattacaaaggttagaagaggaagatggcaagaggtcacatagtggtagcaggaagagggtgtgtaatcagaaaagagctcagaaaaaagaaacatttcatttaaagaatgg

SEQ ID NO: 125771 - DNA, 150 bp, Homo sapiens
tgtttttgagaatgttacatgttaacctgtctttaaagtatttgtatttgaggttttgagaaatatatctattttatttatttggggagagttccataagataaacatcacagctagtaggaattctcaatgtgtttcccagattcaagg

SEQ ID NO: 125772 - DNA, 482 bp, Homo sapiens
ttgatatactctcttcacttggctttcatgccactacaggctctttttttcctcctacctgtctggatgttcctgtgtcctcttgctggttcctcctcttctcccctaccttttagcgaaaagccttttgacttgttacatggtcttctttatccactggtggtcttatcctgccccctaactttaaatgtacaccagttgattccaaatttgtatctctagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttca

SEQ ID NO: 125773 - DNA, 262 bp, Homo sapiens
acaatatatgcaacatatgactaacaggacataattttctattgaattttaggagcttaaatcaatttctgcactgctgatcataattttaaatggtacaaatacactttgggaggttgaggttggtggattgcctgagctcaggggtttgagaccagcctgggcaacatggtgaaaccacaactctatcaaatatacaaaaaattagccgggcatggtggtgcaggcctgtggtcccagctacttgggaggatgaggtgga

SEQ ID NO: 125774 - DNA, 450 bp, Homo sapiens
tcctcataagctctcacgcagtggacatcagcatccagttgtccaagtcagacactgagacatcacatcgcctcctcctccacagtaaccactggctgaggacccctcattcgccctcacacacatatcttctagaactgcccactcctctacctcctcgccccagcttcctttatccaagccactgtgtctccttggtctactaaaaaagctgcctaactcatccctgccttcaatctttccccgctcggatccattctctatgttttccgaaacaaatcagactctgactttcctgcttaaaatccttcagtaacttcccattgcccttaaggtcaagcccaaagcccccctaataacttctaacccaaatgagaagtcataacacacacttctgttgcattatctgccagacattgttctaagcacttaacatggattgtctcatcc

SEQ ID NO: 125775 - DNA, 397 bp, Homo sapiens
acccccattaggaatcatcacactcaggctctggagaggctgccaacagaagggatggggctccggcattacagagctcctctctacattccaggctttgacccatcacagtctccaatgaggaagctggggcccacagaaggtcagccacctgcctgagttgacacaagaaaaacttggtctctctggcaaagatccagctcccttgggaagcctgcttgttcaccccacagctaacaaatcgggaggcctcaaggaggtgggcagggtcagtgcgggtctcattcctgccagccaggaacttaccccagaggagcagacctccagccacatccacacacccctgacccctctgcccaagtctcctctgaaggtgctgaatcatcagtggtgccac

SEQ ID NO: 125776 - DNA, 182 bp, Homo sapiens
gccatcccctctgtgaccccggccctgtgccagatctgggcaaggcagcccggagaccttgccgtgggctttgcagaaggtgatcagtaaaccagaggcctggaggctggtaacagacctggttaggccagggttctgttagcaagttaccacgttctgttggcttcagtggggcagcaagg

SEQ ID NO: 125777 - DNA, 740 bp, Homo sapiens
tggggtgtggggagtgtgtgtgtggggggggggggatgtgtgtgcatgtccatgtgtgtggtatgtaaccagtgagataactgtgccttcaaacaaatctattggcaccgtgaaaggatgtaggaattcaaagaactaaaggctactgtaatggttcaaataaaagataaaaacctggactaggccaggcatggtggctcacacatgtaatcccagcactttgggaggccaaggaggtgggctgatcgcttgagcccaggagctcgagactagtctgggcaacatggcaagaccccatctctacaaaaaatataaaaattagctgggtgtgccatcagatggccaaatcattatttactggaccagaccttttcaaaactatcaagcagatagtcaaggcctgtaaagtgtgccaaagaaataatcccctgcactgcaggccatacatttcaatccctctatctttaacctccttgttaagtttgtctcttccagaattgaagctgtaaaactacaaatcgttcttcaaatggagccccagacagtccatgactaaaatctaccacagacccctggaccggcctgctagcccatgctccaatgttaatgacattgaaggcacccctcctgaggaaatctcaactgcacaacccctactacgtcccaattcagcgggaagcagttagagtggttgtcggccaacctccccaacagcacttgggttttcctgttgagagggg

SEQ ID NO: 125778 - DNA, 148 bp, Homo sapiens
ggaatgacagcctgtgccaggacattgtagcttgtggatgcctactcttttcaagtgactcatcggtacaggttaatattttgagtaaatctttcggaattaaattcagtactgtcaacaatgagaatctggctagtttatgtagagc

SEQ ID NO: 125779 - DNA, 1233 bp, Homo sapiens
taggagaatgcatttcagttctgggagctcataatcctgtgattcttttattttaagttttaaaatacattaaaattttactggttaatcataaaatattttatatttgaaaataggatggcaatctttatttttccaagatatttgttggaaaaaaatgatcgttggtattattttttctttcagctatattccatggtatctttaaaattgttcagaatataggacttttactaaaaaaattcaattgtcagagtctaaaaaaacaatgtcctcaggaatacttcagaaatagaaggtatgcaatcccttagtggggggcaaacacatttcagatttcgtctttatttaaaaggatcttcagtctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcgtttgtaacctgatcgtattatgtttacagctgaaagatttcatctagacatgtctttcgtccttattattcaaagtgtaattgaaagagatatttagtatt

SEQ ID NO: 125780 - DNA, 684 bp, Homo sapiens
ccaacttgtgtgcctgattttctaaaaaactaggggcatctcaaacaaaactaactctaaagtgattatttattcccaagagacctcttatattaggggaagactaccaatttacatcaaactagattccgaagggcattttcaggatctgtacttttcattttaatataatataatttttaatatataagtacccaagaacctaccctaaacaaaatctgggatcttgacagtaatctgtctttatacctcaccaacctatctctctgcctacccctatttgaactaatcatcattctggaccctatgtttctatttgcttgcttttctttttatatagttttattgcatctgtatgcattctctctctctctctccctgcccccttgctgtttttaactaaaaaataggggattgtgttgtttataatcttttgaagtacatttttaaaattcagtattatactgctcagaatcatccatattgttgcatattatagtcattcataccttttgactgctctgtaatattcaatgtgtgaatataacagcttgctatggcttgaatatttgttctttccaaaactcatattgaaatttaatccccaatgtggtggtatttagaggtggggcctttaggaggtgatttgcagtagtatttctgtgcataacattcaagctgaga

SEQ ID NO: 125781 - DNA, 161 bp, Homo sapiens
ctgacaaccccgtctcatattccagttctgctttatttttgcccaaaagtaaattccgtctacaggattttctagaatacaagctccatgaggaaagggatcttatctttctggttcacagctgtattcccaggacctggaatacatgaggagggcaggtc

SEQ ID NO: 125782 - DNA, 838 bp, Homo sapiens
  misc_feature (365)..(365): n is a, c, g, or t
ctagaattagaggttctagtcttaatgtccattatattttaaacattaatgagttatatgtttttaatctggacaagtcagtggcctagaaattcagggaattgttagaattgaaatttcaattctctatttatctgttaaagggtttctattcattttcagggggaaaaaccttagttaagatcataacactaaatgtaacaatgtcatttgggttccagtccgtgagttgtaggagaaaggagtttgccgtccattttttttttttttgggtaaagtccatatcctgggaaaaagggagagggaggaaggatattggggacggggtaggatgaaacattttggggagaagatagaagttgganggggaacaccgggaagaacagaagtaggggagggcgaagaaaaagattagagaagcatggggaatttagaaagataaaacctttcctttagaacgaaacaaggataattttaaccctgaaaggttaggaggcagaagaacaaggcactgctgggaaacaaaaggctagggcaaatggtactactttgagaggaaactgggggatttgacccaggttggaacctggcacctttgggtcagacgtttccgacttgaaagtgaacatcacgcttagaccaggttggagaagtttagcaagctaggaaaatttaagccaaaagttgggtaaactaggctgaaaaacaacaacaaaaaaaacttgtggcggccgccgaagtttcaacctggtgggggcgcccagaatgatgtatgtgtcagaactgaacagttggtcccaaaagcggggggggaaaccgggggtagtacggggccacg

SEQ ID NO: 125783 - DNA, 680 bp, Homo sapiens
cagctaagcacattttctacatccccaaagtatttggaatcacagcattgtaacttgtgattgtcttacctgtaacagactccacagtcatgctggcattgtgacctgaagaattacacagtgcccttcttagattctttggggttaaggtaacttcttgaataatgtactaatgaacgatagtgtttcaggaaacatgccctagctattggaagttcgtatctaacttttaccccttgtgtgtcatgatacatttaagttggtagctacatttttggaataaaggaaatgtaaaattatttgcagaataataacctgggatttgctcttctgcctaaacatcgaactagggaactttaaagacaaagggtgcatcttttgtgcaagtatctaagcgggcaaaatggggaaaacatgaagggcaagtcctttggggatgacttctaattaatgcagaagtcatttgctttggccaggttgggtgggactctgagattgcacactcttgccctgttggcagaaactagcccatcttaagttagtcaatgaatcctgagtcaaaatgaaaggttgctaaatctaagatcgagtgtataaataaaataaccccttcctccagtgactgtgcatttattttgtaataaactcattttggaatgttttagcaatgaattggtatc

SEQ ID NO: 125784 - DNA, 290 bp, Homo sapiens
ttcctttcaaccgcatcttcccacgtagctgtggacacaggcacaaggtatcacatcccggctaatttttaacttttttgtaaggacagggtttcaccatgttgcccaggctggtctcaaactcctggcctcggcctcccaaagtgctgggattacaggcgtgagccatcgcacccggtctcccctttgttttaagagttttacagtttttggctcccagtatttttataagattctctccacagttgttaagttcccaactttaattttgagatctaatctctctagga

SEQ ID NO: 125785 - DNA, 548 bp, Homo sapiens
ggcttttctgctatttttaagatttgttaagtcaggcctgctttgcatgggagctccacctccacaatagccactttctccttgggatctgacttggatccccacctcagcattgtcaaaggccccgtggagcctctgaagctctccctcctgtggccttttgagtctagtgcctgtgctgtgcatggctcatcacgctccataagtatttgtgaaatcaaaatgtctccttcttgcccaacacacacccatggctcctcacagcccaactcccctgctgtaacccatcagccaatccagtcacattagacctcttgcatcccctgaaaaaactctatgcctttcctttgcctaaaatgcccttctcccccttcacccactgtctcattcctcaggacccttctcaaaagtcactccatcaaaaagcctttcagattccagcaaacacaagggaacttccgcttatccccattcctcaaatcactttgattgtgaattaattaattaattaattaatttatttatttattttgagacggagtcttact

SEQ ID NO: 125786 - DNA, 351 bp, Homo sapiens
ggtttaaaatgcattgcggtccacttctgcccgcagttccttcttccaggaaaatgtgaaactaacgatttccatgatggcttctggccaggcacaggagctctatgggctgtccctggactccaggagccagggaaaacaaagaggatttccagccattgtcctctgtagcactgagcatcaacaccactgttaatttcttgatggtatcatttgcagcatgaaagttcttaatcttgatgtaatccaatttatctattagttattttgtcacttgtaccttcatttcatatctaagaaaccattgcctaacccaagtaaatgaaaatgtacttctaaattttctccttg

SEQ ID NO: 125787 - DNA, 339 bp, Homo sapiens
cactgtctccacgctctacttgcgtaattcaaatttagaaaagtcggcattccacgggcagcgtcctaactctcacgtgcctactggtcctttccggtccgcagggggcactcagcgggccgggtgtgtgcgaggcctctgcacctgctgtttccctggcctgcgatgctgttcccccaagtcctggcggggctattccactgcaggacacccatcccaacaagccacatgtgaagcagccccctgcagccattcccccacccaatgcagtacagggcaaaccgcttctcactcttcagaatatttttatttttgttttttttgagatagagtttcgct

SEQ ID NO: 125788 - DNA, 231 bp, Homo sapiens
caaatgtgtagtatagaaataatttttgtggtcagaccacaataattttgtggtttcttccactgtcaatactattataaggaaaagtgcctgttcgcggatgggaaaatgagattggcctaaatataaatgaatgttcatggtcttagaggttttacctcttcttctgagttgatttgaagaaaaagtcataaatgtctgctttttttttttttttcctctgcaggggtt

SEQ ID NO: 125789 - DNA, 117 bp, Homo sapiens
cttgagccagtccctgaacttcttggtgctcaagattcctcccctgttaagcggtgctggtcattcctgccatgtggtgaggatgtgtgcgttagcagtggtgacatccagtgcctg

SEQ ID NO: 125790 - DNA, 488 bp, Homo sapiens
tatactgagtcaagctacttgaccaaaacatctgatttaggaaagcacttagctttatagcacaagtttttccatctacagttactatcttcaaaggaatatacatcacaatgttgacaaaaaaaaaacctcctggttccttttgaataatgcacaataaattcatgatgttaactccatggtgagtcaaataggtaccaaaaaaacaaaaggaacaattacacacagttcagtaagtatcattttggttttctccatgtataaattaaccaatgaaataaaacatatcaactatagatgacttgatttcaggaaaaccacatttcaaaattacaattacattatttcctcatgtcatcttcagtcattgacaggaattttgtaggccaccatgctatttactttgtggattgtagtagtaaatgaacaaaggcagacttcctcagaattggtaataaactgtggtcccgactcttcccatttttcag

SEQ ID NO: 125791 - DNA, 342 bp, Homo sapiens
aagatctgccttgtggcaagcaggatagggagcattgtaaaatactgattcctgagtttaagatattacgataatatcatggagaaaataacatggagaattagagcacagttagatgctaaattatatccagaacagggagacagagaagaaaaaaaaagaacactcacagtttactcttccatcctctgagactagagcactgattctgtcattgatcccagatcctaccttaggatatatgaagctttgtaagattcgtaagctttaggcaactagattacactaaagggcctacacttttaagtcagcaaggctgctctcatttataggctcggcttt

SEQ ID NO: 125792 - DNA, 371 bp, Homo sapiens
ttcgagctcggtatccccttttggggtctttgctccattgatgaataactgaaattgcaagagaggttgggaaatgtaggttttagctaggtgtgtgtatgtaaagcttaggggtactattactaaagaaaggaggagaggctgggtgtagtggctcatgcctataattccagctacttgggaagattgtttaagctcagaggtttgaggcagcagtgtgattgtatcactgcacttcagccaggactgagtgggatcctgtctcaaaaccaaccagatcaggaaacaggcttttcaaggaggtaaaataagctactaaagatcatacctaagaagtagtagaatgggctttgaatacctttctgatacaa

SEQ ID NO: 125793 - DNA, 399 bp, Homo sapiens
tagccagagtagaaacaacgcaaatgtccaccaattgatgaatggttatgcaaaatgtggcatatcctacaatgtgtattatttgcaataaaaaggaatgaaatacatggatgaaactgaaaacatgctaagggaaagatgccaatcacaaaagaccatacatttcatttatataagatgttcaaaatagacaaatctttagagacagaaagtaagagactgaggcaatgaaaatgttctaaaattagacagtgatcgtgagggctgcacaactttggatatactaaaacccactgaatggtacactttaagtgggcagattttgtggtatgtgaattatatttcataacactgtttacaaaatacattttaaaaatacaaaaaagaaaagaaacagag

SEQ ID NO: 125794 - DNA, 579 bp, Homo sapiens
cagtacggatgtggacggtactgctacaagtggcatctgccagactcacgagcagcaggtgtcacgctctggggaccaggtgctaacctgcccctgggatctgcttggagagagtcaattctgcaggtagggagtgagaagacgtgcattcataaggaagggttctgagtggagaaccctattggcttggcggggagcagtaaaagggtatattggcagtcatctaagtcctgagctgtgcttgttgccagaggttgtgggtcagtgctgtgttaactatatttggtttggctgttgtgtttttattcattcctttggtgcctctatacctatcttcatctccgaatagctccagtagattcatcccgtgaaagtagctgtggttccttgctgtggctttgctagttcatgctgagctacttcctggtagaattgtgctgaccatttatattcacaacagcaagggtgaaattgcaggtttgctcttgtcgttgccactaaatattacaaatatcaaaagtaagtcataatctgtagttatttatacttttatatttgtttttaaggccttatttttta

SEQ ID NO: 125795 - DNA, 123 bp, Homo sapiens
tgctggtattacaggtgtgagccactgcacccgcgctagatcattgtttttatcctgtattatggatgacaagcagcttgtagtagagtagggaaagtgttaactttgattttttcccctcta

SEQ ID NO: 125796 - DNA, 731 bp, Homo sapiens
tgagaatttcccttagccatcagaagccatttcatcttgaaatgcctgggaggtaatttcttcatcctagtactgtccttatccagccaataatggagtcataaaagtgtacaatattctaggcctcctgcttcagtttttgaggacacaatttaagctccattacttacatctggagagctgcgtgtctttttatcactatcctagagtaactaatggaaacagcttcaggaaacagacttaaagatgggtttcatcgattggattgaaaatatatttgagagcattggagatatcattcttgctgtgagagatggaaataatacatgttgtgtgttggcaacatggttattcaaataattactggtggaagcatgaaataaaagcaggatgaagagagaaacccaagacagagagcaggattgaagatgaatctgcataaacaaactatactaaaataacccctgtcctactccatttgtgctgctataacaaaataccagagactgggtaacttataaagagcaaacatttatttcttacagtatgcaatctgcaaagtttaaaatcaaagtatcagcaaaattgctgtctggagatggctgctctccacttccaagatggagccgtgttactgcatcctcagaaggggagaaaagctgtgtcctcatgtgatggaatggatggaggggcaagaagtgtaagctctttctgaagcctctttcataagg

SEQ ID NO: 125797 - DNA, 2088 bp, Homo sapiens
ggcatggatgatatgaggtaataaatgctttgaaaaccatgaagggccacacaagtgctagtgttattgctgtgggacaaggtctgggaatatgagaaccagcagcagcatgggtgcagctgagaaccagatggtgaacatctgtctccaaagtgcaacattcctgagcaccggatttataaggcatttcttactcgacagaattgacttcatggaaggtatgtagtttgactttgccttagccatgttgatcaaataggagtattgtgcatgccgcagctagacagagtcctgggccctttaaaaaccttgtcagtgactcccattgcaggcccagcgcagtggttcacacctgtaatcccagcatttgggaggctgaggcaggcagatcacttgaggccaagagttcgagaccagactggccaacatggcaaaacctcctctctactaaaaatacaaaagttagccaggcgtgatgttgggtgcctgtaattgcagctactcgggaggctgaggcaggagaatcacttgaatccaggaggcggaggttacagtgagctgagatcataccactgcactccagcctgggccacagagaaagaacggtgattctttctagcagaaattagcagagtaagtgtttttggaacaattgctaatgaaaagaaggaaaaacagaaaaaaaaaattttctgtttatgggaggtgacttatttctctatcaatcctgtgagtgatttagcatggcaattcatgaacactgagttgtttccttgctctgattgtctgttgctcaatgaaatggcttttagcagggctcaaaggtgaagccagattctcctgcactaataggataagcatggagacaccagtgttcagtgtggcctctggttgtctgaaattttgctgtcaactctaataccttgaaagaattaggttcccagggagggaagaggggcgacagatatgcagctacacaatgtttttactatcttgagttctttttacccagattccatagctaaatccagatgtattaataggtagagactacttcagaaaggatgagactattttcttgcttaattatccacacagtaattcagaaatgtatattgaacactttttatatgccaggcactgctgggcactggaaatataaaagtaagcaaaaatgaaaaactatcctgtcctcctgaggcttagcatctaagggagacaggcattagtcaaccccgtgtggctgtgaatcagccatgatgctgagtgctacaagagaggactgtgcggctgggagggcttataacaggatttgacctagttagggaagatctgaggaagtgatgaaagaatggaaatcaatatgtaagagctcacaagtcagagtgagatgtttcttcctatactgcctgcttctaatgagcatccacttcattgaaccacctcttcattgagccaaacctaccatacagggatacattctctggaggaaagttgagcaactattgcatttgggacattagagtatgggtgggctgacaggtatgtgtatgtttattatccaagacagccaaggtgtttatcctgttacaacatcccagaggacagaggctcttatttgtgactcttttttcttacctgtaacaccagaggcataacgtacatcataatgctgcatcttgttgacgcttcaatgctcacaattcaaaggtgatttctgaagcactttgttacactggggacagctcctaaatcctcccactcttttttttgcctcaccttggagtcttgggctctgttgatcactgactctgccaggtctttcagcaggcaagacagctcagttaaattgagtttggactccactgtagtgcatgcatgagacagcacccccaatccccaacacccacacacaaactttaaatatttgtaacagaattgttaccattaatattgcttaaaggctaacacattagccagaacctagatgtcttctggaaattttttattgcaatgttacttcatctacataaagttgtccaatcactgaaacctccaactgaaataaatggtaagctttttgttctc

SEQ ID NO: 125798 - DNA, 360 bp, Homo sapiens
taatagaaattcagaattcctaggcatatgacctagactaaaatgtcttcataactacaaatgaaatcagggtcatttatagtacaaactaccacagaagtcagtagttaggggatggagatagatatgaaaaaaaaaaaaagcaaacccagcctaactcccagggagggaagaggggcgacagatatgcagctacacaatgtttttactatcttgagttctttttacccagattccatagctaaatccagatgtattaataggtagagactacttcagaaaggatgagactattttcttgcttaattatccacacagtaattcagaaatgtatattgaacactttttatatgccaggca

SEQ ID NO: 125799 - DNA, 223 bp, Homo sapiens
ggttaaatgttatttgtaatcactgagagaggagttgtaaaaatactcccgcgatgcagatgtggaagaaggactggaaagaatcaggagtgcagttaagaggctgttcaagtagtttaggggagaaataatggcgccttctactagggtggtgacattggagatggaaaaaagggtgctgatgtgatgtgatggctattttaggtaatgagacaggatttgg

SEQ ID NO: 125800 - DNA, 631 bp, Homo sapiens
gcaaactataacctgtgagctaaatctggcctgccacctagttttgtacagcctggaagctaagcatgatttttacattttaaatattatacataaaaattatacaaaattcaaatttcagtgttcataaataaagttttattagaacatagctacctacactcattcatttacatattgtctgcggcttctttgttaccatgttggcagagctgagtactagcaacagagaccatatgctccacaaagcccaaaatatttactatctgcccttcacagaaaaagtttacctgcccctggcttccaacgtgttcaatttttaatgttttaggtgttcttgaaaaaaatctgtactctccagataacatatgcagggttttatatatgtttattagattaatcttactgactgtattacacaaatttatatacttataacattttgtctgcttaatctaccaaatactgagaaatgtaaactaaatttcctactttggcagtggatctgttaagtttgtattttttgtttgtttgttttggggctttttttatagttctgtcaattttactttataaattcatagtttaggtaactagaagcaaataagtttagaattgttatctcttctca

SEQ ID NO: 125801 - DNA, 1092 bp, Homo sapiens
gtaattgaggcacctgtatctagtttgggaattaactgtatttccatgaggaaactggcagggcacagtgtctcatgcctgtaatcccagcactttgggaggctgaggtaggaggattgcttgaggcaggagtgcgaaaacatcctggccaacatgtcaagaccctgatgcatgcctgtagttctagctacttgggaggctgaggtgggaggctagcttgagcccaggaggtcaagactacagtgagctctgattgtgacacggcacagcagcctgggcaagcgaacaagaccctgtctctaaagaacaaaacaaaacacattgtgagatggtgaataagataggattgttcttcatttctcacaaatgcccttctattttaaatgcttcctagtttcattctgtgtgacagtgggcaaccctttctttctggatgaaacatttcaggccatggcactctgactcaaacattcccatgtggtagggaatgtaattaaacatttttattatttatgtaacttatgagacaaaagtctcaaaagtttattttttcttgtaacttttccttgtccttggggtatattcaataatagttacttgactaataaaatctcagagtaaaactctttaaaaaattgagctagattccctggaaactttccacaactattaaattttattccaatggtttttctcctgcctcagcctcccgagtagctggaattatcggtgctggacaaagatcagaccagatgtgaggaatgctgaaaatgaaagtggaataccaacttcatgtacacttggcttattcagcacccataaaattcaatggaccaccatccggacaaaaggataaaaacagaacacatcaagataatgaattttcttcaaactactgaggtacaatgaaaaatggaaatattatctcagaaattacaacagagggatgaagatatagcatatgctgtacctaaaagatacatcaaatgggacattgggaatatggattgatgaaatttaatttgcgattgtcctataatgccttttcattacagtaccacacaaattgaggcaataaatgtatatttgacc

SEQ ID NO: 125802 - DNA, 466 bp, Homo sapiens
tcttatctgatcctcacaaaaacccctaggaaaaagaaagggcagatagggttcattgttgataatggatgttaaaggggctatgcatttttaaattattattttcattttgcagatgaagaaactcaggctctgggaagtagctaagatgtctaagctccgaaccatactctccaacttccacgtccagcgctctttccacttcaaaatctttggtcattccttattccttgggtaacgctcaggccaaggtcggagggataagaaagtcagtagaggctgggagcgtggctcatgcctgtaatcccagcattttgggaggccgaggcgggcggatcacctgaggttgggagttcgagaccagcctgaccaacatggagaaaccctgtctctactaaaaatacaaaaattagccgggcgtggtggcccatgcctgtaatcccagctactcgggaggctgaggcag

SEQ ID NO: 125803 - DNA, 667 bp, Homo sapiens
gggatgacaagcaattcttcccatcttcccttaaaaccttggcagaggttaatgagctagttggtggaatatattttcgttacggttgatagcgagagaacttgctgtcgcttcctaattagaaggtactgattacattctctttaccaggcaaggagttgttctctcctggattctgacttttctgattacttaatatttccagaattcccatgacatgctgtaagcagggaaaaattgaatctccaagacccacttcttgtatgctagtagcaaatgagatgattaaataagacatagaccttaggtaagatggggaatttagcagaagacaagttcatgcttgtgtgtaagagtgtttgccactgtgtttatcgggaggtggaggagcaggtgcaggagggtgttggccaggatgtgggggctgtgggtcactgtgctccactcaaatgaaggcttcctgcaggctggtgcttggcctgatactggggaaggagcagaggaaagagcagaatgggaagggaaaacatcatccctctactatttttataaccaaatcgacacaactatttaggttgttccccaacctttttcctccgacccctaaaaacccctcctaatactaactacctgattcttaccccttcacatcatggcagccaagcca

SEQ ID NO: 125804 - DNA, 459 bp, Homo sapiens
tcttttatttttcagttgcagatttttatgataaatattagcaatgtactactcaaggctcaaggaaagattagttacataatttttggggggggtaattgtttaaaataggctgtagaacaagcttgtccaacctgaggcccaggacagctttgagtgcggcccaacacaaattcataaactttcttaaaacattatgactttttcttgcgtttttttttttgtacctcatcagctatcgttagtgtattttatgtgtggctcaagacaattcttcttcttccattgtagcccagggaagccaaaagattggacacccctgctgtagaaggcttcaatgagaaatcattcatagtgcaatggtctttttgttgtgacttctcaggatactttgagttaaaagattataaaaccagacagacagtagccccctttgaaaaaaaaaagtatgtatgcatt

SEQ ID NO: 125805 - DNA, 364 bp, Homo sapiens
taaagtgtatgggaggatgtgcataggttatatgcaaatgctatgccattttatatcagggacttgaggacccatgcattctgatattctgaggtgggggggtgtcctagaaccaatcccccgtggataccaagggaccactggacctaaaggcaagattcttgagactgaatgaggagacagaggaagcaaaattttaaataaacagcacatcgaatggtggcattgatgggacagtaattctatatttatagtgggaattactgaggaattctgtcctcctgagaaccactaagcagagccaggcactgagtaatttggctggggcatccttaaaggaaatatcccttgcacatcttccaat

SEQ ID NO: 125806 - DNA, 481 bp, Homo sapiens
taactgatagtaaacctaagtaaaattttctctgagttctgggaaccattccagcaaattaataaaatgtgaggaggccgggcaaggtggctcaagcctgttatcccagcactatgggaggccgaggtgggcagatcacctgaggtctcaggagttcacgacccgtcaggccaacacggtgaaaccctgtctctactaaaaatacaaaattggccaggcgagctggcgggcgcctgtagtcccagctactcgggtggctgaggcaggagaatcgcttgaactcaggaggctaaggttgcagtgagccgagattttgagcccctctcctctcccgcagtttctccccttcttccctctattccttcttttccacttcatctgctccatcttgcaatttttttcctcttgttgctctttctctccaatcttttgattgtctccaatctccatatatttctgcctctttcttctcccatctgtg

SEQ ID NO: 125807 - DNA, 351 bp, Homo sapiens
gggcgtctctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgatgagccca

SEQ ID NO: 125808 - DNA, 346 bp, Homo sapiens
cacgcctgtcccaggggaaggggcctgacatcttccatcggctgggtcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatggcatgccctccccacccagaggacctccgggcaatgcctgtcccgcctcatgctggaggctgcctcgggcacctgcctgcccattaaagactggtcagacctgatgagccca

SEQ ID NO: 125809 - DNA, 337 bp, Homo sapiens
tcctcgcaagtgggaacaggtggggcctcagaccctccaggccaaaccctggctcctgccagctgcccttggggcaggtccaggcagctgggctgaatgccagtcagggaggcagcaggtgtgcctccctgatcctggggtcccagggtgcccactcagacttgaccaagggcagtgcccccactgcgcccatgagccagagccatcctgcctgtcatggggccatgcctagcctctggcccagtcccagaccctggactccagcccctgagatggctcttcccctcctccccctgggcatggctgtggctccctggctcagctccagccccctgtg

SEQ ID NO: 125810 - DNA, 387 bp, Homo sapiens
ctaacaagctctagggagacaagaaatagagctatactagtctagcttcttccaacttagtgtgtgtgcgtgtgtgtgcatgtgtgtgcctgcaaatgtctgtgtacatgatgcacgtgtgcttgtgcacgtgttccacatgaggtgttttcactgtgcacgtgtgtgcgcgcctgtgtgtgtgcccgcgtgcaaacgtgtacatgatgcacgtgtctgcttgtgcatgtgtgtctgtgtgaggcgttttcacattgcggatgtgtctgtgcatgtacctgtgtgcaaacgtttatgtacatgatgcgcatgtctgtgtgtgcatgtatgtgtgtgtgaggtgcgttttcacagtgtgcacgtgagcgttttcacaatgcacgcgtg

SEQ ID NO: 125811 - DNA, 778 bp, Homo sapiens
tgtgtaaaacggggtagtagtagtacttgtctccagagttgatgtaaggagttgacataagggtaaaaatcgtttggcatgtggtaagcgccaatgtgtttgccattattattcaatctttgtttctaaattaaaaaaaaattccttccttctgtggttatttggacttattctgagtttcattttataactagaaactgaacaattgaaataaaaagaagagtcatcacatgctgaatttctcaaccaaactttttctgggaaagacaggattgtttttgtaaaataatttatatctgattattattagaattttaaaaatttgtgaagaaagaagaatcagtgagatgggattaatctatgtgcagtttttaagaaccttggaaattttcatgccatcgattgttagagaaatgcaaatatcattcagttgaaagactcttacaccattcattcatttattcaccactcattcattcatttattcaccactcattcattctttcatcactcatcattcatctatccaagccacaaacatttccagaatgcctgggacactgctaagctctcggagacaaagacaaataatttattgtctcagcatctagaaaactctaatgaagaatttgcttcattatggggaggaaaaatttaagtggccccaacagtcctcctgaaagctcggaacagggaagatagttcacctgtaagaaggaaggatgaataagaaatttcaccatttggcccggccaggtgggtcacacctgtaatccta

SEQ ID NO: 125812 - DNA, 350 bp, Homo sapiens
attcatcctccaggtctagttatgccatgatgtctcccagaagccttcatctgtgtacccccacagcactcagttcaggcctccattatagtacttgtgctatactatgtatttaccaatctgcttctgcaactagattataagatcccagagagcaagttcatgatgttgtgtccagagttcttttgccagtgcttaacactatacttagcagagaggaaacactgcaagtctgaagaatgaaaatgtaatgaatgaaattttataatgaatgaaataatttgtttatgagaggttgggggaaaaaaagagtcttcctaagagtcagagtgctttacaacatcaaacct

SEQ ID NO: 125813 - DNA, 291 bp, Homo sapiens
tggcattcttccagtctcatttcgaatagtgctgccttcccccaccctggactgcctccgaggcctgctggcccccaccgtttcttgagctcaatctgcattctgatgtgaccccttgttatcatccacctcatctcccaccactctccccttccttttctgcctctccagtgttccttgaagtgggctcactgcagggcctttgccctggctgttctctctgcctggaacactcctctcccaaatttctttatggctcaccctttcatgctaatgaactcaaaataccca

SEQ ID NO: 125814 - DNA, 563 bp, Homo sapiens
ttgtttgcagctgctgagaatcattcatgtggcccaacacgagggcatttcccagggcaggtataagatgagtgctgtcagcaggaagcaaggaagccgcaccacttaacagggaggctagtgcaggctttcacgacagtatctcatgccaggtgggcaccgctcatggggctctgtcatatctgacgatggagacggaccgttttcaactcagaaccaaggactttttggtaaggtcagacgtcttctggccaagctgaagccagaggctctgcaggctgcctactggaccaatctcagagaaaagaggaagggacaggaacagagtggcctaccaggaactctcaggcttccaaagagtgtcccaaggggcagcagcgtgggaggatgccctgcctctccccatctcctccttccagctgaagaggctggcccacacccacaccccgtaacgaggcagcagtcttcttgcttgcagccatcctcagagaaatggatctaaccatgttctccccaatctgaccccctacttgagatctgtccagacccttccagaaaggtgg

SEQ ID NO: 125815 - DNA, 310 bp, Homo sapiens
tgagaatctggagtttgaggtcagaatgaaagagagcagccctagagggagaaagctttggcccagggttcttagtctggaatcaactccttgtctttggatgtatccccgtgtagtctgtgcacctgtgtgtgtatttcaggggaagggagcagtgcatttaatcagattgtcaaaagagtctaagaccccaaatggttaggtacacagggttagtggtggacagtctgaaagaaatgaacctcacctgggctttcctctgttgtgccatgtcaccacacacccattcactactgtgtgtttgcccatt

SEQ ID NO: 125816 - DNA, 881 bp, Homo sapiens
tgtggctgcagcaagggtccgcctgtcaggatgtgataaggaggcacttcctcaattgttagagtacctttattttattttattttattttattttattttattttattttattttattaatttatttatttttgagacagaagcttgctctgtcacccaggctggaatgcagtgagccgaggttgcgctgttgcactccagcctaggcaacaagagtgaaactccatctcaaaaaaaaaaaaaggaattccagaagagtttccttacagagcctgggccctctgaaagcttgcagaattaaggccaatgggttatactcagttggaccaaagtcaaaccctcaggggaaatacggtaaaaacaaaaaagtctccatcccaaaggacaagggaccagcaacttcaacaagataagggaagcccctgccctcagcagttgagaaggaccagcacaagaagttctgacaattctaaaacccagagtgtgttcttacctccaaattgatctcattagtcccccagcaatggttgtgtattccaaaattaaagcagttgaaatgacagaattcagaatctgggtggtagaaacgctccatgaacttacggggaacgttggaaactccatccgggacaccggtaatgtgtcccagaagttggaatgattgcaccaaggcccttttaagaaagaaccaactgacttctagaatggaatttactagggaatcccaaatacaattgaatgcttattacaacgttcctctggggaagagctccgagtcaaaacccccctttattcatgcggggagcaaataagagaatttagatgaactccgaatggttttgagagccccattctgggttcggaaaaggcgcatctggac

SEQ ID NO: 125817 - DNA, 392 bp, Homo sapiens
cctgagttgcctctcaaagtgctgggattatagatgtgagtcactgtgcctggccccacatgtttttacactggggcctgaaaatcatgtttccaaaactgcccagcaccaacctgccagctctgggaattccagctcagcatccctgagcaccccaggtgaagaagtggagaaaggagggggtttctagagcaagtgtttacaaggagacagaaaattgaggggccagcaagaaagtggttcaagtgatcaaccgagaaggcatctaggatgggtggagtcagcaggggactgatgtatcagaggaaaaggaaagagtctgggatctgggggtcttacacatagacaccactagttggagcagaggtagaagtgtgattgcaccagaagga

SEQ ID NO: 125818 - DNA, 694 bp, Homo sapiens
tcattatatgccattatatgccttttaaaaattaggattagatccagagtatgggtaattgggtagagacaaaacacaatgggaagggcagtgtttccaggcatgcttatgtggtatagacctaaagcagattacagactccttgagggcagggacctgtgtcttatacttacactatatacctacagctaatattgggctcagcacccctgtaatcctgtcatttattggttactccctgcagataatcttttttgtatgtcatttctttaaacttcccagtaacctgtgagacaggtattattattcatattatgtagatgaggtaaccaagaaacaaagcagaactcccaaggtcagtattcaaacttcagtttctctgattttaaatcatattttcttcattataccacactgccccccaataaaaatagctgccttcatttggttttattttttaaccaaatatatattgaacctttttttgtgtaagctgctatgctagattcaaggtgtgtagaaatacacataaagcctaattctatttaaacagctacacagataactgatatgaggtagcatgtggcagtcccataactaatgaaccagtgaaagactgtgaggttcacaagtggatgatatcacttctaattggtgcagattatcaaagccatcacgtaggagggggtgtttg

SEQ ID NO: 125819 - DNA, 666 bp, Homo sapiens
gccgcaatccgacaccaaactatactaaatgatgaggttattgaacaactgcgaaaattgttgcttagatgcttgggacaaaattcaagatgatggtaaagtatgcccatctttcacagccgtcagacagggacaacatgagccctacccagactttattactcgtcttcaagacgcagcagaaaaggctattcctgatagccacggccaaagacttgttgtagaacttatggcttatgaacaagcaaatccagatggtcaggcggctgtttgccccgccaaaggtaaaattccaccgggtggtgatatactcacctcctacattaaagcctgtgaaggggtgggaggaactctccatacagcaacgattatggcacaagctatggcctctattcgaatgcctggacaattctctggccaatgcttcatatgcggccagaagggacatgcagaaagaaattgccctcggcgtgcaggtggccgtcctttacatcaccaccaacaacaaaaagaaacttttcagcaacaagacaccccaccttctgctgtatgcccacgaagccaaaagggtcttcactgggcatctcaatgccattccagatttgatattgatggcaatcctgtacggcctttttaaaaatcaggaaacgggatgagggaccggcc

SEQ ID NO: 125820 - DNA, 284 bp, Homo sapiens
tgctggctggctccacagggtaaaggtgtggtggaatgatgaggacctggggctgtgctgggacaggagagggcaaagtacgggccctggggtctgggcagggtggaggaggaagttgggaagagggtgatgtgctagagggaaactgaaggatgggaagttgaaggtgcagtggggcagactgaatggacagtggggaatgttggagaggatggggaatctccaaggcggagccattctgggattgacaaggccaggtgtgtggctgcttgaggggagctgag

SEQ ID NO: 125821 - DNA, 396 bp, Homo sapiens
agctctctctgtgggggctgtggggaagtctcctgtagtagacatggtcaaatctggaaggagttacctgttggggtcatctcctcaggagctagtaagtgacggggcagaggatgaagggtaattcggtgtcacagtcagaggtggtgataccagcagctggcagattaagaagctgcaagcatacagactgtcagctgctgccccagatcctcatggtgggatggtttttgggtcgctaatgctactggaccattcactgcatgccaagcacaagactgatgcttaaacatgtgttatttcatctcatctctccatggaccccagaagaagcaattactattatccttatcttataatgaggaggctgcaactcagaggttcagaactgttccc

SEQ ID NO: 125822 - DNA, 427 bp, Homo sapiens
cccatctctataaaaaatcagctagctgggcgtggtggcgggcacctgtaatcccagctactcgggaggctgaggtgggagaattgcttgaacccaggaagtggaagttgcagtgagctgagacagtaccactgcactccagcctggatgacagagtgagatcctgtcttaaaaaaagaaaagaaaagcagcttgataagcaagagggtaatagtaacaaggctaagacaggaaccaaggaagttagtcagatgtttgattcccctatagaaactaaaagtaacatcttaacatatgcccctgagttgttttccagaaccctgaacccccaccaatgacccccactgaacagctctgctgtcacctaaacctcagataagggggagctgatggctgaactctctagctgaataatctcaaggggatc

SEQ ID NO: 125823 - DNA, 557 bp, Homo sapiens
tagcttggtgagcgcagaccgctgaactcttctaacatctgtcttagaggttatgtgttggctgctgcgttcagagctatcctaaaagtaactgaaacaagggatttttgactccatggctaaacagtttctggggagcagaccttgattctaccattacttagaaaacaaatcaaattagagtcagactagtgatgttgtcagaacttttcaaacataaagacccatgaatggacatgtacacttgggatcaaaagcactctcctcttccaaacagcagtctacacttggccttttgagaggctgagctattgccaaggactatttagatggaagatttgattgttggtcaaggagacactgaagaagagataagatggtgtactggaatggaaggaaggctctggacatcaaaactttgggccactgtactgctgtgtaaatttgcgaaacctacttaatccttatggactgtttcctcatctggaaaatgagttaaatgagatccattttataaaattgttgtaatgattatataagtaaacacatagtaatat

SEQ ID NO: 125824 - DNA, 737 bp, Homo sapiens
tatttccaaatttagttggagagcacctcattcacatactcaacttttatattttagctgcttggtattttttttgaattgattgattcctttataaaaaatttattaataattctaaacatacaaaaaagtttcagaaatagtgtaagaaactttcccctcacctgaaacatttgagagtaatttgctaacatgatgcccatcactcccaaatattttagtatttatttctctcaaagggatattttccaacatagtcataataaaaaattaacagatacattactaccctcattagagtatagatatatattgtagattagacaagttccaccattggtctcaataatatccttggtaaaagcaaaaggatgtcagtcagaagcacacgctgcattcacttatcattccctcttagtcttcagtcttcccataacatggatgatctcaaaagtttggaagaatacagaccagtaatttcggagaatgttcttcagtttatgtcggtttaagtgtttcctcacaattagattcaggttatgtatttctgggcaggaatatcacagaagtgatgctggggtcgtcgacgtggtataaaaaaaggtggtaaaacacatcaatgattgagacaacgggaaccaaaaacgggacaaccaaggacggaactaccagggagaacagataccaagcaccgggacaccccttgaaccgggggatacagaaaactccttagcccc

SEQ ID NO: 125825 - DNA, 304 bp, Homo sapiens
tatgatgtccatgaagctaattatagctgagatttataacagctgatcaatttggtgaaatggaaagacactcaaaagaattaaagagtaaaaatgttattatttagcattctttcatcagataatctttaactgctcctgccaacctggtatatgagagttggtttttccaaaggtaattctgaggcccttgatgataacatttttgttttctattgtgatcagtgaaaatcttacctctccaacaaattgctttgtacttcaggacaaagattgtctcctttacttcttttttttttttttt

SEQ ID NO: 125826 - DNA, 129 bp, Homo sapiens
cctgcctcagcctcccaaagtgctgggataacaggcgtgagccaccgtgcctggcctcattagcttttaagtgttaaaaatactttcacattcacagtatcctgtgtttcttcaggcttatctttggtt

SEQ ID NO: 125827 - DNA, 473 bp, Homo sapiens
ctgatgatggtggctggatggctggatgcatgtctcagtaatgtctggacagagacacaccaatagttcggtctcctcttccctcctgacagacccagaactcaggccaggctctgcactgcatcagctgctcaggaaggggcaataatacaagaggaaggagagctgaggagaaagcctgcctctgtcctctccccatgggggagggatcacccacctcctgttcccgactggtggcttaatttgcacctacaccaaatctgagctatcaagttcgcaacacccggggtaactcttgcctccaggcctctcaggcctgggcctgattaagctctgtggggcgcaaagggcagaagttgcccagacagaggagacattctggccaagaaagccttagcacaatagcaggagagggctagccggaagttgaggcgcccacaagtctagctgaggtgtcccaggcttgctccaga

SEQ ID NO: 125828 - DNA, 684 bp, Homo sapiens
atcctaaccatgctgaatactaatctcctcatttcaaaaataataatacagcttctcctctacaatctctatcttctaaggattttgtaaagataaaaaacaaataagaaagaaggtaaaagaggactgtggtaaaagtagttttgttaatattaacagtgacaattaagggtcatatcatacattataagttcttaacatggagttcattgtcttctaaagagatttgaattagctacacggtgtctatgtacacttgacattgcacacaaacaacattgtcaatgtctgttggagatgagagtggagcaggttaataatgtcgttcatcagatgtttaggggagtcgaattaacaaagtaaaaaacaaaagttaagaactccactataaatgtgttatagaggttgatttttttgttttgtcatcatacgtgtgtgatattaataatgtactacaggtacataagatgtaaccattggtttagctgaatgaagtgtctgagagactgcatgcacagggtttacattttcttgtgaatctataatcatttcaaaatgcaggtttttaaaaagtcattagactggaatgaaataaaatgaaataatgtaagaaaaatagaaaagaggattaaaacaattatgcttaataatactgagactatgtcacagagaagtttctaagga

SEQ ID NO: 125829 - DNA, 343 bp, Homo sapiens
ggagacaccaaagacagagacaagacatgcagtgccctcagctgcataaattttgcttttaaaatattttcgtggagtaaaattagtgtttagtctcatgtgaatttcatcagtgtgtctatggtgagcatttaaaatacggttttattggaggtgtggttcgtactttataatccctacctaacagtgcttactcggaattgctcccccgcctcccaagttactggcctcactgtgctccagctttcccagtagcagaggaaccctcttcccaaacgtgggcttgatttacaccgagtcattagttgtcatctaatggtggctcttcagtgtcactgcaatc

SEQ ID NO: 125830 - DNA, 732 bp, Homo sapiens
tggaggggaacaacacacactggggcctgttggatggaagtatgcgggggagggagagcatcaggaagagcggctaatggattctgagcttaatacctaggtgatgggacaatctgtgcagcaaaccaccatgggacacatttatgtatgtaacaaacctgcacatcctgcacatgtacccctgaacttaaaagttgaagaaaaacaaaaggaaagaaagtgaagaaatttcaagaaaaggccaggcgtggtggctcacgcctataatcccagcattttgggaggctaagatgggtggatcaccatcttaggatggtgtttgaggtccaggtcaggagtttgagaccaaacatggccaatatggcgaaaccccatctctattaaaaatacacaaaaattgggagtggtggggggcacctgtaatcccagttacttgagaggtggaggcaggagagttgctcgaacctgggaggcagaggttctagtgagccaagattgtgccactgaactctagcctggacaacacagtgagaatctgcatcacagaccaaaaaaaaaaaaaaaaaaaaaaaaatttttgtggggttgggcccgaaaaagtttctaaaccattgttgggggcgggggccatgggtatggaactgggcaaggtgtccagggaacttgggtggcatggggttggttcccaaaaaaagcggggccggggtttgaatcagggttggggttgggtta

SEQ ID NO: 125831 - DNA, 648 bp, Homo sapiens
gggattaaaagcctggattaaggaatattccagaaaatgtagaaatgctgataaaattttatcttgagctcaccaaagcaaccctgccaggtgactcagttacatgctaaaattgtagaaccattgaattactttatattcttaggacttttttttgaaaaggtaagggtaagtgagtgacactgagactggtcaaaactaaagggcagcccctagtttgtggtgacacatgaatgttaagggtccactcgtgaggtttcctggcaggcacccagaggctctcttcaagttagagctcaaacttgctttgcatatttctgttcaaacttctatgtctatcattgaaccaaagtgtaatgttgtccaaactatgttactgctgatatggtaaacctgttttttaacacctcctgctttgcgtctttagttggataaggaagagggaagaaggtaaaatgaaaagaatttaaaaagacaatgtcaatgcttaattaaacaaataaaaaacttttagtatttgaattcataaacaaataaaatgcatatttactcgtggcctttctaacactttttactcatgacaaagatgtgaataagaaccagtatatgagtaaactaactggataaaagcagagagaaacacatgtt

SEQ ID NO: 125832 - DNA, 764 bp, Homo sapiens
gaaaaaatacagtatatagggtttcgtactatccacagttttagacatccactggggatcttggaatgtatccccagcaaaaatggtggaaatgtgatcatttcaaaagcagtgaattaaatccaaactgatcaaagccctgccagccagattgattgaggaaaacaaaataaagaacaatttcacaatacatgtctatattatggaagtgtaaatgacagcctctttattttatggtttttattttgctgctaagtatcagttattagcaaataatgcaattcttttttgaaaagcgttcatctttgttgtgttggtaacttcactggcctgaatgccttctgaacattctgttagcattggaaatccaggctagaaattccaaggatgttctgcttgatgtagaaagactcaaatctttttcttatatctgtatcctagacatttgaacaaataagaaaacggaggataggcctgtttgttaaaatttgccacaaacgtgagtctttctagacttaactaaaatgcactatggcagcatagtcactgtattgcatttatagataatattggaaatcagtgtttcctaggacttgttgtctttagttagtgaaacttaatattgatacatctgaaaggcccccaaacctgatgttagataaattcaagagactaggacaatttttacttttacataaaataaatttgttaaattattttaagagtgctgcagtccttctaaaaacagaaccaagcaatctata

SEQ ID NO: 125833 - DNA, 228 bp, Homo sapiens
tttcagctggcaacgggcagactcataggaatgcattggaaatattaatctagattaccattcagacaaagtcagaggctcttgcaataatctaaggacaaaagaaaggcctgacatagagattgtcagtagaacttaaaagtaaagacagaggacaattatgtattaaaggaagaatgattgtgatgacaaatgagagcaagggagcagaaatcaccatgtcattta

SEQ ID NO: 125834 - DNA, 230 bp, Homo sapiens
tgttctgaggatcccggacggtgtactccaccggcaggtggtactccaccggcaggttgtactccagcgcggcaggttgtacttctgtctcagctctttggaaagaggggaagacatagtcttccttcgaatgtgggaaggtgcattgaaatgccttttgcgattcttgcttcggtcggaagtcacaaagggattaaacttcattttggccactcctgcttcggtgatag

SEQ ID NO: 125835 - DNA, 323 bp, Homo sapiens
cgcccatgtgtgaggcacacttcggaaaaccacttagctcctccaagcctcagcagcttcatctgcaggttgagggtgagtgcatcaagcacgcagacggcactcacacagctcagcacactgctcactagtgtcatgatttgctcaggaaaggcctttgtcattacttcattccattcttctctgccagggcatacagatatgacaagaagaaggaaagtggaggtgttcctggaggatagaaaaatgatttttcccatatcactgccaactgatagcaagagctctataccattggtggcagaatcatggactgggatttt

SEQ ID NO: 125836 - DNA, 369 bp, Homo sapiens
tgaaaaatatgcctcctatacagaaccaagactaaaagggtcgaggtggaataaaatgttcctatagttcgtaagcagccgtagtttggagtgctttggcatgtatcaatggaaagccaggatagtgtggttaggaatccatactctgtaaaaaaaaaaaaaaaaaaaaaaaccctgcctgtgccatttggcatgcttagttcaattattttgaatgctataaaaatagagatggaggagaaaaaaagatttcaaagtaggaaatgaaataggaagaatgttcaggcagagattgaggcaagaagggagtagagcccaggcagatcttatcaatgtgaatcagtctcaccataagtcctaacttccctg

SEQ ID NO: 125837 - DNA, 768 bp, Homo sapiens
cgcggtgactcacgcctgtaatcccagcactttgggaggctgcggtgggcggatcacctgaggtcgggagtttgagaccagcctgaccaacatggagaaaccccatctctactaaaaatacaaaattagccaggcttggtggcgcatgcctgtaatcccagctacttgggaaggctgaggcaggagaatcgcttgaacctcggaggcggaggttgcggtgagccgagatcgcgccattgcactccagcctaggcaacaagagcaaaactctgtctcaaaaacaaacaaacaaacaaacaaacaaacaaaaactatctgtcttttattaagccatattatttaaaagacctgcaaaaatgtaatacaatgtactcttctcactaatattggttttattctggacaacagaattattttctataaaaatgttatgttttataatagtttttatattattttcaataaattaatatatatctggctgggcacagtggctcatgcctataatcccagcactttgggaagccgaggcggctggatcacttgaggtcaggagttcgagaccatcctggccaacatggtgaaaccccgtctctactaaaaatacaaaaattagccgggtgtggtggcatatgcctgtaatcccagctactcgggggaggctgaggcaggagaatcgcttgaacctgggacctgggaggcagaggttgcagtgagcagcgattgcgccactgcactccagcctgagcaacagagagagactgtctc

SEQ ID NO: 125838 - DNA, 206 bp, Homo sapiens
tttaaatctatgagacagtttatcctttattactgttatattataggagaaagaatgttgtctaaatgcatccgaaatttacttaaaagcagggaaaacagcagggtatgacacaaagaacaagaaacaggaagacctaaaagacaacatgtgtgtgcactggcatgtgctcatgcatacttgatttctccattttcatttttttt

SEQ ID NO: 125839 - DNA, 835 bp, Homo sapiens
attgttgtgggttattatacaggctgtacagggtactttactcgcgacttacagtcatgctgggccttaatgagtctaactaaaagactttttagcaattttcattttgtatggattagagagtattagtggggcccatatggtcttctataaattaggagatcaaacaagagagtcttctgcagcaggacctcagctctggatggcgtctctaactcacccattcaagtcagtggggagcaactgcccccaagggttacacagcaccagggaccccagaggtcttggactctgtccccatgcaccattggagctgagatgaatggacttagccatccaatcatgagcatgctggcaacaatgattctgatctatctgttgtctggaaggttttaatatcacggtcatataaatttcaaccagttttatttaatggtgctttccaaacgagcagctgaagagctggagaaacacatactccagatgttggctggcccaggaagcaggatcagcactgaggaagaatctgccagcaaagtaatgattctactctcctaaaaagagagttaaagccaggacccaaactaagttcaggcgcatatctgggagggcatttattgaccagagcacacagtggtagtgaaaaacgaaaacaaaaccaacaaagcagataaacaaataaaactccccaaaactcaactgtttttctgttcaaaggtttctataaaaatccgttcatgtgttctcaaaaactcagtttgtttctgttctaaacatctcacttcgccttagagagcattcattattctctacagattgcttttggtgattctgg

SEQ ID NO: 125840 - DNA, 546 bp, Homo sapiens
gctggttccgtttgtttttggcttctcatgttgaagctctattttagcagggctggatgttcctaactgagcgagcgttgtaaaggcaaacacactaggctctcccttgtgtgggagagctctgctggcttctgaagatagtgaaattatgctcttgtgaataagccttaacgatttatgtacaggatttcatgttacatttaaaatgttgtggcacatttcagatgtaatgtgatgtctatttgtatgtgggctttagtagtttgatatctagagaattttctaaaaattttgggaattgatgctgaaaatacaactataaatgggagtcggataaccacataaacactggtagtatatatttggacaatgccagagatcatttgtgtaactttggacattttatgtagcttttgatttctttgtagacatgtgacattagatgattgttttaaagaaaaagcagaagtggtggaaagcctcccatcaatggagatagatcatcgtagtctaggccacagatggtgttagccttgttaccaaatt

SEQ ID NO: 125841 - DNA, 303 bp, Homo sapiens
agaaagccagtttgaaacgaatgtagcaatagatgtaaaaacatttaaaggcgttttaatgtggctttttaatgagctggcttatgcctgtagtcccagcacattgagcagctgagctgggaggatcgcttgagcccaggagttcaagactagccagggcaacatagtgagaccccatctctatttaaaaaaaaatgtttttaaagataaggaacagacttaaagtgatgattgattgctcatagaacgttcattttgggctccagaactaggaatgatgtagaatttattgttgtgtcattg

SEQ ID NO: 125842 - DNA, 718 bp, Homo sapiens
tattcttaaggttggaggtcactgtttcttcttaagagcactgtattccaattttgaataatatttcctagacaggaagcacgatcatctttcatttttatagtcattttttagtagatgattgttgagatggctgggtgctgaataaaacaaactgccctagtctagttgttctcttattgttgtgtgcatttcacacttgtgtaagcctatttgttaaggtcatggtagtcagatgtatttttcatctaatttcttatggcctgatattttttcccaatattgttttttcttgtcctgttaaatcattgacaactgagcagccttcaaaagtatatttttataaaagtgttttttgaaatatgtcttatttcatgacattttgtaacaactcctagactattgtctattctatttgtcttaagtggagctattgattatataatgcaaaaagctgtgaggttgtaactcagttcagtagtatttataaatatttgttttccacttttgtgcatattatacaaacgatggatataaaatttgttttgaccatttatgatgcttgctttgggaagaggatatcctcatagaactgaacgttatgatggatttttaaaatattctgacccaaatgatattgcattgtcagtactgtccctggttattaatttctcctggagtagaaaatgctttgttccttactatatcccatttaaac

SEQ ID NO: 125843 - DNA, 590 bp, Homo sapiens
ccctcaccggatgtgtcctctagatcttggacatccgagcctccagaactgtgagccaaataaacttctgctccttataaattacctacttggtggtaatggcagcacaaaacagactaagataacatcctaaccctccacatcccgctcgctgggaccatcccactctggtaatatcgggctgaaatggttcctctcctacgaaggcttgacttatacttccaaatgactgatgttttggttcccatgagacgttgtttataccttaatttcagcacttagaggtaacaaaattttatattatacaaggttttcatgtcttgcccactatcccatgacctctgagattggagacatttttataccaagagcccaccagagttaagtgtactatagaatatgctttatggtacaatgtaactttgtgttatatcattctgtgctttcctagcttgcctaaatgacctctgtggtcaggaacttctttgtatctccagattctattaaactgccaagaatgtagcagatgttttacaaacatctgacaaataagtaataacatgtgaataaagatgtattgcatgttccac

SEQ ID NO: 125844 - DNA, 315 bp, Homo sapiens
tgtcaaatttatgccaaggagcttacatatatctaatgcaaagagacaacaaacaagccaatgaataagaatttcaagaagataaaataaggtaatatggtacagtggtttgtggaggaatataatcagggaaagtctctcaggtgctcacatctgtttcaattgtaacctcaatgaggcacagacaaccccttgagaaattctgatgagggaagcagtgccaacgtggctcaagtttatccttctcaaggataaattgtccacaatgccttctttgctcgatggtagctatccagtgtctaaacaaaagtcact

SEQ ID NO: 125845 - DNA, 584 bp, Homo sapiens
ttcccgcccaggaaatgccaggagcactcccacccccaataaacaaccccaaatgccagggcaaatatgccaaacggccccccactccccccgcgaactacggtctccatatctagacactcaagcccaacaggacaccccccatcgtggacaggatccccgtgcagtgtggtcaaggacatagcagggtcttcactaacgatgcggacatcttggtcacaggcaccatggaaaagcacatttctcaagtccacagagcaagggttaaagactaaaaccagcaacagaggcaggcgatcatggcttccaatcctcacccgggaaggaggattctacaagaacatgcaacgtgggccacacacacgtgccaaggagagagaggagcccacagatcatttttcctgttacctaacaggacctactgtctatggaatcccaactttatgcatagcggggcagaggtggaccgcaaaacacattctagaatgttcatagcacccctaaactgaaacaacccagatcctatcaacaggacaatggatgaatcatcaaaatgatagagaaatcagagccctcatgcattg

SEQ ID NO: 125846 - DNA, 396 bp, Homo sapiens
tcttggctcaccaatgtgcatataatattaggaattctttattacacaaagcccctcttagtttcaacctgatatctcataacttctcatcataaatcctatgccctacctagccatgctaaactttatgccattcaaaggagatgacattccttctcagctttgtgtctgtgttgtgataacccatttcctggaatattcttttcttcttccttgcttatcagactgatacatacttttcaagacattacttatgtgtcatgattctttcagaactctctcccaaattcaaattcccccctctgagctggcacaggtttacctttatgtgacaaaagagcttgtatattagtctgttctcacactgctatgaagaaatacccgaaactgggtaat

SEQ ID NO: 125847 - DNA, 320 bp, Homo sapiens
gaggcatacacaacggaaaacaaatgtgtggtattctggaatttaaagcaaaacatccaaaacaatcccccacatcagatgattttggttaagatcagaatgcctgctttcagtggaaaagggatttatgggctggccagtgtatgctacgcgtctggcaagcaggcagtggaaacttgaaatgggatttcttgtttagaaagaggttaccttgggctggggcctccctcccaatcagccccaacatcctaacgccagtacacttcactgaagcttttctcctctccagggcagaggaagggctccaggtttttaaatga

SEQ ID NO: 125848 - DNA, 344 bp, Homo sapiens
tgtttaaatgccatgcaattgtcacaagaaaacttcactgattgtcaaccataacgggtaccagagaaaagggattcttcaccatcacgccaacttctgagaaaatcctaactttagagaattagccaaattcagttagattggatttagggctcgttaatatctactgtaatgggaacggtttcccaacacaaggaggctgttggtttgttgtggaagtttcagctcagtaatggagggtgagcaggtgaagaatatttcagatggggggcaactcacagtacacacgtgcagtgttcctgagctgggtgcccaccaggaacggaacacttaactggaaatgg

SEQ ID NO: 125849 - DNA, 610 bp, Homo sapiens
aatcatagctgtggggggctccatgcaggaccttgagggccccgaggccagtccctgtggccacagcaaggagcatctgctttagctagttggacaagactctctcctgcccagaaacaggcagaaggacttcccctgctccccacccatcatcgtatcccaaacacacctgtgtggatggtcacctcaacgtctcccctcagcccagtgcccgcgctcttcctgatgagggttaagcaggagcagcctcctctccccatgtccatgttgcaggcggctgccttctcctcagctcccaccgagcagaacaagagccagccagctctctccaatcccaggattttccagggatgctgataacgatgggggggccccaagaagcctccctaaagcaggcagggccttgtgagtgggtggtgggagggatcagggcttcctcagcatctgtcagtccctggagcatctgaaggggctccctacgtcaggaggaaagagtggggccggcccctgtgggttcccagagcctggcatctgccggttcctctgccctccctcacagacaccctccacagagcagcacagcaccgaggacagaggcagcagccccaag

SEQ ID NO: 125850 - DNA, 381 bp, Homo sapiens
taagaaaaaggttttctagtttcttctacattaaaaacaatccctccttctcataaagcacaattttacagaggaaaagggagatgtgaaactatacacaattcaaatctaattaatatataatttttttgtggaatacagatggagggaatacatcacaatactaaaggtgattatctttggatggtgggattacaggtgattatatattttttatatttctatagtttaaaaatattccatgatgacctataattacttttacttattttttgagacaaaatctcaccctgttgaccaaggctggagcgcagtggtgcaatctcggcttagtgcaatctcggtgtagtctcgacctcacaggctcaagtgatcctccca

SEQ ID NO: 125851 - DNA, 432 bp, Homo sapiens
cttttctcctcctagagaaattctcagacttcatgtcccagtcacctcttctgtgaagccttttctgattggccccaggactgtcacctcctctaagtttccacagtaccttgtgcccatctctctagcataacctttatcaattcatgttgtaagttttcagttacatgtctgctgatctcattgaggaagtgaaattcatcttttcacttttccttccctcttctccccctccaagtgcttaacagggtctagagcacagtacatcctcaataaatgcccagtggtagaaacaaaggctgccaaaggcgtggcctctgcctccatgtcaattcagtcttcactggagcagagatgaaaccaaggagccccaggaggccttaccttcccaatcattgggagtagaggttgatggaggataaatttggtcat

SEQ ID NO: 125852 - DNA, 248 bp, Homo sapiens
aaaggctgacggacaggctcggtcagataaggcaattccagggatgggggtttcatgtggaactggttggacatttgcagaacagccaagtaaatggccaaagtcaggtggtcaaggtgtgttttctgtttagagcagaaaaagtcagaaatcttgaggttaggatgctgaatgagcccccagctgatgcaagtatcaagaaagagggaccccttgagccaggtgtaaagtctggatcttagggagtg

SEQ ID NO: 125853 - DNA, 689 bp, Homo sapiens
tgcttttgaacgacaagcagtgtctatgagtatgctgcttattgaaataatttcctaggggtatatgtccagtagtgtggactttctgaaacagtcaactaagtaagtgatacagtgtttccttatgcagatgtgcgtgctttgcctcccggagggaattcgttttgggaatagtcaccactgttattattaagtccattattattattcagttaatacaactttttcaaaaagataatatgcctctttaaaaggcgatttagagtgggaaagtttttttttctttgtaaatatcacagcgacaaggagtgtaatataaacttccaaatggaaactgttctgaagaaaatactgactcaagaaatctacctgaagatttccatggtattgttgctgagtcggatgaacagatggtctacatggcaatgaaacttttcagggtgtatgtttcagactcctgtattctctatactcaatcattcaattagtgtggacctttaatttccttttttggtagcaaacagcattcacttacttgcataaattgtagttattttaaataaaacaacaatcatatcaacatgtcattttagaatttttcatagtgtcttttttcaaatggcatcttgtacattgattacagaaaatcttgttatttcgaactctgtttactcggcatacaagtccaa

SEQ ID NO: 125854 - DNA, 404 bp, Homo sapiens
caaatatcctctttcataatagatcatccagacactcagacacacgctctcactcacacactctgcagcacaccagcgagcatggcaccccttcccatctgtgtctgcctgccagctgctcttcctcctttcccacacacactcccttttttgagtggcttccaaaacatctctttctaatttgctataaagagtgagccataaagaatttattaagtgatgaaaaaaatcacagctaagtatcagattctccagaggaaataagattaaaaagaaattctggaaaacagttgtttttggagaagggaatagcattgggaagggggatattaataatgtttcatcttttttgtttaaaaaaaacaaatctgaagcaaatatgactactgagatgcaacaaagct

SEQ ID NO: 125855 - DNA, 132 bp, Homo sapiens
acttatttatcctgatcactgcatatagtcataaatattttcattaatgaataaaactaaagataaattaatcacttaggaagataaaaggaagaataccaaaatttagaaaaaagaattataagatagtat

SEQ ID NO: 125856 - DNA, 316 bp, Homo sapiens
cctgatgaggtggaggcatgtggagggctaagaggctgaacgtggagagtccctgcaattggctgtctagtcatagccagcctcaactcaaaatccctttttctcagtgggagccaggagactagactatataccagctcatgctctggggcattgttccctaggctcttggtagagacagataagtaaccatcaaatgttttcttctctgtcaaaactcagaatgcttttcttttcttttcttttttaagagacatgatctggccccatatcccagacttgagtgcagtggtgcaatcatagctcaagtgattca

SEQ ID NO: 125857 - DNA, 155 bp, Homo sapiens
agctagcctgcctgaaaaaaacccagcccaagccaatcctcctctgataattcctctggctgctcttacctccttgctcccatcacaagttacacagacttccatttcggcaacatcccactccactaaatcgtatatatatactggtattaatt

SEQ ID NO: 125858 - DNA, 1094 bp, Homo sapiens
aaggacataaatcaagaaagcttttgtgtgtgtgtttttttaaatgaatagcaaaatgaacaactaaaaattgaatggtggggaagggtaataagctaacactatagttacagctttctaaagtactttctagagtacacctaacatttacttactatgtgcacttactatgtgccagtcattattctaggtgattcacatcaatggtatcaatcagttaatcttcacaacagctatatcagttacattcttgcatagaataggtgtcagtaagtattactattgacggtatacaattgttattaattcaacaagtcacattaaacttcctgcagcagactgtatttttcaaaattggcagcaacagtatgttcaatcccatgtgctcttccaaaaaccctaccccctacctcaatcaagagatggcatctatgtcctttccccttgaacccaggtaggcttctcggacgggtttctgtgactgcacctctaaagtaatgctatgttggccaggcgcagtggcttatgcctgtaatcccagcactttgggaggctgaggcaggcagatcacttgaggtcaggagttcgagaccagcccggccaacacggcaaaaccccgtgtctactaaaaatacaaaaattagctgagtgtcatggtatgcacctgtaatcccagctactcaggaggctgaggcaggagaatcacttgaccctgggaggtggaggttgcaatgagctgagatcgcgccactgcattctagcctgggtgacagagcaaaactctgtttcaaaataaacaaaaataaataaagtactgctatgtgactttcaaaaccgcatcttgaaaggtagtacagcttccatctagctctcttgctcgtaatatgtgcctttggagcatataagtacatgaaaccaccgtgcggcagagatcacgtgaacagaccacgttaaaatagagtccgaggaaccctggctgttgaagcccgcagcggtttgagttttccctgtcccagtgccagacatgtgaatgattctgaggccctcaagatgactccagcattatccctgtctcatggcagccaggcaacaca

SEQ ID NO: 125859 - DNA, 286 bp, Homo sapiens
tacaccaggcaccccaccatgcctggctaattaaaaaaaattttttgtagagacagggtctcactctgttgccagggctggccttgaattcctggcatcaagtaatcctcccactttggcctcacaaagtgcgaggattacaggtaagagccaccatgtctggcccactgtacttttatacaactgaagcacagtaaacctactgtggtttcgtttacaccagcatcaccacaaacaccatgagtagaacattgtgctgcgacgttaacgatggctacaacatcac

SEQ ID NO: 125860 - DNA, 632 bp, Homo sapiens
gcttcaaccttccgagtagctgggattacaggcatgcgccaccatgtcgggctaatttttgtgtttttagtaaaggcgaggtttcaccatgttggatgatcttgaactcctggcttcaagagatctatctgcctcagcctcccaaagtgctgggattacaagcataatccaccacacctgacctacttttgtatgttaaatgtgattatacttctctttgacttgtcagcttagctttagctgatacactctggtgcccaactattattgtatcagtgaacttccactttcttttccttttctctcaatttttgttgtatcattcctaccttgtgaggacatataatatttacattctgttgtcatcctcacatttcttagttccacagtttaaatgtatttgaaactcaaaacattcccattaatctcttggtcagctgaaattaatgatttaatagtttccttaaaaaagactcatggaacaatttccctaaatttttgccatgtcaaatatgtttatctgtagcctttacacagtaaaaacaatttggctagataatacaattctcagttcatatttttctttggaatattaaagtattgctatagagaagcctaaagtcatgtgacat

SEQ ID NO: 125861 - DNA, 595 bp, Homo sapiens
agacggagttattctctgtcatcttggctggcgtgcagtggcacgatcttggctcactgcaacttccatcccccaggttcaagagatctatctgcctcagcctcccaaagtgctgggattacaagcataatccaccacacctgacctacttttgtatgttaaatgtgattatacttctctttgacttgtcagcttagctttagctgatacactctggtgcccaactattattgtatcagtgaacttccactttcttttccttttctctcaatttttgttgtatcattcctaccttgtgaggacatataatatttacattctgttgtcatcctcacatttcttagttccacagtttaaatgtatttgaaactcaaaacattcccattaatctcttggtcagctgaaattaatgatttaatagtttccttaaaaaagactcatggaacaatttccctaaatttttgccatgtcaaatatgtttatctgtagcctttacacagtaaaaacaatttggctagataatacaattctcagttcatatttttctttggaatattaaagtattgctatagagaagcctaaagtcatgtgacat

SEQ ID NO: 125862 - DNA, 220 bp, Homo sapiens
aattaagatttctattatttgaagatgcagcacatcaaagtgcttgagaagaaaagtattttaacatgaccaaaatatttgctattttgatataaaggaagactttcttgggaccgctaaagtattccattcaaaggaaggtggcttggtaaaagtattcttgaagaaacgactgaagacatgggtggaatgccagaattctgccttttttttttttttt

SEQ ID NO: 125863 - DNA, 534 bp, Homo sapiens
tgtttttgccaatattttccttgcaggaggttcagtgggaataggatagacaaggtccctgctcttgtgactcttatattctggttgggaaaactgacaatgaacaacaacagtaaacaaagaaataaaaataaatccatggtgataagtacccttatatggaatagagaatggtcaggtaggtaggtgaaaagagactgcacattagatagggtggaacaaatgaggtttttctgagatggtgacatttgcattgagagattaaagagttaactaaccactcattactttgtctaacttttacaacaacctgagataaaggtaacattagttcagcaggtataagcaaagaaattaattacccaactaggttaaataatttctctaagattacacagattttttcaatcctattgtaaaccaaaaatagaattctaggccccccaactaactgaatgaccgctccttatggctaaaggcattccatagttaacctgaaaaactagttaagaccctgatgagaagtggaggttg

SEQ ID NO: 125864 - DNA, 515 bp, Homo sapiens
gtagtgtttgaaatgagtaaaatctttttaaaatgatatacatagtataaattgatatagctgtgactttatgtataggcaatacgtatttttatatgtcttaatttattaccttcaatggctgcgagatacttattttattgatgtaccgtaatttacttcagtcaccatgaatatttagattgttttcagttatttgcctggagaaacaattattcggtgaatgtcattgtatacacattttgtacatttgcatgagtatacctgtggagtctatgttaataggatataactaaattgaggaaacgtttgagacggtcccactttcaggttacatttgacttaatagattatgaagacctgagaataaaaggagaaacagaaatggatttagaggagaatgaaaagggggaacagaaataggcttataggtaggatccacatgacttgatgattaattggttgtgtgtatcttctgagtagtgtcaggggtgactcaaaaatgtcatgcctaa

SEQ ID NO: 125865 - DNA, 305 bp, Homo sapiens
tgagcctcagtttcctcatctctacaatggatctaatactcccttgaacaaacaggatgccaacgaggcaaagtttggtgcccagctctcagtatatagaaactaaacttcttggccgggcgtggtggctcatgcctgtaatctcagcactttgggaggccgaagcaggcagatcacctgaggtcaggagttcaagaccagcctggccaacagggtgaaaccccaactctactaaaaatacaaaaaaattagctgggcgtggtggcccacgcctgtaatcccagctactcaggaggctgaggaag

SEQ ID NO: 125866 - DNA, 108 bp, Homo sapiens
gggtgggatctgggaactgggaggtggtgtcggtgttgactagtgtcgaggtggccatactgttgtttggggaagcacgccctggagtatttggtgcgatggggcagt

SEQ ID NO: 125867 - DNA, 290 bp, Homo sapiens
tgtgtacatgcaggggcgggattctatccatcagagaggctggagagggagttccacattagagatagcctaagctagaattctggtgtaccttccaattctgggagtctcatttgtaggcctaaattcaggcatgagcaagtgtaagagatcaaaggtctcccctacatcccccaatccttctccccagcaaatagagggttctgagccagacagaaaattagatttccatggttccttccagcttcaaaatgccataattttaggcttagactattcttcagcacaca

SEQ ID NO: 125868 - DNA, 121 bp, Homo sapiens
tgagagtaagatatgtcatctttctttcaggcctatcatagtgtctagtctaaagcaacagtaaggctccttgcatatttgttgaattaaattttcaatttagtttctgaattccttggtc

SEQ ID NO: 125869 - DNA, 654 bp, Homo sapiens
aaaaggacttggattgaaacctattgcctttctttacaagattcagatctgttagaaatctgtgtggagtcagtccccatggcacaggcctgtagttcagctgctcaggagactgactgaaggattgcttggtcccaggagtttgaggctgcagtgagctatgatctcgcctgtgaatagccactgtactccagcctggacagcacagtgagaccacatctataaaatttaaaaaaaaaatctgtctagaatataagaaaaagaaagaattgataaatcagtgcttttatttctaggcaacatgtctgtcctcctcctaggttttaagcctaaaaataaatttttaaaggtttaaagcatacagctacatcattatttttatggcagtcaaattaattcttccgtccaccacttgaagccaatggagattgacggtcctgttttcttactttaatgatgtaaacctcattgaaaatgaagattctggaggataaaaaatggtgctgtgactgctattgattaagtgtcttgttgccgtcattgttcatccctccttggcctcttgggcagaaggaggcccaagaataacattgctgacatttccttgaaaagatgcagtgcttgacaaagacagctgcatgcttaaaaaaaaaa

SEQ ID NO: 125870 - DNA, 710 bp, Homo sapiens
ctatgtcctgttcgtggctgatgccagtgcctaaaacaagtgcctagctcattataggctttcaataaatatttattgaatgagaaccataaatgaataagtgatagctaatgtattgtcagtgatactgtatcttctaaaatattaataagctactgtaaaattaatttctctttcctgattgacttttcttggttttgttctcattccagatgcttgggatggaagaagtttgagtgacctatcctgtgtttatcctccttgccgtagctgagttgatctttttgaaaccctcttcccagactcttggatttatttattttattccagtgtgaatgcatgttttttccctcatagatggcagttctggattagcagttttaaggtctcaactttgtttttagttatcttcctttaacaagcttcaatttaaaatactccttcttttctctcccaattatctttactgatccttagttgtctctttttattatctccaacagaaggaacttgctgtttaggtttactgaaactaaaattctgaagattgcaaaaaagtatataggtaaatgtgtgtagatgagacttaacgtgtacaagaattcacattaggattaaggttactatttttatctagaatatgaaatttgttaggaaagggtagcaccttactatctttttatcaccttgatcagtgacgtacagtaaaa

SEQ ID NO: 125871 - DNA, 428 bp, Homo sapiens
catcccagaacagttgtggtacattagtagatggcaaggtactgcatggtctgaaaagtcggggagacagctgggctaggcataaacaaatatgagttgctgactgctttggaagttctatatacaccatagtttttaataaacacacatcaataatcacagttattactactgtggttgcataatcaacaaaatcgggccagattagctagttttaattcagttcactccactgactgaaggcctatcaaatttgaatagattatgtagcagcagaataggagtaaaatgaaaaactagcttctagaagatctatgatctggtgggcaagacattcatattactaacaggaagaggactatgttcaagtatactcagagccctatagaaaaggaattcaggatgtcagagataaatttttggaagag

SEQ ID NO: 125872 - DNA, 349 bp, Homo sapiens
tagctggaagaaactttcatcatttctgaaggcaaaaagtaaaacaagatctcatgtccacctataagcaagaacatatgtagataccaaaggtactgactgttgaagtaatgagaaccacaggacagaaataagccaataccttgcctcctccttcatcaaagttttaaactgaggaccagatccccctgcaagagaggatttgtttcagaaaggtcacaccttgctgaaaacgggcatacccacaattcccacgtgccattactaaaactatgattttaagacaaaatcagttctaagaagtaaatactattatctccaatttccagataaagaaagcgaggtttga

SEQ ID NO: 125873 - DNA, 852 bp, Homo sapiens
catgatggctcacgtgtataatcccaacactttgggaggccaaggcagaaggatcgcttgagggcaggagtttgacaccagcctggggaacatagcaaggccccctatctacaaaattttaaaaaattcgccaggcgtggtggcacacacatgtagtcccagctactcgggaggcaaaggcgggaggttcacttgggcccaggagttcaaggttgcagtgagccattatgccgccactgcactccagcctggatgacacagtgagatcctgtctcaaaaagaaaagtaactacctcaattggcagaaagatagacaagctttaatcagaaagaatccaaatacagaactacacaaatatggtcaattgacttctgacacaggtgcaaagtcagttaaaaggagtaagaatagtcttttcaacaaatgcttctgaaacaaatgaacatttataggcagaaaagacaaatttcaatgtatacctaatactttatacaaaaagtaactcaagataaatcacagaccaaaaagcaaaatctcaaactataaaacttttaggaaaaaaaacaagacaaaatcttcatgactttgggttagacaataagttcttagttacctcatcaaaaacacaacccataaaatataaaattaataaactggactttataaaaattaagaaccagcaaaagacactattaagagactgaaaagaaaacctacagtctatgagaaaacgtatgcaaatcatatatctcatgaaaggcttatacccagtactctcaatacttgacaataagaaaatggcctagtttttaaaaaataggcaaaatatggacgggcacagtggctcacac

SEQ ID NO: 125874 - DNA, 145 bp, Homo sapiens
gtcctatagctgtctctgagtaagactgaattcataagaatttattaatttctctaaagagaggagactcagggtcccagtaactgaatgctgttcttatttcagtctttcctgtatcaccttcctggattttgccatatcaagg

SEQ ID NO: 125875 - DNA, 480 bp, Homo sapiens
ccatataacgagagcacgctcttcaaatcaaaacttcatcagctgacacactccctccaggcattctccaatgagtgatcagtttgtttgccaccagcacctcatatttaccaccagtactgaaatctaaacttttgaatttcaaaagcaatatcactcaactatataataacaagaatgtctcacatataccctagaaaaacgtgaacagagaaagaacgagaacaaagttaacagtggtctggataatatttcctttttaaatagtccattcagaagtgcgtaagtactaacatgttttgtgatgtggagcctaatgaatctaccgcctgttcctcatcttagcctcacccatgacagacatcacgacttgaacacaaaactttccctctgaacctggaggcaccctgagaaaccactgacaccatcctacaggcgaattcttatccactaaccagtgttggccactaaccagtgttg

SEQ ID NO: 125876 - DNA, 449 bp, Homo sapiens
ggagagactttctttgtcaacccaggagggcttgttagaagaagagggccgggcagctcagctctttccctcttcgtgtccggcagcaggaggccactcctgggtctgggcctcctggagttggcaagagctgctgactgagaacctgacccaggcccatgaaggcagtgtccaaggtgagccagcacagtggccgtccacatacctgtatgctaaggtgaagccaccgcagtgagaagctggtgcagaacattttggggcagctctaaatagaaaaggattttgtctcccgggcaacgtggacatgagacataagcctacacgcctccatgtaggctcccagactgcctgaaagctccggctaagttctccagagcgctcaggtgatagctcttcttctcagacgagtactctgaggccactgtcatgccagacatgtaagtggccaa

SEQ ID NO: 125877 - DNA, 400 bp, Homo sapiens
aaaaacaaaaaaacagaaacaaaaacaaacaaaaaacaaacaaacaaaaaaaccagatgccaaaaaaaaaagtgtgtgtgtgggggaatcttactgagaagagagagaaagaaacagaggaggaaggggaagtgaaaatgttatgatggggtggaagggaggaagataggatctggagagaagcagaagatttcttgccccaaactcctgagagagagcaaaaacaaatacttttgagcaaaatcagttgtccccagatgtccttagatgctccatcggtgactccgatactgccagggagtcccacctgcagaatcacggttctctgcctacacaagaccctggaaccagtccccttctgtttgtccctgctccacccgccagtacaacctgcagacca

SEQ ID NO: 125878 - DNA, 409 bp, Homo sapiens
tcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctggaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacc

SEQ ID NO: 125879 - DNA, 204 bp, Homo sapiens
atgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgtt

SEQ ID NO: 125880 - DNA, 353 bp, Homo sapiens
ctatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatga

SEQ ID NO: 125881 - DNA, 478 bp, Homo sapiens
agccttcctagatcccacatcctcatccagttactgtcccatttttctgctttcctttatagcaacatttaagagctgttaatactgtctccattcctctcattcttctgaaccaattcaatcaggcttatcttcttaacactccaggaaatagctcttttcacagcctcagtgacctctacaccaccaaattaaaggtccaaacttcagttctcatcttatagggactagtaggagaatttgagacagtggatcactccttccttcttgagagtcagaacttcctaaccacatacgtaaaatagtgaaaaacctcatccctaacaccctagactccaactcttctctttcaccaggctctccccctcacaccgcttcactgaagccctgcacaacacctattgccacgacatatagatttacttttcatgaaatgtaaactctgtgattttggtcatgttacttaacctatcagaac

SEQ ID NO: 125882 - DNA, 181 bp, Homo sapiens
agacagttctcagggccacaaagaagtgaaaaaactccaggcaagctgtaaggtatttgatgcctttccccataatctgcccaccacgaagtgtgtggaatacttcccccaactcacagtttctacactggatctcagtcctggaaactgttccttaactcaatcaaaggagatgccaaat

SEQ ID NO: 125883 - DNA, 614 bp, Homo sapiens
ggagcttacactctagcagagggaggccagttacaaacaatatacacaataaatatacatgaaaggataagagctgtggtgaatggcacagcagagtaaaaagacaggaggaatgggtagagtgcaggatgcagtattagacggggtggtccttggaagtctaactgagaagatgggagctgaggaaaatcttgaagaagggagttagctggcagctccctggatgtgagctttcctgcaagaagctttggctagagcaaaggccctaaggtgggggtgtgcctggtgtgttcgagagatggcaagggagcccatgtggctgagcaggattaagagccagtgaggggaagaggtgatggagagccagagcagtcagttgagggctagagtcccagagtaactggaggcctgagtaactggaaggatggagttatccttggctaagatgcagaaggctggttggcagagaagatcaggagtttggtttgggttacctaaattgggaatctaatattgaattacatattaagattcaaaaattctgaaaacagactggtggcacatgggtaatatttaaagcatggccatcagctgacagtcgggataagagaagg

SEQ ID NO: 125884 - DNA, 234 bp, Homo sapiens
gaaagatcttcctcattgagccagatcagacatcagctccttagagaggctgaccctgttctctctcgagaccttccttccacagtatcttgtatatgcatgaccttcacaagaacactttgctttgtaggtgtctgttctgtgtgactgagctccctgaaggcaaggattatttttcaccaataccatgcatgtctagcagataacagtggtaaaaataataataatagcagt

SEQ ID NO: 125885 - DNA, 820 bp, Homo sapiens
agtcttgctggaattggttttggaactctaggtaataaatcagctttctctcctcttcaaactacttctgcttcttatggaggtgattcaagtctctacggcgtaaatcctagagtaggtatcagtccattaaggctggcatattcttctgcaggaagagggttatctggttttatgtcaccctacctaacacctgggttagtaccaaccttaccttttcggccagctttggattatgccttttcagggatgattagagattcttcctacctttccagtaaagactcaataacttgtggcagactgtacttcagaccaaatcaggacaatccgtaatgtatatgcccattctctctttctggagtttttccagcatacaatacatgcacgtgcacacacatacacacacatccattaatatacttcagtaagtatgtgagtggattatgaggtcttaaaatgctgggttttttttttttcaagcaatataataggtcttagatctgaaaactcttcattaggatttatcaagtgaaagaagtaaatctgaacattatatgtgccttgaataaagctatttcaggaaatatttaatgaattttctccctaaattatcatttgtaaacatttttattttaaaactagtttttattttattgaaaagtggaatttttagtgataaaatacatttgtaagtgtaaagcaatacagcataatagaatagaatataaaccgaaaggaagaactgaacaattaaggcaattctaaataattaccatttcaaaactgtttcttctattcctggttcataggaaagaaa

SEQ ID NO: 125886 - DNA, 318 bp, Homo sapiens
cgggcacctgtagtcccagctacttgggaggttgaggcaggagaatggcttgaacctgggaggcggaggttgcagtgagctgagattgcaccactgcactccagcctagatgacaagagtgaaactccatcaaaaaaaaaaaaagtcacagaaccaaagcatttatttttattcaataattggtcagattattttttctagtgaaggagatgagaacataggctttttgattgttttaaacagctttactgagatataactcacgtactacggtttacccatttaaagtgtatacttcagtggcttttagtaggaacc

SEQ ID NO: 125887 - DNA, 294 bp, Homo sapiens
tttatgaggaacagataaagggctgggagatacaggagaggtttgaaagacagtggataaaatgtcttaggatattccatctttcaaacaacttttaagtgttaagtgtgtatgttcttactctctgatattgtattctagacttccacgttttttgttgtcttaagattttcttagacaggcatgaggtgaatgaaccagttgtctcttttcatagattcttgaatatgtgatggttttcttaggtgagaattatgcttaaagagaaatctagatactctaatagggaacaaa

SEQ ID NO: 125888 - DNA, 512 bp, Homo sapiens
cccatggatcctaactggcccccttgcctcttctcagacctctctccaattctttcttcaccctccagtcagagtattctttaaaaattgtaaatctggaccaggtgtggtggctcactcctgtaatcccaccactgtgggaggatagcttgagcctgggaggcagaggttgcagtgagccgaggtcactccactgcactttagcctgagtggcagagtaaaattccgtttcaaaaagaaaggaagaaaaagaaaactttggtacagctaaaagcattatcaataaaatcaaaagacaaggcataaaagggagaaaatatttgcaaatcatgtaacagataaacggttatgaccggccgggcgcagtggctcatgcctgtaatcccagcattttgggagaaaaataaagtaaaataaaaaataaaaaaactaaaatgtttgggctatactttgaattctttgttgtgcgtactaattttatagtaaactaacagcttaaatcaagcttttct

SEQ ID NO: 125889 - DNA, 1045 bp, Homo sapiens
  misc_feature (1040)..(1040): n is a, c, g, or t
agctctaagtacactcatcttgaataggctaaaggttggtcttcaggttgtggcagtcaaggctccagggtttggtgacaatagaaagaaccagctctaagtacacctagcagttgtgtaactccctcatcattgaaagtggggcggatcaaaattttccaatccaaagatctaaagggtgggaaataataataatcgctcgtatgataaccacaaggtttctaaaggaccccttctacgatacttgaataccgatcacagaatgtctgaccgaacaagtctgccataatttcttccatgatctctcctctaatccattacctgcctgggatttaatattcttactagaagtcaccggaatcttcagataggatctggttcttgcgatcccgtgcgagtaggtaagagacccacacttccttatacgccaatatggtactttctgactgtccacggctcaagcgtggaagctatatataatactatttcctagccagggcattcggaagtaaatgcgtccccaatgatgtctactataaatagatgccggatacagaaagatgataccgtttggaattgcttagggttatggctgtgacgcggactgatatgaaagttcggattgcctcaggggttgactcggtgctgagtaatcacgctgtagtattttaccggtccggaatgtggaatcggcggagcttccgatgcgtatatcacgcgtccgtcaggataactccttcgttatacccacgggcggtaaaggatttaggggatcggcaggtccagggaagtactatgcaagatgggagcagtggtccgagccacgatccgcttctgtcacgaggggcgacgcctggttaacccgtacaaaggtgtgctagcaaacgagaagggggagcacacccatgcctcataggagagggttgaccacagagagggatgtggttcccctagggcgtacaggaagcaccctgtcataattatgattgcccacggagatgcggccacacgcagagaatgttttactatacagagatcgnggaag

SEQ ID NO: 125890 - DNA, 333 bp, Homo sapiens
agctctaagtacactcatcttgaataggctaaaggttggtcttcaggttgtggcagtcaaggctccagggtttggtgacaatagaaagaaccaacttaaagatatggctattgctactggtggtgcagtgtttggagaagaggggttgaccctgaatcttgaagatgttcagcctcatgacttaggaaaagttggagaggtcattgtgaccaaagacgatgccatgctcttaaaaggaaaaggtgacaaggctcaacttgaaaaacgtattcaagaaatcattgggcagttagatgtcacaactagtgaatatgaaaaggaaaaactgaatga

SEQ ID NO: 125891 - DNA, 706 bp, Homo sapiens
gctttttagttaacatctgaattcttaaaatctacttttcatttgagaaataattacaaaaattagtattgagcaagttttaatatacttattgttaattaaaatattgatgccaaataaacattgtactttaaaaaaaaaaaacaacctgggcttgcccatttgagctaaaataggaatctgatcttgcttgcttgtaaagtaattttcctttttagagatttgggtttctttgaggggactcaagttagattttgtgaagtctgttttaatgttgttgtttagttataacgagaagtaaagtttttttggaatgaactgtagaatttagtttattgttaaaagtctaatttaaaggtattatttaaaacaaacggtgaattgtgtgtgaattacatctcaataaagtcattaaaaaaaacttcagtgtcttaatagattactatgacttttttttttattatactttaagttttagggtacatgtgcacaacgtgaaggtttgttacatatgtatacatgtgccatgttggtgtgctgtacccattaaatcgtcattgacttattttattatcaacattccattgattgtttttttgtagaatgatcagtgatgtttaagactcatttggttaattgacataatgtataagtaaagagtaggtgtattacgtttataacttattgaatttgggagaactaaatt

SEQ ID NO: 125892 - DNA, 378 bp, Homo sapiens
acaatactgtaggaaaggacacctctacagagatagcaagagaaactaaaaccttaaagtaaggttacaaataacctaggggatgacactaatttcatagcaagaaaacacaaagggttataaaaaagcatagtaccaataaatgcaaagaaaaaaacaacctaagtccaaaagttgattaaaggtccacagaagaaactgtacagtgtttaaaaaacaaaaactacaaatatactgatatccgtatccatactatatatgaatatagaatagatatgaccatatgtatattgttacacactgttttttagcactggttgcagaagtcaagatcaacactcaccctgcaggctaagtaactgtggtaacagatgtgtg

SEQ ID NO: 125893 - DNA, 544 bp, Homo sapiens
aggcgttggaccagggactggggcagatggtgactaacacgtggttctgaccttgagcaactcagtgggacaatgagctatttagcaagtatggttcatggccccatgatgggtatgggacctgggagacagtgaaatggacctctctgagcctgagttccctgcagccatgggggtcctgtctgttccgcccacctgaccacctggttgtgaggattaaatgaaataacataggaggaagcacctagtccataacagacactcaactcattttcactcattcagaaggttgttttggttcttctcaaccacctcctttgttcctcaagttccagtaaaagaatgctaattagtcttcttgaagcagaaatagctgagtgtgcatgaccctaaatgaccccccgggggttattgttctgaggctccagctcaccccaccacccacagaattgacagctttggctcatcccttaatgcctgaggccaatgtgcttcctttcctatttttcatttttcttatctctaaaaagggcctgttaagacc

SEQ ID NO: 125894 - DNA, 413 bp, Homo sapiens
aattcgcggccgcgtcgacatacaaattccctgcagccatgggggtcctgtctgttccgcccacctgaccacctggttgtgaggattaaatgaaataacataggaggaagcacctagtccataacagacactcaactcattttcactcattcagaaggttgttttggttcttctcaaccacctcctttgttcctcaagttccagtaaaagaatgctaattagtcttcttgaagcagaaatagctgagtgtgcatgaccctaaatgaccccccgggggttattgttctgaggctccagctcaccccaccacccacagaattgacagctttggctcatcccttaatgcctgaggccaatgtgcttcctttcctatttttcatttttcttatctctaaaaagggcctgttaagacc

SEQ ID NO: 125895 - DNA, 288 bp, Homo sapiens
acctccgcctcccaagttcaagcaattctccttgcctcagcctcccaagtaactgggattacaggcacccgccaccacgcccagctaattttttttgtatttttaatagagacggggtttcactatgttggccaggttcgtctcgaactcctgacctcgtggtctgcccacttcagcctcccagactgctgggattactggcatgacccactgcctgtggcccataatgagtatattctatttaagaagatacattagtatattgttttgcagcttggggttatttct

SEQ ID NO: 125896 - DNA, 589 bp, Homo sapiens
ggctcaagcctataatcccaggacttagggaacccgaggcagtaggattgcttaagctcaggagcttgagaccagcctgggcaataaaggagaccttgtctctacaaaacaaaaaactgtcccaaaaaaaccccagaaaatggtgtggtgttgcatgtctggtcccagctactcagaaggctgaagtggtaggatgtcttgagccccagaggtcgaggctgcagtgagctatgattgcgctattgcactccaccctgggtgacagagcaagaccctgtctcagtcaatcaatcaataaatgaaatttttgtgtgccccatggacacaaagatgttctccctgtgttttaggagttttttggttctggtttcacatatagatctttgttccatcttgaatttttgagatggagttttgttctcccccatattgatgtccagttgtttcagcaccatttaccaaaaaattgctgatattggctgggtgcggtggctcacacctgtaatcccagcactttgggaggcccaggtgggcagatcacttgcggtcaggagttggagaccagcctggccaacatggtgaaaccccg

SEQ ID NO: 125897 - DNA, 503 bp, Homo sapiens
gatgatgacaacagatgacatttattaagcgcttactatatgccaggccagccccttttctaagggtttaatacacattatatcattatattccctacttcaaccctataagaagtgttgccattctccccattccacagatgacgaactgctggctcagataccttaggtaacttgcccagagattcctgaatcataagcgaaggctctttgcactcggagcctttgcttgtaactggtgctccccctcacctccctgccaaggcttccacaggagctgcagcacagttggctccagtctgacctggccagagcaaggagaagagatgggtttgatgcttgttgaagtgggagggggtccatgtgcttccgatgtcagtgatgctgatgccaagttccaggaacagggatgctcagccacaccttcatccaggccgagggctaggcctgaaaggtgtgcccctcctaaataaaaaataaataaaatatgtatagagagcatc

SEQ ID NO: 125898 - DNA, 427 bp, Homo sapiens
aaattgtgacttgggtaaactgaatttgttctcattctgcatagacactggatggtttaggaaagcttagtaacgttagcataatattatggctgtatgatttcatagtctggttcagtttcattggcaagaggaggtgtgatattgtagagttttgaactaaaaattgagacttcagtcccaggtttgacattattacttccatgctttgagagttaaagtatgtttgttttctcacctttaaaatgggcttatcattacttgctttacacagctcatggggttattgagaatcagataagaaaatttgcatgaaagatttttatcaatgtaaaggattgttattgcgttgtagacagttataggtatatctgttgttttcactcaaagactcaatttttctttctgaaaacctttttttttaaga

SEQ ID NO: 125899 - DNA, 147 bp, Homo sapiens
gctgccgttgaagaaaaatcagctttctcatattactcacatatatatattattacataacaatgtgttaaattggactacagtgaatcaaagagttattgcagcttctgaaggtgacagacttttaactttcagatattgcttaat

SEQ ID NO: 125900 - DNA, 225 bp, Homo sapiens
taggcgccctctgttcacaaagcatcacagctactattgtctgaagaggccaggaaagctgtctgaccagacctttgctccgatggtccagagcagattggagaaggcccaatcgttgcagggaggtgaggcagaagtggctggtgcggaccccacagccatgcccagccccctcgtgcctgaccttcctccgtccatgaacgctgcacattagaccctttccag

SEQ ID NO: 125901 - DNA, 454 bp, Homo sapiens
atcctactctagtccctttcctcatgcaacagctatgaaatagctggttagtactgacagcaattcttggccacaaacagaaccagttctatagtggaatgaaacttctagcagccttgcttaaactattcattcatcaacacactgtggtttctgccgtagaaggaaaggaacacgaatacacaagaagtgaaaaaaaaagaaaggcgtcttagatgccaatcttttaaaagtttattttaaaaaggatattgggggccagtcacagtggctcatgcctgtaatcctagagctttgggaagccaaggtgggaagatcgcttgagcccaggagtttgagactagcctgggcaacatagtgagacccccatctctaaaaaaaaattttttttttaaatttctaggcatggtggtacatgcctgtaatcccagctacttaggatacagtagggaga

SEQ ID NO: 125902 - DNA, 437 bp, Homo sapiens
gaggaggggccaaggcagaaagctgatcagaaggcagaggtggacgggggcagggacatcttcagatctgggcactcgctgccccacatactgtggatgctaagctgggagacagggacacgggagcccagctgccatgtgggaaccgccaggccccgggtatatgcacatggctcaattccaagccccaaggggacagacatggagatgcgggcactgatgaccctcatgcctgtgctggggccagtgtggaagggagaaagggcatgagcccagcagacctggcagagtgtgggggagggaagaggacactggattcaggaacaaaaggctccaacaggtggagtgaatgggtagcttgagaaggagcaggtgttgcgcacctgttcctacctggcagggctgacctcggggtcacagcccatcccagcacatac

SEQ ID NO: 125903 - DNA, 480 bp, Homo sapiens
ccaaagttataaaaaaatattgtttcttcagagttttattttggaattatggatgagggattgtgggcttataattaattctcaggttgtcatgaggaatgagagtgtggtaaagctcttgaaacacatcatatggtaggtatgtatgcaatctcaatttggaacaagatacaaatgtccaagggagtggatttttagcttgaaggaagaaagttgctacaatggacaacgtacagctctggaaccagctaccttgaaaagttgtgcacaaccaggggttgaaggtgccttagaagagagtcttcctgtggtgggagggtgacagaattcattgtttatgaacgttggctgcagatgatttccctttcatgtatcagaggggaaaggcaaaaaatggtatacctgtatgtatgtgagacgcaggattatcatacatatatttatttataatcaataaatattttactgcataaaaaaaaa

SEQ ID NO: 125904 - DNA, 887 bp, Homo sapiens
atgaaaagcaaaatggaaagaggacagagttaaacttcctatcaataatcacatattaaatgcagacgatataaacacccttattttaagggcagattcttcaagttgaataaatgctcacctccaaggagcactcgctttaattataaagacacaaaagagttaaaagtaagaaggtggaaaggcatataccacattaacactaatccaaagaaaactgggatgacgatattagtatcaaaatagattttagaacaaagaatgttaacagtattaaagaaggttatttcattatggtaaaagggtcagttctatggaaggacattaaaaacactaaacatgtatgtacctaataacagagcctcaaaatacatgaagcaaaaaatagacctgcaaggaaaaataaataaaactacaagtataatcacttctccttctgtaactgatggaagtgtacagaaagtcagccgggatataggaaaccatgaacaaacccatcaaccagcttgacttaactgacagttgtggaaagaatcctctgtgctttgttttcaagtgtacttggaagggttattaagataaaccatattttagtccataaaacaagtctcaataaatttggaactattcaagtcatacagatgtgagctctaaccaaaacggaatcgtattagaaaccagtaagagaaagatctctagaaaatcccccagatattaggaaagtaaatagtattattttaaataacaccgggatcaaagtagaaatcaaatgggaaattagaaaatattggaaccaaatgaaaatgaaagtacaacatatcaaaatgtgtggaatgcctctaaagtgtctgtaagggaacatttctggcacaaaatatctatactag

SEQ ID NO: 125905 - DNA, 366 bp, Homo sapiens
tggtctgttgtgatagtagagacactcttccctccgacgcagcatctctgtgtggctgcccctcctctacctctccaaacctatggggcttgagagggattttataatccaacactgcactcccctagggtgagcctttcttatctagaaggcttctttagaagatgcttctgagaattgccacatctgggccactctgggcaatttgcctgtcttctctttccatctttgcagcccttgtgcctgttcaatcaacagttcccacttggggttggggaaggttctccttcatctggacatttccagagtcatccaccatagggtttcttcctggctttgcaatggtctgcctgccctgaggctctg

SEQ ID NO: 125906 - DNA, 409 bp, Homo sapiens
ttggcacatactattcagtacatttcatcctcctggttacagtggcaggaatcatggatgatcagaaggcccaatacaaacaatgaaactcatggtgacatctgctgagggattctggggaaaaatttccccttacttagagggcagatactgaaaatatgctgtcttctttcttaaagatatgaacaagaaaacacataaatctgctgactgcagtggccaacttgagaaaatgagagccagccttaagacaaagtagaaactataactgctgtccaaaacagtagcctctggctacatgtggttactgggcctttgaaatctggctagtccgaattaagacatgttgtaagagtaaaataccagttttgaagacttaagaacgtaaaatatctcaatttttatacta

SEQ ID NO: 125907 - DNA, 280 bp, Homo sapiens
gggggtcttcgtggagtttgttggtccagtgttcaactcttttctcttttctcctctgagctcctacagttcccttctggccacatcctgcctcctggtccagggcacctcacacagatgcagccctccgaacacacctacccaagagctctggggttcagggaagtccccctgacctcctcaggccctgttccctgcacgctcagctctaccatgcagggtgaacaggagcacacttttgcaccttctctctgctggccaagggggcccagaggggcgg

SEQ ID NO: 125908 - DNA, 424 bp, Homo sapiens
atactgacccccggggtttgattaggagtccctcttctgtgctcttatagtccctgtgcttctctgtatcacaatttggaccaattacttaaattctctatgcctacatttctatctgtaaaataaggagaaaacagtatccacctcatagggttgtgagaattaaatgagttaatacatataaagtacttcaaatagagcatggcacatagtaagtgttcaattattaccatgttatttttgttgtaattgtctaactagtacactgaaatatctaagcagaaattggtatttgcattcgtgtctagcctggcatatagtagatgcttggtaaatatttgagaagagaattaagggatctaaggttggggcaggaaggtacaatctaaattaatggtagaactggagatttagaggattggga

SEQ ID NO: 125909 - DNA, 255 bp, Homo sapiens
aaatgcttgggaccagaactgtttcaaatattgaattttcttcagattttggaatatttgcattatatgtacaaggtgagcatccttaatccaaaaatccaaaatcaatttcctttgagctttgttaaaagaaaaaccttagcctaattaagtttaacagagtttaattcatgaattcttgaatcaggcagcctcccaagccagagtaggctcggagactctggcgcagccacgtggtggaaaaagctttataga

SEQ ID NO: 125910 - DNA, 636 bp, Homo sapiens
agctgaaagtggctggtgttcttcatagggcgatgatggcagtggtcagaggggtctcctggtgccgtcctgctggagctccacacatccacgctgcggttgctgccgaggttcagctgtgggagccactgggcagcagcatgtgagggccaagggtcttactggccacgacgctcaccctgtgtgatgctcatggggcctccactgctcaggtgcaggtgtggccaggatggaggccacggtcctgggcttggctgtggcccagccaccctggctggtgcctttcatcttgcggaccctgagtgctgtctcttgtgtcctctgagtcctaggaagtgaccgcagtgggagcaggaccgtctgagtcctaggaagtgaccgcactgggagcagggccgtctgagtcctaggaagtgaccgcactgggagcaggaccgtctgagtcctaggaagtgaccgcagtgggagcaggaccgtctgagtcctaggaagtgaccgcactgggagcaggaccgtctgagtcctaggaagtgaccgcactgggagcaggaccgtctgagtcctaggaagtgaccgcagtgggagcaggaccgtctgagtcctaggaagtgaccgcactgagcgcaagaccgtctg

SEQ ID NO: 125911 - DNA, 256 bp, Homo sapiens
atgtaacacaatcaaagggtgtgtctgtggctctgccctttctaggtacccagaatcctcctctgggtcttcagctggcagaggagaaaaagagggagcaggatcgtgtgtgaaggctttatagagcagatactctgcccacattctgctggccagaacttgatcttccagtccatctaactggagggaggctgggaaaggccagccatacgccattgttatcagtcctgaccaggtgcttggtgaaccatggtct

SEQ ID NO: 125912 - DNA, 470 bp, Homo sapiens
ttttttgtagaggtgaggttttgccatgttgcccaggctggtctggaactttgaagactcaaaccatcagcctgtgttagcctactaaactgctggtgttacaggagtgagccactgtacccagcctagaatttaaaatcagatagatacccttacaggtttgctaaacttattggggaaagtttctatagatttattgtggaaaaatggaacatctacaaattgttaagattgccttcagaaaatttttgaaatttttaataggatcaaagttgggtaattcaagttttttctttttggatttgggcctaggctttcacgctgaactctgctatcttttcaaattgaccttcagttgagatttctgtatacaaccaactgcatgctaggcacctgcaacccacagctgaaaagctaatgtgtctaaaatgaaatcttccctcccagaagctctgtcctgtgttcctagt

SEQ ID NO: 125913 - DNA, 679 bp, Homo sapiens
gtcacaaatcagagcattaacttagtttggtgataggcaatgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcctcagttgaatgtttaatgaaatgaaactctgtgaagtgtatcacacagttgtttacggagtggccatcctcccctgcgtcagttcagagatttgcctgctgctgggatttctcattaggcaccactgctaccactatagccctgtgaggtggcaaaaatgaagaagtggtgctgtaccccatttaatattctggcccaagtatagtcccccaaggccctttccttactgggacccataatatatctgaaaccaggcaagtcatgaggttgggtggaacacagacatctgtggctttttaaagccccaagtgagtctgatgtgcaggcagggtcgagaac

SEQ ID NO: 125914 - DNA, 503 bp, Homo sapiens
gccctccatgcctgtggggctatcttggaagccacatgctccctgccatgccctagtgacaagtggccggactggagctgtaatcttatcagtctggacctggacctgggccccaggcatcctcctgccatgtcctagtgacaagtggccggactggagctgtaatcttatcagtccggacctggacctgggccccaggcgtcctcctccagggaggccctggtcctaggacttggggaaaagcattgggttctaaggcagtatccctgacctcctgggcctcagtttccctacatctgcccaccgggctgcagccttcctgggccccctgagctcctgcctgagagtcccctgcagatctggctctgacatcccctcattaaaggggccttcctcagccttacccctgagtggccccagcaggctctggccctcgctcccgctctctggatgttggataagtcgctgctgagtccctgcagggaggcgtctggctagagcag

SEQ ID NO: 125915 - DNA, 629 bp, Homo sapiens
tcggtacccctgctctcagccagttcggagtgcacattgcccagagctgacagtgacttcttgataattcctttgcctcgtccagctcggcctccctctgcgtcccagtcttgctgaccttggtcacgtcctgccagggtccaccagatacagcttcccactgagcttctgctccgtttccatgttctcctgcttgattttgatgaggaagatgctgtgcgtccgagagctgtgttcattggtgttgttgcagccaagtgcgcatgcgctgagatgggtgaacccatgtgtttgggaactgcgaggagcccggtggctggaccaggggatggatgtgagttgcagaaggtggagaaggtgaagaggtgacagggccaggcacatgggaggagcccggtggctggaccaggggatgcacgtgacagggcgagaggcattgagtgagtctcagaagggggaaaggtgacaggaccaggcacatgggacccgggcatgtgagccttgtgggcttctacgcagacagagacaggaggttcctggaagctatgaggcttctgggctgttatcttgaggctggatggaggagatagagaatggagaccagtctggggctgctgaggacctgctga

SEQ ID NO: 125916 - DNA, 279 bp, Homo sapiens
gatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaaggg

SEQ ID NO: 125917 - DNA, 496 bp, Homo sapiens
ctcatacagcatttactaagtgctatgtactgttcaaaacatattacacatattcacacatttcatcctcccaaaaagcctatgaagtatgtgctgtattatccctattttacagataagaagagtgaggctcagcaagtaactaagccaaggctattcagccagtaactgggagaactgtaatttaaacccaagcagtctgactctcaagtccctgcttgttgtgtgtgtgtgtgtgtgtatgtgtcagtgcagtggcgtgatctctgctcactgcaacctctgcctcccgggttcaagcgattatcctgcctcagcctccagagcaactgggattacaggtgcatgccaccacgcccatctaattttgtgttcactgtgtgagccaggctggtctcgaactgcagacctcaagtgatccgctctcctgagcctcccaaagtgctgtgattatgagcgtgagcccctctttttctgttgttgccttaccttaaga

SEQ ID NO: 125918 - DNA, 145 bp, Homo sapiens
aaagaggtgaagctgccaaaggaaattaaaaaaattttaagtctggctgggtgtggtagctcatgcctatcatcccagcatgctgggaggctgaaatcaagacttcttaaagaatagagtttttttcccctcaaatgatcattaa

SEQ ID NO: 125919 - DNA, 377 bp, Homo sapiens
ctttttcatggccgaataatattctattacatatatttatcacgttttgtttatccacttccctgttgatgaacatttgggttatttaaccaccttttggctgttgtgaatagtgttgctatgaatattcatgtacaagtacctatttgagtacttgctttcaattcctttgagtatagaactaggagtggaattgctgggtcttatcgtaatcaagtttaatttgttgaggaatcatctaacgcaggctgcatcatttttccctcccatcagcaatgtgtgatgctttcagtctctctatatcctcaccaacacttataattttccattaaaaagaaatcatatggctgggcgtggtggctcatgcctgtaatccc

SEQ ID NO: 125920 - DNA, 484 bp, Homo sapiens
tcactgcactatattattttaccaataaaaacctaagaattaatattaaagctgtacatagcacaggactcatctaaatatccttcctaattttcaagcatcaaactgaccccttctagctcactgccaagttgtgatacttttttattttcattacaccccaacatctgataacataatgagaaaaattagaacttatccatggcactctccttactttacccagatacaggtataataagtcttccatgttgattctgaagccagaccgtctgaatttgattcctgatttgctacttattgtgtgactttaggcagattgcacgacctctctgtgtttcaatctctccccatctatgaaatgagattaataatagcacctactcacaaaggcccaaatcaatgtccactcaagagcagcagttgcaagcattacttatctgtcctgatctgagaagtatgacatgagataaacacactggcc

SEQ ID NO: 125921 - DNA, 462 bp, Homo sapiens
ttcccctcctgttaagttccaaaatctttccaaagagcccataagttttaactcaatattaaattagaatatatctatgaatacccaatatttgtcaacaggcagtatatattaaattctccttggtcctactttactgtttacttggaattaataggatgcatctcccaaattgcaacatggagggtaggttggcatgcagagtacgttactaaatctccattgcccagaccccaataaatccctgtaatatggctctagtggactgaggaagaagtatctcctgctccctctcgactaggcagactgaagcagtcagtagtactttgactagaagcaataattccttaattgcctgttgccctgctgccaagattctctctctgttctttgctacagctattaatgccaatcaacttaaggccatactgtgttaatgaaaatctagagtctctggatgga

SEQ ID NO: 125922 - DNA, 211 bp, Homo sapiens
cttggtacccaccggctcactcagacactgggaactgagtattcctggggttcaaggaggtccccatactggggtgaaggggctacctccaagtcttcctgactgtggcctgtgttgggccaggggacttgcctggtgccatcaggagcctcacccatgatgggattcagttgggagggccctagagcaggacacgggttcccatactcag

SEQ ID NO: 125923 - DNA, 491 bp, Homo sapiens
ttttgtatttttagcagagacagggatttgtcatgttggccaggctggtctagaactcctaacctcaagtgatctgcccgagtcagcctctcaaagtgctgggattataggcgtgagccactgcacctggccaatcaggcttttgtgacactgccagaactgtgtttgaggaagattagactgaccttgtatgctaagaattcccaggaaaaaaaaagggagatggtttaggaatctattcagggagatggtttaggaatctattttatggatgacaaaggtctgaattacggtggtggccatagaaatggagtgggtagggccagtgtgggagaagtctcatgggaagaatgggtaacagtctgtgctcatctgggtttgaggagtgaaagaaagaggtgtggaaaatacataaagagggaagtcgggttatacaaaggagaggagaaaaataaaggaggttataccaaaggagaggagaaaaaataaag

SEQ ID NO: 125924 - DNA, 281 bp, Homo sapiens
gctggttcactggaccatgtttgaggttctgctgataactcttcagcagaagtagctcttcatttacttgtttgtttattgatgtattaactcatgtatagcatgcaggacatgcaaagtattctatttaaaaatagcctttgtaacctcccacaaaaaagttcttattaatcaatggtgaatcacataaccaatagtctggaaatatagaaactcagatgttatgaaatctctgggctgccataaaatattatctttcacctacttcccagacctggaga

SEQ ID NO: 125925 - DNA, 957 bp, Homo sapiens
tttgcaccgcggcaggaaggccacaaagtacttaaaaagccgtcaactggaatgggggtagtgttctttccaggcccgctttttccaaagttaaaagcctctttatatgaaaaccatgtaaactctcagcagccccctttgcttcactgccttttctagggagtgcattagagtcatttttacgtctgtagtgctaaagggtcacctagttaggagctttaacatcggattcgctgagagggtcatcggtttttgattcttctagagtaggcctccaccaagaagggaatacgtctaatacttgggatctgtggtttgcaacacaagtggtatccctcagactcctgaaaagggactatgccgtgacttccttccggctgcagtgagatccgaggtgtttacaccaccctagttgccgaatgcagcctttgctcagctagagtgtgtcctctgacggagcctggcctctgtttttgtctctgtgtgttgtgtgtacacactgaacgtggacatcggatagttcttttctgtgcctcctcagagaggcttggcttccaaacctgggagtttgttctctacccattggctagaaaaggccgtccataaattagtatatccaggtgggactagcacgatgccacgcacactgaacattttctgcagaggggcgttagcagtggaagtagagacacattctggtcctcctttagagtcaagccaatgctgttgctcgtgtatttgtgcacaattattcatctccgttgatctgacacactctcttgaaatcactagattatgaaacagatcttcacctcctgattccaatactgcctggtttcaacacaggggttgttttatttttttacttctcctagtaaatagagatgtgtataatttttgcccattttatttcttgagttgtctgcaccacttcttttcttactctgaaataatgtg

SEQ ID NO: 125926 - DNA, 463 bp, Homo sapiens
agctgggattacaggtgcccgccaccatgcccagataattttttgtacttttagtaggaacggggtttcaccatgttggccaggctgctctcaaactcctgacctccagtgatccacctgcctctgccttccgaagtgctgggattacaggcatgagccaccatgccacgcccacatttgccttttttctgtttttgttttctgtgcaccccagtggattggatgttgcctacacacattaaaggccgattttccccacctagtccactccgactcacgtgacaatgttctctgtaaacaccctcgctgtaaacacagacacacccaaagtgatgctttatgaggtttctaggtattccttaatccagtcaagttgatacctaaaattaactatcacatgggctggaatgggtttgttaccctcatcaacctctgcccaggaactggatcccttcatgaaacc

SEQ ID NO: 125927 - DNA, 328 bp, Homo sapiens
tcctgtccaccgaggttgtagagtttgaggggttagttcttaacaagaactgaccgtcgggctaggatgtctttatatggctgggtatctggagtgggtaaaaggaaattggcagctcagcggatttcatgtctagcttgttgaaggactggaagatagttaccaagagggctggtgtctggaatgaggttgggcccatgtaaaaatgtgcggccatataggagatcaaaggggctataccctgtgggttcttgaggggtggctcaaatttggaggagagcaaagggtagaagaattgtccagtcttttttgcgttggagggtgagtt

SEQ ID NO: 125928 - DNA, 842 bp, Homo sapiens
atgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagag

SEQ ID NO: 125929 - DNA, 216 bp, Homo sapiens
agccaggttggaagtgtgtacaggtatctgagggtgtgcacgtgagcaagagggtgtgcaagatgtgggtgactgttgggaccacagagctgaggcctgtggtcagctcaggtcagaactgggaggtctgtttcccttgggaggacctgtctgctctgagggggacccggacaagtgcacatatgcatgtgtgtgtctacacacacacacacacac

SEQ ID NO: 125930 - DNA, 352 bp, Homo sapiens
ctcaacaaagattattttatcagtcaatctgcaccttcaaaagtgctttgggtttgcccctgacaaccacctgccggccagcgagtgagtaaaagagctgggcctaatgcatccctcgagggctttcttctgcatttctagactgtcatgcacaagatcatgcaaacaccaagtgctcaataagggctggtggagttaaacccaggacttctggttttcagccctattctctgtccacagcaggtcctactcctcaccccctccttcatgcgtccggcttcttggtaggtgaggctgagcaacttttttaaaaggctgtttcatagtccaggccaaaggctgagccggggag

SEQ ID NO: 125931 - DNA, 719 bp, Homo sapiens
tgaagggtaaaatttttcaccagagtaaacttgagaaaccaactggaccttgagtattgtacattttgcctcgtggacccaaaggtagcaatttgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatgg

SEQ ID NO: 125932 - DNA, 778 bp, Homo sapiens
gtaagcatgcatcttcctcatagcattcattcgtctttatattcaagcaaaagttactgaaggcctatttatttgctgagtttaagatagctcactatggagtccaggcccctgtactccttctgctgaattactgcagtaacctcctaaaaagcaaaagttgtttttttctccttcatccaccattgttctttctcatctatccccactcaacattcagagtgatctttctaacacaaaaatctgattatgtgaaccccaagttaaaaccttccaagggcttcccaatgctcttaatataaaatccaaactgtcccatatgatctgacctctcccaaactctccagcctacttttatgccactttcccctttactctctatactttggccatatttgacttctctcacttcctcacccctgtgttctcacagtacaatgtacatacgtttataacattgatcccactgtactgtattctctggtttgcctttcctcactagaatgtaagctcctcagaaggcagtgagaccatgctttatattacccttgcactcctagtttccggcagtgttgactcaaacatttgttgagtaactgagcaaataaagaaaaatagaaaagacaggagaaggaggaggtaggctaggggaagataattttgtttttaaacattaagttttaggtggcactggtttagtggaatagaaatgcacaagaacaatagagatcaggtctgcatgtattgacttggaagttatgtacatagaaataatgac

SEQ ID NO: 125933 - DNA, 283 bp, Homo sapiens
tgagagcccagagagggtgcctgtgcatgtatacacacgaacacacatgcctgggcaaaggtggggtgagctgaggagaacagaccacattcttagccaggagcagggcggggtccatctctggtcagggctgggcctggctgctgggtggcctggttcttcaaagtcaccccagactcaatgggctctcaagtctccttgtatctttgtccctttcatgaacacacaacagaaattaccaactaagtaagacagtggtggctaggcacaatggcacgtggat

SEQ ID NO: 125934 - DNA, 329 bp, Homo sapiens
agagcagaggcccaggagttcgaggctacagtgggatgtgatcacaccaccactccagcctgggtgacaaaatgacaccttgtctccaaaaaaaaaaatctactgttagcagaattcaatacagcttacctctccaaaaatctactgttagcagaattcaatacagcttaactctcctgtggagacctttgttttagcctcatacatccttggagaaaaaaagaattcaactttacagaaaaatagcaaaataggagaactcttcttaactttcatgctcattaaagtgaaaattaattaagaagacatctgaggtgtttttttttttg

SEQ ID NO: 125935 - DNA, 244 bp, Homo sapiens
atacaatattaataactcttggaagccttaggatattggatagtacaagcaacttggaagagacattcactcttgaaggaaagacttctgagtattcagtgtaaataggctgatttaaataatggtgtgtttcaggtaagaaaatgttttaagagacagtttagtatgttgcttttatatttagttggtattgtttgctcagaagttcagatcattatgaggatttgtgggtaaaattgcatcc

SEQ ID NO: 125936 - DNA, 612 bp, Homo sapiens
tattattattattattttagagacagggtctccttatgttgctcaggctggtctcaaactcatgggctcagatgatcctcccgccttggccccctctgtagtgccgaaattacaggcttgagccactgccttcacccggcctcaaatattttttctgccccacactcctctctttctgggactccaatagcttgaatattagactttttgttgttaccccacaagttcctcagactgttgttgtttttcaatctttttttctctgtgttgctcaggtttcatattttttattgatctatttttaagttcactggctcttcactctgtcatctctattctgctgttgtgcctacccagtgattttttaaaattttatctttcagtttcaaaatttccatttgattagtctttatgtctcctcttttctattccaatactttccattttaatatttgtttcaaggatgattgctcattcaatcatttttataaagctgctttaaagtgcttgtcagattattccaacatctgcatcatcttattcttggcatctactggttgttgttccccatttgaattgagcatttcattattctttgcatgctgagtaatt

SEQ ID NO: 125937 - DNA, 349 bp, Homo sapiens
tccttgaagttataagagtatgccacttctgccactacccatcactgtatttttctcctgttgctgcaagtctctacttagtatgacctttattggatcatgttttgagtctcaaaacgttgaaattatttctgcttttagaatttaactctacttaatacagtcataaatattaacttaaaaagcacaaaggcaggccagatgcggtggttcacacctgtaatcccagcactttgggaggacgaggcaggtggattacttgaggtcaggagttaagagaccagcctggccaacatggtgaaacaccgcctctaccaaaaatacaaaaattagcaggacgtggtggcgc

SEQ ID NO: 125938 - DNA, 294 bp, Homo sapiens
gtcactaggagagaagtagaccatcatcgctgcccgacttttcagttatcttctggttttgtggtggttgtgcttttgtcactttacatgaggtaaaatgggtatgcttttgtcactttacatgaggtagttgatgttagtaatgcgcattaagatagaaatatcttgtatttattgataaattggattttttttttatttttagagacagggtctcactctgtcccccaggctggagcacagtgacgtgatcaaggctcacggcagccttgacctcctgagctcaagcaatcc

SEQ ID NO: 125939 - DNA, 536 bp, Homo sapiens
cacagccaatgtgtatccacccctggagacactggctgtggtcacgtgtttcttagtattgtggaattgtgtaatgttggtccctttcacttttcacctaataaaaataagccagtgtcaggaccacttgctgaggcatgtgtaccaataggcacaggcagcccaagttgtcccttgctcacccctgaccctgaccccaggaagcagcctttgggggctccccactgcccacagcggatgtttagcaatgcaacatctggaatttagtaataataaaaaactattttaaaaagtactttttaaaggctgggtgcggtggctcacgcctgtaatcccagcactttgggaggccgaggcagttggaccacctgagatcaggagttcgagaccagcctgaccaacatgatgaaaccccgtctctactaaaaatacaaaaattagctgggcgtggtggcatgcgcctgtaatcccagttactcaggaggctgaggcaggagtatcacttgaacccaggaggcagaggttgcagtgagatg

SEQ ID NO: 125940 - DNA, 534 bp, Homo sapiens
atttaactgataatgatattggtcacccacatgttccggatcctgttgtgagtgcttcatgggcatcatctcattcaaccctcatagcaacactatcagacagtcactactgctgtctacactttacagatggggaaaatgaagcacagagaggttcaacaacatgccccaagtcacatgggtagcaagggacagagttaggattcaaatacaaaaaggatggttccaagcacagaactcacagctccactggctaaaccgaatgaccactcatctgagccttccctccccatgtcccccaacccctgatggcttgagatgagaaagctcctttctggagtttggagggtgactctgcaaccttgggaaggcttagaaataagaacaggtaagtcaaaccaacagtgctaagtttaggaacaagtttgtgaacatcatgataatgggcaaaggtttctaaaaagatgcttgaggctgggcacagtggctcatgcctgtaatcctagcactttgggaagccaaagcaggaggatt

SEQ ID NO: 125941 - DNA, 743 bp, Homo sapiens
gacctaagaccttgtaggtggtttgaccactggggaggcagctggagacattcatgaaattcagtcacgtatggatgttaggaagatgtgttagcatcacagcttgtaggatgaagccgtagcagtacttagggggaaatttattgccttaaatatttgctgcaagaaaagagaaaggactgaaagttgataaatggccgtgtcagaaagttagaaaagacagaataaaccagtggaagatggaggaaggaataatgaatattaattttatagattggatcagaaagccagcagctggtcctagaatcatcattgaaattgatgttgttaaattgtatcgaaattgttaaaaatcagcactctagccagccttccccctttaagaaaagatctcagaacactaatcctgatggttttatgggcaagttcttccagatctacaaagaacagaaaaccctacctgtacacaaactatgccaaagaataggggaaaaggaatgatttttagcttattctatgagactcaagagaccctaataccaagatcagaaaacagtctgagaatcacctctgatttttctcattttaaaatacacatagaaatctcacataaaaatgttaacaaaccaaatctagtgatgtgttagaaaagaatctccatcaagaaacatttataccatagaaactttctgtgaactggcattattagactgtgcattactgtaattccacatacttcagat

SEQ ID NO: 125942 - DNA, 478 bp, Homo sapiens
tgttaaatccagtgacaattctcagtattctttccttcatttcatcaaagggaatatattcgacattagggttgggaggacctcttggctcaggagctgaagttctgaaatcatccatcactttctccagtttgaaaataaaatagcctttaaattgggaccactgaatctgtttctccagtcttggctatatgacaaagaaactgatccaggacaggacaaacttcctttttcccctcttctcaaaatctttcagcgcctcctggagactctcaacgtccatggcttcctggagtccctcacagcctccgcctccctccgcaggtctcttggggaccggaatgcctccccccaccccccgacgtcctcccactccctcgcacacactcccgcatgcaggccaagttgggtggggggaacgaagggagccaggggaagcatgtgagagagtgagaccaacagagcgagcatctcccca

SEQ ID NO: 125943 - DNA, 429 bp, Homo sapiens
aagttggcaaacagtggggttggacacaaggtcggtggcccaaaaagagtgctaaatttttgctgcacatgctaaaaaatgcagagagtaatggtgaacttaagggtttagatgtagattctctggtcattgagcatatccaagtgaacaaagcaccgaagatatgccactggacctacagggcttatggtcggattaacccatacgtgagctctctctgccacactgagatgatccttactgaaaaggaacagattgttcctaaaccagaagaggaggttgcccagaagaaaaagatatcccagaagaaactgaagaaacaaaaacttatggcacgggagtaaattcagcattaaaataagtgcaattaaaaggaaaacaaaaagaatggaggaaaattaataaaggccattaaacaaggtaaagttg

SEQ ID NO: 125944 - DNA, 400 bp, Homo sapiens
caggcaggatgtgggccaagggctggttgcgaggcatttagggtacagctcccctgggcagagtgggaagcctctggggctgaccagcagtttggaaatgacccaggggcagcaccatggctgtgcccatgtcagaccctggtccggctagccatcttggcacctgggggaggggacagtggtctggaaagggcccatccctgctgtgcacacagtcctgtaaggctccctcccaccattctctccccagctcacaggtgagactccaccacagtcaggttctcagagagattctagtccactggggtctgagcagggcaaagccacatactacctgaactgagaaattctctgctaggacccccaagggggctgttgtgggcctcatgtggaagtgggt

SEQ ID NO: 125945 - DNA, 414 bp, Homo sapiens
catttggtggacctgaaatgaccactccagcactcaaatgctgagcctagacccttaaccaggatgcagacatcttgagaacaaaacaaggtaaaatgaccataggtcagaggaagagctgtccacactctatacattgtcatcgggacagtaagtccttttccttggcctcctgcccccaagtacaggagggtctgcagaatgtcaggaactcgttgatcttagattagaacccactggggctacagtcagagagcaggagaacagcaaattgtggggcctcaggatgaggctctctagatgtgattaaatgattttcctcttctaaaaggacaggagaacttcaagatgagtgcgatttccgtgctgtgtactgtgcgttttatcttcagttatctcgagaaaaaaaaaaaa

SEQ ID NO: 125946 - DNA, 328 bp, Homo sapiens
agaacataaaaatttactcattggaaagctgttatattcaatgtttgtaagaaataagccatagattaggaataacaattgttatggtactctctgttggggaaaaagaatgaagttctgttttcagttataacccatgagttcttaatatgtgcaccaggaggttttatacatgaggaattttgaatgagtttttaaaagtcagtaaagcacctgtaatcccagctactcgggagactgaggcaggagaatcacttgaacccagtaggcggaggttgcagtgagctgagatcgtgccattgcactccagcctgggcaacagggtgag

SEQ ID NO: 125947 - DNA, 801 bp, Homo sapiens
caacatcccagcccccacaagccaccatcctagtttctgtctctatgaattttactactctggatacctcatagaaattgaatcctgtgatatttgtccttttaagactggcttatttcacttagcatagtgtcctcaagattcgtccatgtcagggcatgtgttaaaatgttctccctttttaaggctgaataatattccattgcatgtgtattccacattttctttattttctttatccagtcatctggttgacaggttatttgatgtcaggctgtggagcaaaagctcaataaatggcaattctccccacttgcccttcccactcaggagatgtctgagcagaggggccacccagcaaatacttctgcccagagggaagctatgtcacagtgtcatgggagcatcaagaaggaggcaccccattctacctggcatctggtctggcctctggggctcccttcctgcatccagggctgcccaggcaccctgtggtgcccagccctgagtgtgaagcccctgggctgagtgtacctggcctggtcctgggggccaagcaactcagcaagtggagggactatgagggagggaagcatgtcccaggcaaacgtaccggtgtgaagggatgccagcctcctgctctcatccctgctgccttcccgggaccccgagaaagaaatcggccgggtactcctagagtctacctggggatgggagcccaggagagcctggagatcccctcccccaggtatgtggaggcctgtcttgagcctgtgccttgggctacatgtcggtggtgga

SEQ ID NO: 125948 - DNA, 907 bp, Homo sapiens
gcatagtggtgcatgcctgtaatcccagctactcggaaggccgatgcaggagactcacttgaacctgggaggcggaggttgcaatgagccattacactccagcctgggcaacaagagcgaaactccatctcaaaaaaataaataaaaactaacaactgagcactgggaaattcaaaatctcagtgataaccccaaaacatgcaatcctttcatttattttttaatcctggtctcattgtacatgcaatactttctaatacattatctgtaataacttattctttaagatctaagaaaaggaaacagttctgaaacaaaacattctggaaaagtctgccaaaattttaagctttttggagtaacatgggagatagatctttggagaaaaaagtaatgatgtcaatctaagacaatattccattaacagtactggtagagctatttcacaatttagcatacataatgtcacacgactgtagaaatgtttccaaacatgtatattaacaaaaatatttttaaaaatttcttcccacaagaataagtcttaatgattgttttcttaaacagttactgacatcactcagttataccaagcactgaaatttaaataagactatccaatatgtagattggaagttggtttttaacaaatcaccaagcaaaattattagctagccatgtaatatcactgcttgcttatatcacaaatttttaaaacttttactgattgtttttcttccacaattttgaaaacaaactgaatgtaacagggggtctgaggactcaaggccacgtgacggtggctcctgcttgtaatcccagcatctggaggctgtgcgggtggatcacctgaggtcaggagtttgagaccagcctggctaacacggcaaaaccctgtctctactaa

SEQ ID NO: 125949 - DNA, 218 bp, Homo sapiens
cttgattgacaggcacgtgagtgcttttgcagcatgaactgtcctatgtcttaaagatactctagaacaatgccaacctgaatctgcaacgatttttatatcttgttaaatgcagtgaaaaattacacgtttgcaccttgaaatgtttctataagaacagagcaaactcattgatagctccgaatgagtcagagtggtcgtcgcctgcctctcctaaa

SEQ ID NO: 125950 - DNA, 511 bp, Homo sapiens
gtccagcagcccacaaggaattgagtgttgccaacaaccatgtgtgtttggaaacagatcctatcccactcagttctcagatgagaccatagtctcagccagtaccttggtggcaccttatagaggacccagctaaactgtgcctgggcttttgacctatagaatctgtgagataataaacatgcattagtttaagctgctgctaagctttgctagtattattatgctacagtggataactaatacgagcaatatagttcctgttgccctgtatctccaccgacatttagtgcctgtcttttagattttagccatgttagtgggcatgaaatggaaactctgaggctttaatttgcatttccctaatgacattgaatacctgctaattggacatttggataccttcttttgcgaagtatctgttcaagtctttttcttattttaaaaataggtaggttgggcatggtggtttacacctgtaatcccggcactttgggggccaaggtgggtg

SEQ ID NO: 125951 - DNA, 578 bp, Homo sapiens
gatcaggaaactggccatggcaaagatcagaggcaccatttttatttcactatttcaagtagctggaagttagtaaacaggatgtctagtcaccacggctagaatacaagtggtaccctaaatccaagataacacagcagcacagtaggtgtccaacaggtgggaaaggcagactaaagggaaatccaactggcagattacaaagtccagagacaaggctggcattgcagagtctgctcaccggcagaaaagtatcctctgcactgggcttctgtttaaagactttgatgatgagggtgtgggctaaagatgatgctaaaatacgaacatggaatgggaactaaagcaaaatcaaactaaagcacatgaaaaggagtaaggaggtctttggactagaagattttgcctcattagatactttctgggttggaggtaataacttgggcacaacaccaaagttcaacacgaagactcacaactaggccccaccgaattcttcttcaaacactgaagggtacagaaatgagtcagaaacgagcctgtggatgagacgatcaatagatccagtttagagaatc

SEQ ID NO: 125952 - DNA, 307 bp, Homo sapiens
tactcagaccaaaaatgtgatggcactaacaactgcggggactgttcagatgaactgagcccaggtaggggtctgggcacaggctgggctggggctggtgtccaggcagcagccagagggcaaagggtgagcagggaatctctagggctcccccttgcatgcttccctgcatcctaggaaggagttttctacccctgcttgaatacatcctgtgatggggtactcactaccactccaagtgactttttctggaggctcattcttctgcagtggggaagtcaccttcaaaggcacagatgagaaaact

SEQ ID NO: 125953 - DNA, 161 bp, Homo sapiens
aagactggcagacctttgccctaaccgccttgtccagtcgaggggcagtgctcagtggggacagtcatctttttgttttatgtaggtctcactgaaagaaaagttgtaaaaaggcaacaaggcatttgaggtggggaggcctgcacagcgtgtgtgtgtgt

SEQ ID NO: 125954 - DNA, 850 bp, Homo sapiens
tggggaagtttaactccttatttaaatgagattcttgttcactttaaaaggtagatccaaaaacttacttgtatgcttttgacacaccaacaagtaggtatgccttcattttcatgaggctaacacattttatttacattttttaatctgtgttttactaagaggagagctggctagatttgggtttctaccttgtgactgatacagctagactttattgagatttaaatgtctgctgaatgtcataatattcttagcagtgtttgcgtgggtatatgagttccctagattatttgcactgaaatttggaatttctctagtccaaaaatatggaagaagaatataaaaatatcaaacctggtttatatttgccttacttggttttgagttttagaatgaatttaggaagtttttaattgctctctaattttgtatctgtgacattttacttcgcttgggttatttaactctaaggaagagaccagagatgctttgatctttttatttatttatttatttttattttgagatggcgtctccctctgtctcccaggctggagtgcagtggtgtgatctcggctcactgcaaactccacctcctgagttcacgccactctcctgcctcagcctcccaagtagctgggactacaggtgcccgccaccatacctggctgattttttgtatttttagtagagacggggtttcaccatgttagccaggatggtctcgatctcctgacctcatgatctacccacctcagcctcccaaagtgctgggattacaagcgtgagccaccgtacccggctgaggtgctttattctttctaatgtgtattcacatatactatct

SEQ ID NO: 125955 - DNA, 440 bp, Homo sapiens
tgtcctgtctgccacacctcccgctacaaatgccatgagagcagggccagggccaggcggtcaccagcatctggccctgcagacacctgagaagtgcctgctgaatgaagggctgaatggacagagactcagccacccatggcaagtgggccacaccccaaagccagccaggagagaccgtccctgccctcgtggacagggggccaaggtgtcagctctgtgaacgagtatagcccagggagccgcatgagccccagtgaggggccagatgcggtcctgagggctggggaaggccagcagggacccagccccgaaggcactgggggatgcagagggctcccagcggctggctgaccatgccctcactgcccaggtggctgggctctaaatcccaaggtgcagccagggacagctcagggtggtcaccgagggacctgctt

SEQ ID NO: 125956 - DNA, 509 bp, Homo sapiens
cctgagggcggatggtggtgtgtgtctggggggaccaggctcactgaacaggacacttgtgggttgggcccaaagggatttcaccgacaaataaaccctttcttcccacatttgtgccgaaagagaaagaggcgcagctcacctaatggtcaatcggtcaatcgctgccatgctgtcctgcaggaccagggacaaaacgagccctaggacacgaagaggacgctggcctgtagctccgcagtgacggtgaccccaggctgtcctgcaggaccagggacaaaacgagccctaggacacgaagaggacgctggcctgtagctccgcagtgacggtgaccccaggctgtcctgcaggaccaggaacaaaacgagccctaggacacgaagaggacgctggcctgtagctctgcagtgatggtcaccccagcttgtccacgctgacttctcacctttcccaggacggttggcgcctttcattctctggggcgaaaacagtcaggacattcatcc

SEQ ID NO: 125957 - DNA, 326 bp, Homo sapiens
ccattaaaataatgaaacaatttacaaatgtaatctcttggaacagagaaaggaactcttttctcagattggagctatacatatgactttatccatgtcactctactgtactcaaatcacatagtggttttccataattctgatgtgtgctttcacttattgtgacacagcattattttatttttagtcaaccatctttctatatcaagcatctttatgaaagcataaataggtcactaattgttttcattttcactgaataatttgtttgcattctcatactccattaggcctatataaagcatacaaacatttttttcatcatt

SEQ ID NO: 125958 - DNA, 483 bp, Homo sapiens
tgttagaaatgctaaggtaaccactaattctttttataagaaatatacttttaatgttaacaaaggagatacaatgaaacatattacgctcaaaatcaaagaaggaactcaatggaagaggaaggtaaggccaatgaacaaatacaacaagtagaacatttattaaaacatggtagatattaatataaatatactaataatttaaatattaatcatctagtcagagcaattaggcaagagaaggaaataaaaggcatccaaattggaaaagaggaagtcaagctatctctgtttgctgatgatatgttctcatacctagaaaatgctaaacactcctccaaaagacccctagatttgataaatggatgcagtgggctcgcaggtatctttatctatgttctctagttttcatctcttctagtcttcttctattctagctgagtatgcaatagagggctgaatctccttgccgagagctgcaaa

SEQ ID NO: 125959 - DNA, 554 bp, Homo sapiens
tgaggtgtttgcttgagaagtggaaaagatttgggacagccatggatgaggcagaaagttgttgggaggaacctgatagggagtcagctgaattgagatgatacagctttgccgtggagccagtcagcagggtcatatgactttctccagcaatacttttgaggtcagagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagaacaaggatggaattgagtgggccagagagccctagattaatgggttaggatgcagaggatggggtagagaagggggaaggtgatttat

SEQ ID NO: 125960 - DNA, 782 bp, Homo sapiens
  misc_feature (113)..(113): n is a, c, g, or t
  misc_feature (159)..(159): n is a, c, g, or t
  misc_feature (169)..(169): n is a, c, g, or t
gaaagccaccgtaccaggccaaagctctgcgcttcatagatgtaccccaatctgtagtatgttcttgatttacccaggcagtgaatcaagcagtaactgaactaccgatgcantcgtgtatagctcaactcataaccactcgacggcgtcagtgcaaantacgcaactntcacatagaatccaatacacatcatctaagcttccgaaggatctgtaaggtgacatatagacacacagaaagatgagaacaaacgaggacaagaactctgatacctcaagcatctagagtgccttccttctttcaaatggccacatagtctatccagcaagggttctaaagtgggctaaaatagctgaaatgacagaaataaaattaagtatatggatacaaataaggaatgttgagctacaaaaataagttgaaacctaacccaagaaagctaagaattataataaaataaggcaggagctaagagacaaaataggcaggataggaaaaaacaaaacctctgagaaacataaaattatgtaaagaaaacaaatacatggctcattggtgtccctgaaagagatgggaataatagaaccaacttgaaaaaatatattttaatataccatccatgagaaagttcccaaactagctagcaaggcaaaaattcaaactcaggaaacgaagacagtaagagtgaaatactcacaagaagattatccccaggacagataatcatcagattcttcaaggttgaaatgaaagaaaaaatgttaaagctagctagagagaa

SEQ ID NO: 125961 - DNA, 266 bp, Homo sapiens
cccagcatcagctgggaacaggtgagaaatgcaggttctgtggcccatcccacacctgaattacaaaccctggagatggggcccagcaatctgtgttttagcgagctcttcaggggattctgatgccgccttgggtgtgagaactactgttctaaggactgttcttgcttctctctgctttctatttcatccttcctccctaatcccttaggatagaagactcaagatgcttttgcctcctggtaatgcttgctatttgctcagca

SEQ ID NO: 125962 - DNA, 622 bp, Homo sapiens
cggaattcactagtgattgtgagctgagatcgcaccactgcactgcagtctgggcaacaaaatgagactctgtctcaaaaaaacaaaaccaaaccactgagatactaccatagcagttggtaaatagctgctgtactgaatattccttgctccccacccccaagtaccctgagcctccctgccctctttcaggactcttctcccaaggaccaccgccaccctccacctcaccgagatccagtgactgaagggttaatgctcagcacagcaggtgcctcaaggactctgctttagttttttggctgaagaccattctggcaggtttgaggtgctatctcattgtggttttaatttgcatttccctaatgattagggatgctgagcaatttttctttacctgttgaccatttgtgtgtctcttttgagaaatgtctgttcagatcctttacctgtaaaattagaatagctccctttccgactgtcagtgctcgtgctccactgctgttaactgtgttgactatcacctgtacattcattcattgatttttaatctatcccagatccagtacttagaaaaaaagttaggctgggtgcgatctcagctcacaatcactagtgattc

SEQ ID NO: 125963 - DNA, 640 bp, Homo sapiens
aaatagcataatggactaaagatggccacaaattatttgccacttttcattgaaataaggggtttctattccccttgaatgtggacaggcctgaagactgactttgaccaatataatggtcagaagtgacgttgtgtacctctcaaggttgggcctaaagatgcttgcagcttcttgtgtcacctatgttggtacactcccttttggaagccagatgtcatgtaagagatccaggtgaccaccattttgtgaggaagcccaattttcccagatggtgaggaagagaacacatgaaggagtacatgggctccagacatgtgagtgaactttttctaccttccagtgaagtgaagagagagagtgaatggtgctaacactacagggcacagctgtccagctgattccttcttatgttcctgacacattggaacattaggaaatagagatgtcttaagccagtaagttttgaggcactttgtattcatagcagcatatatagaaacatgcattttctttattaaatataactttgaaacatgccaaatacggttataacatattcggaagaaaatagtaagtaattccacattacagtaaaacttcttttttcaatgtgagtgtgatccccctggggataaat

SEQ ID NO: 125964 - DNA, 335 bp, Homo sapiens
tgctgaggtgatcaccggagcttaggcgaatcctcctcctcctcaacgtagtaggaagtgacagttgataccactttggctgggtaccacctgcccaagggtaccatgatcctgaccaatttgacggcgctgcacagggaccccacagagtgggccacccctgacacattcaatccggaccatttctaggtgtacaaaatagaaatatagtattttcatatccagttccaccaaagggggaaaaaaaaggatcagttattcaaataagcaaacttacattatcttgtatatcaatatcagccattcccttgttgagttcttcttgcatacttgac

SEQ ID NO: 125965 - DNA, 1978 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctataaaaaaacaacaacacacccacccccccaacccccccccccacacccccacaccaaccacccc

SEQ ID NO: 125966 - DNA, 1683 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggcgataagggatcctctagaacgcct

SEQ ID NO: 125967 - DNA, 1803 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaaacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125968 - DNA, 1867 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatgtctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125969 - DNA, 554 bp, Homo sapiens
tttcgtaacctttaatataaatataatctcaggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125970 - DNA, 555 bp, Homo sapiens
tatcactactctcaccccacacatatcactctggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125971 - DNA, 1916 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125972 - DNA, 1728 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125973 - DNA, 1877 bp, Homo sapiens
ggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacgtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125974 - DNA, 1993 bp, Homo sapiens
tgtgatatcacaaagctggggacttactggaaaaatgtgagactcacacacctggccaggaggaaaaaactcaggactgcagtggacatttgtccaattggtggccaacaatgagctttgagtaaattttctatattgaaggagcttctcatcttatgcatgccatctctgcaaattagaagctgggactcaattttccagtctctcttgcaactaggatatagacatgtgacctgtgctctggccattagttgcagccttttgagattttcattcacaacataaaatgcgaaaaagcaggcactgactgaatccattcctggagtacgtaagtagcagaaagtgatgatgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 125975 - DNA, 230 bp, Homo sapiens
cacaggctctgagaaaggaacacccaccacgtctgagcaccacaaggaggctgaagtggttggagtggaatgaacaggggaagggggtcccagatgaaatccgagagataatagggcctgatcgtgtaaggatcacggctttccctgagtgggatgggagtcactggatgaccttgaggagaggagcgacatgatctgacttcgtattaaaaggattgctgtggctgctg

SEQ ID NO: 125976 - DNA, 889 bp, Homo sapiens
ccaccccttcagggatgaaacggaggccagatcactctcccatcacaatgaggtgtcactggacttcaggtaaatccgtgagactgtgacctggatttcccatccagtcagcaactagggagcgggaggactgtttccttgtcctcaggtatccacctctcaattggtgctccaaatggtccccatgaggtgtgtcaccagtaccccaaatgcttgacctccattgcactctggaaatagggagtggctgtaggatctctctctagtcagcccctactgctgaggctttctttttcctgctctgtaaccagaaagcggccctattttcttcccaacgggtgcccccagagcttcataagtcacctcttcctacgtggggtctcttccttggcatgaccctggcacatgactggagttcagtgctcctgctaatgtatactcccccagaggtgtttctttttaagctgcaggcactttccagttctatcccagagactcagtgacctcccttagtgcctgtctcctctgtgcatgcgcattcttctctcccaccaagaacacagatgtacttgaccttctgtgaacatgtctcatgctgctctgtcactgggagctcgactttttttctctgctgtgaatgccctttctgccctttctctgaagacctatcagcctcgcaagttcattgttttcatccccagatggcgagtctgtcattcaggcaggaagtacatacaaccacaggctaagcatcgtgcccagagacaaagagatagggcccagtccatgccatcaagcgcacagtgtctagtgacaccacacatttcaacaaataattacagcccagtaggacaggtgccataagacagagctttgcaatgacaccagg

SEQ ID NO: 125977 - DNA, 499 bp, Homo sapiens
ccaccccttcagggatgaaacggaggccagatcactctcccatcacaatgaggtgtcactggacttcaggtaaatccgtgagactgtgacctggatttcccatccagtcagcaactagggagcgggaggactgtttccttgtcctcaggtatccacctctcaattggtgctccaaatggtccccatgaggtgtgtcaccagtaccccaaatgcttgacctccattgcactctggaaatagggagtggctgtaggatctctctctagtcagcccctactgctgaggcaggagagtcacttgaaccagggaggcagaggttgcagtgatccgagatcacctcactgcactccagcctggcaacagagcaagactccatctctaaaaaaaaaaaaaaaggcccagtacaacagcatgcagtttttcccaggaactcaaagcagtgagtttccacttgactatggggtgtgaagggtcaaatagagagataaggctagaaaca

SEQ ID NO: 125978 - DNA, 421 bp, Homo sapiens
agtgaggtaggaagaaaggcaagtaatgaaagcattccagagtgtaggatgtgacaaactgtgtcaaatactgttggtcaggtaaggtgagggctgagaataattaaccagtggacttagcaacatggaggtagtaagggattttaatgagcagctttggtggaatgaaaacctaattggttgtggatttaaaagagactgtaggagaggaagtaaaaatggaaatggaaaagaaagacatttcttttgaattttgttgtgaagggaacagaccaatgggaactctcgaaagagcatgccctttctagtttgctactctatcatattctcttgtcacaccacttctacttcattccttcattgatcatctgccaggtccctgtaggtatttgaattttcatctgtaccataaaggttctct

SEQ ID NO: 125979 - DNA, 297 bp, Homo sapiens
taggggtggtgtggacgggcagacccctggccagtggagtccagcccctcggatgacacagggaaaagagaaaggcaaagagaggcaagatgtgatgctgaagctccagccagataaatcctagagaggggccatgcatcccagccacctccccattctttcccacctgagcccacccctgagctacggctctgaggcacagggtaacatctgtagtgtgtgtgacagccgcactggcaggagggcaggatggtagtgagggcaggatggtgaggcagtcccagagctccctcccag

SEQ ID NO: 125980 - DNA, 534 bp, Homo sapiens
agtagaaatggaagctcaggaaacttcttaggtttttcagtcccctggtatctgtgtgtattggctgtcctggatccatcaagaggcagctccagagctagaaggggtaactttctggactgcagtactgggcaggtgtgctcagctcacaccctgtggggcagctggctctgtgttcaacgcagcttgctctgaaaagcagctttcctcttccgcttgcaggagctgctgtaagatctgtttttcagctcaaactttccttccttctttccgtggacgttcgcatcagaaaagtctaaggtttattgcctggaattggggtctttttataaagatacagcgcataaaaatcggcctctctgagatctctttggcaggtgacaccacagctattgcttttgatgctgggccagatttcattcaggtccttgacctctggtggggggctgcagttggtgatttagtgccgtggaggcaaggtgattggatggccgtggaggtcagggcccctcactccagtcgctgcccgtgggg

SEQ ID NO: 125981 - DNA, 554 bp, Homo sapiens
aacaagtacatcattcaggtcttctgcaggtcatgctgttttccaaattgactgtcattaacagccccagttttccggatattttattcattcaacaaatgcataatgaatatgtgcaaatgaatacctactctgccaagctttcttcccctcaagtgctaaaaatagagcactgctagagatagtccctgctctcatggagtttatgttttcagtgttaattgagaaaataacactgggagggtctgagggagaactagcatatagagtaaccatatcgcatattgcggttgaaatctttagggaagaaaaactttaatcaaagagtttttgaagagccaattctatgaggccagctaagctagccactaggcatgaggacactggggaaacctagtctctgccccatcccagggttgagcacagacagattattagtaaccttttggggagccctggtgttttttatcctcccacaaattttgggggggagaattttttcctgcgcggcttttttttccccccaaaggtgggggggcgttcctctttggtga

SEQ ID NO: 125982 - DNA, 745 bp, Homo sapiens
ataagtaggtggttgtgtgtgtgtgtgtgtgtgtgtgtgtgtgtgtgtgtttaaagctgttatagaattatctcccacttttttatctcaaacacattgggaaaacctaaagatatagcccctgttatcacattgagcccttaacttgccacaggatgcataaacattatttttgggcatgttgtgagggtgtttctggaaaagattagcatttgaatgggtcaactgagtagaccagatggccctccccagtgtgggtggacaccatccagtcattgaggacctgaacagaacaaagggtggaggaaggctgaattaacaccgcctgactgcttgaacaggaacgtccatcttctgcccttgttgctcctggttctcagggcttgggacctggactggagtccacaccatcagctgctagctctcaggcctctgaaccataccactggctttcctgggtctccagcttgcagatagcagactgtgggactcctcagcctccataatcacatgagccaaaaccttataataaatctctgtgtgtgtgtgtgtgtgtgtgtgtgtgtgcgcgcgtgtataatctcctactggttctgttttactggagaaccctaatacacttctttcttgttgttctgtggcatacactgaatattttaaaccgcatttgtcacaggattttgaaaacgtgatcatttgtttcatcctctcttcctctgcagcaagaatcaaaattcactttgcc

SEQ ID NO: 125983 - DNA, 779 bp, Homo sapiens
ataagtaggtggttgtgtgtgtgtgtgtgtgtgtgtgtgtgtgtgtgtgtttaaagctgttatagaattatctcccacttttttatctcaaacacattgggaaaacctaaagatatagcccctgttatcacattgagcccttaacttgccacaggatgcataaacattatttttgggcatgttgtgagggtgtttctggaaaagattagcatttgaatgggtcaactgagtagaccagatggccctccccagtgtgggtggacaccatccagtcattgaggacctgaacagaacaaagggtggaggaaggctgaattaacaccgcctgactgcttgaacaggaacgtccatcttctgcccttgttgctcctggttctcagggcttgggacctggactggagtccacaccatcagctgctagctctcaggcctctgaaccataccactggctttcctgggtctccagcttgcagatagcagactgtgggactcctcagcctccataatcacatgagccaaaaccttataataaatctctgtgtgtgtgtgtgtgtgtgtgtgtgtgtgcgcgcgcgcgtgcgcgcacgcgcacatgtgcatgtgtatgtgtataatctcctactggttctgttttactggagaaccctaatacacttctttcttgttgttctgtggcatacactgaatattttaaaccgcatttgtcacaggattttgaaaacgtgatcatttgtttcatcctctcttcctctgcagcaagaatcaaaattcactttgcc

SEQ ID NO: 125984 - DNA, 656 bp, Homo sapiens
gttctttgaaagcagatgagaaattcaagaacataaaggaaatgttttaaccaattcttttcctaaggagtgaaagacaaaaaggaaaactgggctaggtgtggtggcccacacctgtaatcctagcactttgggaggccaaggtgggcggataacctgaggtcaggagctcaagaccagcctggccaatatggtgaaatcccagctctaccaaaaatacaaaaattggccgggtgtggtggcgggtgcctgtaatcccagctactcaaaaggttgaggcaggagaatcgcttgcacccaggaggcggaggttgcagtgagccaagatcacaccactgtactccagcctgggtgacagagggaaactctatctcaaaaaaaaaaaaaacttgtaattttctaaggctactcatttaggtgattgaccacgggggtgatcacaaaattttccttagcttgatcagggttaattggacattagtgaaatggggtggtgtacaataacctagtttcccactgtttttctatagagtaatgttaccagatttcctctcctggttgataaagttacgggtaatattgtacgacacattatacttaattctgacacacacattcacattattttctacggagaggattgccccttctcccaa

SEQ ID NO: 125985 - DNA, 285 bp, Homo sapiens
aaggacaggggtgtagtgtcccagggcagcctcttatgaattctcctttcgataaggccatacttcactgtcaccgccaatgttgctgatcttacagtccagagacctcactgaacaggtttctattaactacaacaatgctgggcctatccctgtaatctttataaagctcactcaaaatgtggacaataaatgatatgcatgctgtacgaagtttctaaatataaatacatttagggcttctcatttttttctctgaagactactggattaaagaagaggggg

SEQ ID NO: 125986 - DNA, 849 bp, Homo sapiens
cgcagtggctcatgtctgtaattccagcactttgggaggccaagggggatggatcacttgagatcaggagtttgagacaagcctggccaacatggtgaaaccccatctctactaaaaaaatacaaaaattagctgggtgtggtggcaggcgcctgtagtcacagctacttgggaggctgaggcaggagaattgcttgaacctgggaaggggaggttgcagtgagccgaaactgcaccactgcacgccagcctaggcaacagattgagaccctgtctcaaaaacaaaaacaaaactccccctggtccctgccccaaatattagctacatgagaggataaaggtaatttattcctaaccaatgagaattttgagttacagactaattcctagaaaatcccgctacttctctcctctaatgttatattttggagttaaaaacacatatctttattcccctagtctaaatattaagtggttaagagaaacagggagggtaaaacaggatggtcacttcgaatattaacttgattttacaatttttcttaaagggatcatattaactcttgttaaatctcaactcagtgtgatgttctcagagcaggactgacatgtgccaacaggtatttaacaaacaagcagaagaaaaaaagctgataaaaaatatgattaggcaactgacagaagggaaaatggcgaggattaataaagatttgaaaagatgctcaatctcactagtccatgaaaatgcacactaaagtaaaagcaatattaattctgtcataggtgggaactttaaaaaacaacatttttgttttcatagagtaaaagtcactttcataatgggaatgg

SEQ ID NO: 125987 - DNA, 178 bp, Homo sapiens
gatgcacggagctgctgcgttggaaagcacaggcctcctgaggaggcggcgggatgaatttgggctgatgctactcctggtgattgccagacaggactgagggcacctgagagcacagaaggggctctgcagggcagtgggcacaggctcgttgttggtccttgggagagagtggtag

SEQ ID NO: 125988 - DNA, 726 bp, Homo sapiens
tatattaagaaatattttaatctttatcgtgtcatggtatggtcaaaagttacaaactttgacacctgtgtttaatgcccccttggccagctacaagttacgaaaaaaatttttaaccactcttggtcagtttcttcatctgtaagtggaaataatatctatatttagggatgttataaaggtttttaaaactatgtatacacacacatatatataactgttatacacattatacatagatttttatatagttatgtgtatgtgcatatacatatacatacacacacacacatatgtgtgtatcactcagtatttacctattttagcacactatatagcactacacattcacagcatcttagtgaaaaataaatatacctccaatggagctgaaaagttctagggagtaactggggatagtaaatgattactttccttacctggaaccaaccactaggagtaatgaactaaatattaaaaaatttctaaatgcaatttttaaaaataatttaaaatatgttcaaaaagattagaaaatgaaactattatgaagaagtattattgttgggagacagtcctctatgggtctctcccattgatacacatcttgttgggtttgccaggaatgcgaatgcaggaccagcctagtcttctcgttttgtcgcccaggctgtagtgcagtggtgcgatcttggctcactgcaacctccgcctttgggtttcaaa

SEQ ID NO: 125989 - DNA, 376 bp, Homo sapiens
tttgctatttactgaggtcccgtaggtgatgagactatgctagacgtgatggaaaggatggtagggccccctgcctccaggagttaacgatgcagtgaggacacatattaagcatgtttacccaaataattatcaattactattgtaaagggaaagagaagccctgatttccaagtgttttccttgccttgcctcctcaattcagtgtccttcacctgtaccctgagaaggttgtgatctcggctgagttcgtttctatgaggcagtcttttggagtgaggctttgggaagaaaatcaaaccccaaatcggccctgcagccacctgaggggcacgcagaaggaccggctaaaaagcgagtgagcaaagacccaccc

SEQ ID NO: 125990 - DNA, 260 bp, Homo sapiens
  misc_feature (12)..(12): n is a, c, g, or t
  misc_feature (33)..(33): n is a, c, g, or t
agcggtactgcngcagaaactcttcatcatctnggtcctcattcattatggcttcactctcagggatgataagcccttctcctgcttctcttttcccagaccccaaagtcttccctcagcctgctctggcgtcccccaccccaagttccctcctcaaactcctcactaccagcctttatcccctgaagtttgaaaatcccctggctagcagcaacacctcagtccaaacaggggcccttaggggtgcctgttccaccctc

SEQ ID NO: 125991 - DNA, 203 bp, Homo sapiens
ttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgca

SEQ ID NO: 125992 - DNA, 380 bp, Homo sapiens
tctgctgtaactccctgtcaaagaatgctttgctttctgctggtacagtgaggacatctttcacacaggagtttctatggcctgttttcaggaagaaaggagtagatcagaatgcctttcttgcatctgctgtttctcaagtgcctttagctcaaaataatctttatgtcaaaaaggcatattatggcatattatggggtgccactcttcattgccaaataatatttcatcacatgactataccacattttatgtatccattcgtcattttatggacatttaggttgtttccacatataggctattgtgaataatgctgctgtgaacatttgtgtacacatatttgtgtggtgccttcagttctcttggatagataccta

SEQ ID NO: 125993 - DNA, 177 bp, Homo sapiens
cacctgttagacctccacctgatgtcctatagcattactactgcctccatctcttgtgtttctacagcatgaaagttgttcttttccttttcaagagcctgcaggaatttctatgaggagtgtgtgtaaatggatggtatttaggtaaccacacttctgcttgtaagctattggtaa

SEQ ID NO: 125994 - DNA, 696 bp, Homo sapiens
ggggatgcactgggtaactgccctggagcctcttccttaaagtatgccaaaacagacttccagaacctcatttttaacaggcattaggtaacagtgtaataaaacatactatatcaataaaatttaatgcccaaataaaaaaattatttgtatacatttttatatttatttcactatataataaaggggctattatattgttgccatatgtcttttctaagtaagttgcaactccttacttatctgggtctgacatcaggacagctgaagcacatggcagtcaataccactgcggaaacagcacaagaaaggattgaggaaagcaaagacctaaacttaattagctgtaatattgtgcagctaaatgacacctatattgtgctggtcccttagattttttggatctggaccgcaggggttagattcatcactgagatcatatctggcctctgtgcttcaatccctgtttcagtcgtgaccaatgtattggttcttttctcacagtgaaataagaactagggatttctattacaaccagaatgtagtaaaggcatggaatctcttgtaggtactattttctattttactttatgggcaaatacagaaatattacttacagacattacatgttatttattaacatgctaataagccttcacacatttaaaagtaaacattaaacttctaacaaattaa

SEQ ID NO: 125995 - DNA, 660 bp, Homo sapiens
tgagaagagtggcgtgctgtgtgagtgtgtatctgtgggtttttccacacatcttatatgtaaattgcaaataaaggaactaaaattttaaaagatgagtcagggatgagataatggtacgtgggcatgatgttaggaagaaaaaaattagcatcctaaagttaagataatgccaccatttcagtaaaaataaaaaaaattcttttaaagaatagtatctctggtttatttcctcatttctaccttttacttctctctaaataatttcagagaacatattacaaaagacatatgatataggattaacaaaacaggattagaaaaagtatataaaaagtatttacaaaggagaaagctgggacactccatgggagtcttaacatggtcaccatgatagcgaatgtaacccagttctgggtttctgagcaaaggtatagagaagacaggttgtgttacaggcctctagtactcactggggatgaagcataaccatttcccaagggaatcttttttccagacctagctctgaagtacattactcacatgtttttttttaaaaaatgatattccataatgtgatggatgtatttctcaaaaagagttttgattaaatgtagaagaaaatccctgaaggctttttcctatataaacctgcagtgc

SEQ ID NO: 125996 - DNA, 345 bp, Homo sapiens
tcccttaaacgcagggtctcactgtcacccaggctggaatgcagttgtgctgacatggttcactgcagcctcaacctcctgggtttaagcggtccttctgtgtagctgggaccacaggcatgtgtcagcatgcctgactaattgttgtgggtatttaaaaaaatttatgaagtttgtattttgttttagatgttgcctttatattaaaatccttatgtaatagacttagtgcccccccaattttttggttattttctgttggtttcttactttgaatactattgaaattacctagtaacttctttttcttcccaagcatttgatttaaagtaatatctttttctt

SEQ ID NO: 125997 - DNA, 440 bp, Homo sapiens
ttgcaaaaggcttgggaagtgggagagaaaattagtgttaagtggatatagggttttagttttgcaagataaaaaagttcttgagatctgctgcacaacattgggaatacacttaatattactgaagtgtacacttaaaaatggttgaaatggtaagttttatatatattttttactgcaataaaagaaagagtctgggcatggcagttcacatctgtaatcccacttgaggccaggagtttgagaacaacctaggcaatatagcaaaacttcatctattttaaaaattaagaaagaattagctgggcatggttgcatgtgcttgtcctaggcacttggggggcttaggtgggagggttgcttgaggccaggatatcaaggttggagtgagccctgatgggggccaggcagagcaagaccctgtaaaagaaacagaaaga

SEQ ID NO: 125998 - DNA, 398 bp, Homo sapiens
caaagtaaagggggaaaaaatcactatccaagttggagttcagcaaaagaatcacaaagcagaggaagaaaaatactaatttgctatgaaaagtaattccattgggtaagtgaaaagatgcttgtgtatgtatgaatgatgaatgagaaacaagaagaaattgacatagaaagttacttatgacaattaactaaaaatccatattttgccaataaccaacaggcaaagaaatgagcctctctaagcctcagcttctttctcctaaataccataccctgactcttctatggaattcaggatgccacacaagtatctagcaaacataaatttgaagttcagaagaagcaaggaaaaccaacattcaatgttcaattcaaaatagccagtaaggggtaagg

SEQ ID NO: 125999 - DNA, 597 bp, Homo sapiens
gctgaagggaagtgggaggtgagacaggaaagaggcggtggcatgcggcgtccgggagctgggtcccatgtgggcagctgggcccgtgctcactgtgggagctggtgtgttccttcaccagcccacactccacaggtttaggatggtcaattccgggcacccctggcctgctccaggacgtgctcctgccaccagagaaagcccctaggcagcgtcccaggtgctggtggtgtcagaatcgagtttgagtctgaggagtgacctggggctggctgggctaggcagcatcacggggttctgcagcccaactgcacatcaggctggtgacagtcacgcagcctattacctcatgtgtcatcagaggatcgctagaacacagcacttcaagtgtgcagatttagtgagccatagtctaaagacaaatagagccactgaatcctaaatttcaatcaatcatctccattactcgtcttattggtattaatcctttgaaattatgtggggtgggagttaaagctaataactaattatgttaatgctaaaactaagatttttctggcaagggaaaatcctcccaagtcccagcactttgggagg

SEQ ID NO: 126000 - DNA, 312 bp, Homo sapiens
agaccagtaactggctgtgatgtctgctatcttccagccatattctcactaggtgctaggctggcaaggcagagtggttaaggccaagagttctggaagtggcagagcaggggaatttgtttaatatcaacaatactctgtccctgaaaattctcccaggcctcagagggaacacatgcctacccttttgcacttctgctttttttttttttttaattaacttcttccggtttcaccttgaacttggctgtgatcaaaaattgttgcctgtgacgagtcttcatgaaacctgcaattagaatcctggccctg

SEQ ID NO: 126001 - DNA, 624 bp, Homo sapiens
caccacactcagctaatttttgtatttttagtagacatgggattttgtcacgttggataggttggtcttgaactcttgagctcaaacaatctgcccacctcgacctcccaaagttctgggattaaggcatgagccactgtgcccagccctccctactgaatttaaagtaatttctttccttcctttcttctctcttttccttcctttgttcctttctctctctctctctctccctctccccgctctccacccctttctttcttctctttttcttctttttttgagatggagtttcacccttgttacccagggtgtagtgcaatggcacgatctcggctcaccacaacctccgcctccaggattcaagcaattctcctgcctcagcctcccgaatagctgggattacaggcatgcgccaccacacccagctaattttgtatttttagtagagatggggtttctccatgttggtcaggctggtctcgaactcctgacctcaggtgatccgcctgcctcggcctcccaaagtgctgggattacaggcgtgagccaccgtgcccggcccttctctttttctagaaaggttttaccactcctttcccgctcttctgaggacagtaagaa

SEQ ID NO: 126002 - DNA, 324 bp, Homo sapiens
tggccttgaactcagggccccctggggactgcaggggatgctggccatgctgagcaatgcctgtgggtgtcagtttcctcatctgcagaatgagggtaggcctggtgcttatttcatagggtcgcagaggggattcagtgacagggtggtgtagaggctggagcgtgccccatgtgtgcacgacagccttccaactaggggaggcgggcctgggctctcaccagagagcctgtgttctccatggctacatgactttgccccagacgtccttcccgtggtctggaccctgggaagtcgccaagagccagacaggagaaaggctcc

SEQ ID NO: 126003 - DNA, 712 bp, Homo sapiens
ttgcttgggaggatgtggggcaatcagtgggatctggggcaggagtgacaaccgaacccagcagggggatcccaggccaaaggtgtggctgcataaaggccaagtggccactggaggcagaggatgcatggggagaagagccacgggagagggcaggctgggaggcaggtacccctaaagcagcagtcggtcagtggtgagagccagcagggggcgaggcagggggctggccagtctacctgttacctgagctctgcctttctctgtaacgggagcttcccagcaggcagcatgtcctgtggaccctcaacccaaacaggcctttccctccgtgctctggtgttcgtgggctggagtccctggcaggaggactgggcagagagaccccagagtccaagaaaggagaggtgactttgtgagcaaactgggtgctgccgtgggtggggacccctggccctttttggacctcactcctggcctgggatggggcacagagttccagggctgggagctggttttctgctctttgctggttttgcccttgagccgtgggattcttatcacgtggtgtttgagggctggaccattgacatgaggcggaatgagccagagaggactcgaagcctcagtgctcctggccctctgtgaggctgcagccgtgtgccctggagtatctgcagccttgggcctctgggtgggcaggggagttgct

SEQ ID NO: 126004 - DNA, 454 bp, Homo sapiens
ccaaaaggtggttatatgccccaggagatacattagcattttagataaagtaagaacctagagaaggcaggctccctctacagcaagtccttcctgctggggcctggtcttattcatcatggtgtctctagtgccaagctcagcacctggcacgttggagtctgcggcatatgcttgttggctgttgaattaatgactatgagttggaggacgacagtttaacaaaaaggagaaaagatttgaaagtgaagttttctcaggcagcctaaggagtgttggatcagcttagatgcagaagggaaagagattatctgcagaagtctgggaaatcatggtgggctagacaagaggaacctagatcgggggaatttaacaaggacctgtctcaaaactggatttttaactcccatatcttccaagtaactttgtttttgtttcttaggtttacaaagtt

SEQ ID NO: 126005 - DNA, 409 bp, Homo sapiens
ggaattcgagaccagtatggtcaacatggtgaaaccccgtctctactaaaaatacacaaacttagcctggcgtggtggcgcatgcctgtaatcccagctactcaggaggctgaggcaagagaatcgcctgaacccggtaggcggaggttgcagtgagccgagatcaagccattgcactccagcctgggtgacagaaccggactccgtctcaaaacaaaaacaaggctcagagaaatatattccatctcttgatggaaagagctgcaaaatggctgattgtaaggagcgtggatgcagggaggagtaaagaattgagcacattgttttttaaattgtttcaccacaggcacttacatacaatatcgcacgctgtagctagattgggctaaatctagagctggaggtagtg

SEQ ID NO: 126006 - DNA, 98 bp, Homo sapiens
tagtatttcccagggtctcttgtttaccctcttatctttttggtttgcacacagttcctcatggcatttatgtcaactgtcgtgtctaaccatatttt

SEQ ID NO: 126007 - DNA, 497 bp, Homo sapiens
taacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttca

SEQ ID NO: 126008 - DNA, 152 bp, Homo sapiens
agtagccctgcctggggtgcttgctctcctctccagctccagtcaccacctccctttccttcaggcagatggcaccacctccatgaagccttctctgaccaccccacccagagacgactttcctttccgttacagctcttgcctttgatagt

SEQ ID NO: 126009 - DNA, 296 bp, Homo sapiens
ttttcttaagcatcattcatgaaaagagaaaagtctgcttcgactgatagtattaaacttgcagtcaataaactcttattacagagttatactgtaaaacacacacaagcaaacaaaatcgtgtcctggaagttgaataggtcttaacattttagaaggaatatggaacataaaatgtgacacactgtttttcattctctcatgatttgggtttccaatttcaacactgatcagctgttctaatgcccatgttgccaaataccttaatgtttataactaatggtgttaactcttcc

SEQ ID NO: 126010 - DNA, 307 bp, Homo sapiens
agggcgaggttggggccccgtttccttcccctgctcgagcagaaggagttggggtgcagggttcgcccactgtttcctggtggggcgagagaagaggcggctggagagtaggtttggacacggacggtgggtttcagccggcaggaaagcgagtcttggagggaatgggggtggagaggggaagagaacgctctggacagatggctactccgtcgcagccctggctggggagccgctgaggacccttccttagccggggggtctcagccagggcttcccttgccaggctgtacgtacgaccccttct

SEQ ID NO: 126011 - DNA, 378 bp, Homo sapiens
cgagtgtgaccatcgcttcggccctatgcctgtgcctagtgtggtaagactttcagcgtcagctccaacctgatccagcaccagcgcgctcacaccgctaaaagccttaccgctgaggggactgcggcaagagtctcagccttggctccaccctgttgcagcacctgcgctccacatgggtgagaaggcctctaagtgccttgtttgtagtaagagttttgtgcacagttggaatctgctgcggcaccagcacagtcacaaagtccggaaacctgatgcttggtggtgagtgtggccagaccttcggccacagctcccacctgcccatccactaggcggcccacagcagtacccctgcgtctgcctgcagtgtggcag

SEQ ID NO: 126012 - DNA, 540 bp, Homo sapiens
tctgccggtgtcccatggctcagataaggactgagatatctatgtccctactgcctctctaggtttgggtaaaaatatagatttgaaacttagatcctcatcaagagaggatgatcacattgtcaacctcatgcctggtatgtaaaaccacacgttatccaattctcaaggaaatgcgacaccacaaacacttgttacaggattcaaacataaactgactttaatccaacaacaactaaatcgctcacctgagatacctgatacctgaaagactgtaatgcacatggtccctgttcactccctcgcaatgttctggctctttcactgtatcaagttacatcagcaaaacgcagaaagaatacaggtcctgcaatctccgtttctcaaagacatgccacacaaaatggttaaaaaaaatctaggccaggtacagtggctcatgtctgtaatcccagcactttgggaggccaaggtgggcagatcacgaggtcaggagttcaagaccagcctgaccaacatggtgaaaccccatctctacta

SEQ ID NO: 126013 - DNA, 336 bp, Homo sapiens
actgcattgtcttggggaaaggttttagatatagggaggggtgatgagttgggaacaataatgtagtctgccacaaacatattaaagtgtaactggatatggttgctgcagaattttgaacctttgttttaattgtgatttttactcttttccccctatctagtgcccttttgtaatacagtaattctcatgatttttgtctgaattgaaatcttctgagattagattgtctacgaaaatacagtcgatcctccttgttttcagcttttgtatttgtgaactcacctactattttttgtaacccccaaatcagtactcacagcactttcatagtca

SEQ ID NO: 126014 - DNA, 141 bp, Homo sapiens
gacacacatacacaaacatataatctaaactgtgttgtgatctttcttgatttaaaatgtttctaattaccaagaaacttcatctacctggcctactaagaaaataattcaagccagttagttcatttctccttttgtgta

SEQ ID NO: 126015 - DNA, 741 bp, Homo sapiens
tcagctatgtctcgatcgttagttttagtgtactgttcattttctatctcacctcatgagaatttacattccatgtgggcacagttgtctttgttttgttcactcctacatcaagggcctagaacactgctagacatagagcaggtgttcaattgtttgctgagggaactcgcatgcatccagtatggagatctctcggcttcttgggcatcccatctctagtgacacattcctccactccatctctatctacatccacatcccaggctgcacccaaaaatacaccaacacatgaaaggtgtcagttcgcagattacacgttcagaaaagctcactctgggaccattacatgtcttctttgtgtccaattacctgcaggatatctgttctttgacttcagcaggggcccaagcaaattgatctctttcctggctccctaacaatcagttccttcctatcttcatttctttctccatctagctttgatgctacggtcttaactacccttcattaaattcacagagtgcccttttgtcctttgatcacatacccagcaaatgctccaaattaaatgagttgagtttaaggagataccatgtaggcagataattatatgaatctgtacttcagaaaaagtgctggtctctagatacagttttggaaattagtacaatatagatggcaataaacccaagggagtgaatgaattcactagaggtatacgctctccagaagtaacga

SEQ ID NO: 126016 - DNA, 404 bp, Homo sapiens
ataatctttccctttttattttttattattattttacatcagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatg

SEQ ID NO: 126017 - DNA, 817 bp, Homo sapiens
aaaggtgctcacccctgtaatcccagctacttggtaggctgaggcaggaggataactagagcacaagaagtggaggctgcagtgagccgcagctgtgccactgcactccagcctgggcaacaaagtgagacacatccaccctcaacaaaaagtcgttacaagagacagcattatatatggataaaagagtcaattcatcaataaaaatgtaaaaattataaacatgcacccaataagaaagcccaaaaatgtaaacgttggcagaatggaagggacagacaacaaacagttctatctatagtaagagttggagacttaaacacaccacttaataatggatagaccatctagggttgggagcggtggctcatgcctgtaatcccagcactttgggactacagacatgagcgaacaatgccacgccaagaaatgatgtaacacatacactagaatagtcatgacacggccgctgtaacaggttgactaaacaacgtagaaatacccagcataggtatggagagggatagagagcacgagagactaccctagcaagacacagggaaaggtggaacgctggagagaggaagcccgggaagcctgtggcgaacagcatggacaccggcccgaggcagctggaagcacactgaaaggggaaggacaaacatgtcgaacccctcaaaccttgggagacgacgagcgagccaagaagaaggggcactaagaataagtcgggaacaacacaagaagacacaaagacaaccacaatatcacagatggcatcaaaaactcatcacacaaatggcgacactaaacagca

SEQ ID NO: 126018 - DNA, 218 bp, Homo sapiens
gttggctttccagtcctcaatcaagttatagttgcacttaaaaatacgtagttttctttatcgttaatatgaataacaccatatgcaaattgggaaacaggcttagatcttctcctaggcattatctgtacccagttttcctgtaagtattcaattgggctcctcaatcaacagagaagagcttcaaatgactttctttgttgtcaggctccattctc

SEQ ID NO: 126019 - DNA, 813 bp, Homo sapiens
gggaagagtgggaggggggtaagggataaaagactactacaaatatggtgcagtgtatactgcttggatgatgggtgcaccaaaatctcacaaatcaccactaaagaacttattcatgtaaccagataccacctgtaccccaataacttatgaggaaaaaaatagattatgtacaatactgtgccattttatatgagagacctgagaattcatggactttggtatctcagagcaggggataagttttcctggaaccaatcccctgaggatgctgaaagatgactatatgaaataaactcagaagctataaaagcaaaaagttgagaaaatgaacattacttacaaatcaaatattactgcaaaggccttaaacaatatgaagctggaggaaatacaacttatagacaaagggttaatttttctcacagataaagagctcctataattttataagaaaataaaacccaactcattaaaaaaatgggtaaaggatatgaacagaacaattgcagataaaagaaatacaattggttcttgaaacacatgaaaagattctaaatctaatcattataatagaaatgcaaattaaaaatgtaatgagatgttattttttttgacaaggataaaacatttttatgacactgtttgatgagagtatggaaataaagttaaactcattgatgatctcctgcatttcaggtgggagaataaattggtacaacccctatggagagcaatttggctatttcaataaaatgttaaaaggcacatgccttggactcaacaattccacttttaggaatttatcctata

SEQ ID NO: 126020 - DNA, 239 bp, Homo sapiens
ccacattgacagcaccagctgaaggtcaccccagccatctctgtcccccatctggccccattttctctattccactcctgtgacaggcctgctgtatgtttctcccactagcatggaagtgccctgagaacagggaccttgtctgactcagtcaccagggcatcctcaatgcctggaaaagcctggcacagatgaggtacccaataggtgtgtgagctaaggctgagggggcagcaacg

SEQ ID NO: 126021 - DNA, 237 bp, Homo sapiens
gggactgagtctgtgccgcctaggctggcagggactcggccagatgcactagcggcaaggctgggctgacaccgcctgggactcgctcgccgtacctccaaggggcccaggtcatgagggggcggctggggagacgcccgcccggtgcccgccctgggcccggcgggtgccccctgcccgccgcctgacgcaatccgaggcgcccttgctgcatgccggcgctggagaaacctcccc

SEQ ID NO: 126022 - DNA, 155 bp, Homo sapiens
ggttgatactgtgtgttcatgataaattctgtttaggccaggtacaaacatcaactggaagtcagaattgtaaaggttgaggattggtagcatttaatcattcattctgtatactgaataagtgaacaaaatgcttttcaaaaaacaattaattt

SEQ ID NO: 126023 - DNA, 119 bp, Homo sapiens
gtctacttttaccttctattaatatagtcactctttcttttcatcaatacttccatggtatgattttttcttctttttagttcagccaatctatattcttgtatttacagtatatctct

SEQ ID NO: 126024 - DNA, 419 bp, Homo sapiens
gcgcacagcgtaggcttaacaataggcacctctgtccattgacaagacaccagggctccaaggggaatggctgcaactatgcagtaaaacatgtctgcacccagaggaaacctgaaccacaatacgcaaaaataaaaatcatcatcatggccgggcacggtggcacgtacctgtagtcccagttactagggaggctgaggtggggggattgcttgagcccaggaagtcaaggctgcagtgagctatgatcacaccattgcactccagcctgggcaacagggtaagaccctgacacagaaaagaaattaaaaaacctatagctcagagatgtagggggacttgcccaaggtcataccaatagtggtcagatagctcccagccctaggtatcatttcctctttatactgtgttgacacaga

SEQ ID NO: 126025 - DNA, 463 bp, Homo sapiens
ttctgagaagcaacctcaaagtcttcacaatgtagaggaaataaacctcatgaaaatagtctagccgagtcactgaataaataaataagcaaacagcaaaaactggagaggggagagaggaatcagtcgtcagtacccagaagtgatacaatatattacctaaaatatccagttctcaacaaaatatcatgagacttgcaaagaaacaaagtgtggctcattcacagggaaaaaaagcaacaaaaatttcctgtgagaaggcccagatgttggattgaacagaccaagacctcaaaacaaccattataaatatgcttaaagaactggaagacactatgcttaaagaagtaaaggaagctatgatgacaatgtctcatcaaatcaagaacataaataaagaaatagaagttacaaaaagaaccaaatggaaattctggagttgaaaggtacagtaagtgaaaag

SEQ ID NO: 126026 - DNA, 363 bp, Homo sapiens
aaaatatcggaccgggtcctgcccatgtactgagcacctttagggcaccaggcaaaaaatgcactgagataaataagcagaggtcttgacctcaaggaacttgcagtctaatcggggaaaacaccaatacataacagatgagtaaatgtaataatagttttggtgttacagcatgtgcctagtcccagtatgacacaaaaacagatcatttccccagaggccccaggagatgcctttgatcatccctataaggagagccctcccttaagtcatccaacccaacctcatcatcctaccacctaaacctgacccttccttacaagagccctctgctgttatggggccccataatcctagcaatca

SEQ ID NO: 126027 - DNA, 274 bp, Homo sapiens
gcctttatctcaatcataaatgttagatgagctgatctgaggcaggctatattcaggatttccagaataaacttttgattccttatataagtggtatcagtggaatgtgagatatttctaaggtaaactttaagaaggaaattctggccagagccagtgtctcatgcctgtaatcccagcactttgtggggctgaggctggagggttgcttaaggctacagtaagctgtgatcatgccactccagcctgggtgacagaactagaccctgtctca

SEQ ID NO: 126028 - DNA, 306 bp, Homo sapiens
catctcacgtgatgggtcacagtcaaaacacagtcaaaattttgtttcatgcacaaaattaacaacagtgcataagaccaggtgcagtggctcatgcctgtaatcccagcactttgggaggccaaggtcagcggatcacctgaggtcagagtttgaaaccagcctggccaacatggcaaaaccccatctctactaaaaatacaaaattagctgagacaggagaatcacttgaacctgggaagcggaagttacagtgagctgagatcgcaccactgcactccagcctgagcaacaatagctaaactc

SEQ ID NO: 126029 - DNA, 260 bp, Homo sapiens
tttcctattcctcatgtatggtacaaagttaccttaaaatcaaacatctgtttttccacccacactgcccatgcagaccacacttgggctggtttaatgtgtagcagggccagtctgttatcttgggctgcccagcaaggttcagctgttgggggtaatgtttaaactccagctacacagtacaagtcttctaggatgcagagctagctgaattttcttttcttttctgtttttttttttttgtttttttttttttttga

SEQ ID NO: 126030 - DNA, 287 bp, Homo sapiens
ttatataaccttctttaatcttcagagtttgaatttatctttcacttcttaggacttcaatgacattttatggatatctactgcagttgttctataaagtggtcttgtgatgcttatataaacctttctaccactcaaatgaaaaacattgagggagaatttttgtcataccttttccacaaatgttgcctaaaaaaggctttgcatttagtatacattcaacaaatatttacagaattgtaccaagataaaatatttagtatgttagactagctaagtgatcttaa

SEQ ID NO: 126031 - DNA, 396 bp, Homo sapiens
gcccaggaagaaatctatattattacagagtacttatctcagaagggttgttataaatattaaatgagagttattttatggaatacatctgaactagtgcctggcacataaaaagtgttatataagtatcagctattgtaattacagagtgacaaataaaaggtcggagtgctatggttatggaatagaatgatgagaaaggaaacttccaggagcttaggtgtactttaagtgcaggtatcaaatattgatgcttcattatggcaagggggctaacaagttgccagtgtgtcacaagtcaacatgcaggcaaagatggaaacattttccagatctaaaatgtagttaaatatgttgtactttggaatcgtatatgaactttattcccctttcaga

SEQ ID NO: 126032 - DNA, 708 bp, Homo sapiens
atctggttatgaacgtcccttctgttaaaactctttaatttctttccacttccctttgtataaacacccatacagttcacgatttaaattaggggaatgattcataatgtgcctaactctccaatctaatttcttccaaactttgtcatctagccaacctaatttcttttggttcatcagtgttctcttcacctctcagcatttgaatatgtagttccttttgtctggaatactcttctcccctccctcccctatttggcttgactaactctaattattctttcagggtccaggttacatgatccattttctgagaagctttctctgatgtctcaggtctggaaacccaccccctccagcacctccagggatttcctccatcactgttttctgaaatgtgtgcttttctccgggaggcagaccacatgggattttctcaactttaaagctccagcaactaccactggccccggcacacatcaccctcatagttgtgctgaatttaattaaatgttagggttgtttttcctttctctctctttatttatttatttatttatttatttatttatttctctttctttgtcttttcttttttttttttagacagggatctcattctgttgcccaggctggaatgcaatggtgtgatcctggcttattgcaatctcctccaaagaccaaatctcccaggctcaaatgatcctc

SEQ ID NO: 126033 - DNA, 476 bp, Homo sapiens
ctatcaggatccacactgggttcgaaatcctcacccaagctaaaggtagcatactctgcaacgtactcttctaggcaggttgcctgggccctctcttttctccacagaagagccccaccacctgcatccctgaggcatgaaaacactttcacgtgctcctccacttcctccccagaaggctggggacagaatactatgaggaaccatcactcagtgggaagcccccacacactgctactgctcactgggccctggacttgctcctgctttcctcacacagaggacaagccatgattctggatcatcctatggggtaaacccacctatggagtacctttcccacaatgcgtgtgttggatctactgggatgatcactggcctggctgtagcaaaggagcaacataaaaaggattttgtctctgtgttcaacgagcttatatgcaaacacatatggaatcaagaacaaagaacaagaa

SEQ ID NO: 126034 - DNA, 510 bp, Homo sapiens
ttacacacacacacacacacacacaaacacacacacaatgactaatgtaaataccttcctgctttataagtcccacacaaagcaattgtgttcatatgcgtgtttttcatggcactccttgaatcagcttggagtcactacaaattattatgggtaataaagggcatgtgccagtaggagggattctcagacaagggagtcccctccctccagggcttcagacttcataagggagcaaatagggaatttatgtggcacaaatatttaatttgtacgatcatccttaggtgatgctttcatattagtaaggatgtatttgtgagtccaattgtagtcattagcttctgaccgtaccttctcccctgcatattgcctgcactacattgccattgttgacttctgggacaattttccaggatttcattactaacaaaccttgccttttctggttgcagtttttagatactttatttaggttacatttaatcttgtttaccatatttagggtga

SEQ ID NO: 126035 - DNA, 367 bp, Homo sapiens
ggtatagtgccagggtcaggtgggtgtgtttgttcagcttcctaatagactcctccaaaccatcctggtaaaaatggggcactgactcacactgcattgttgcagatgggtggggtgaaagttcaagtccttcttcatcccacagtcatcttcctggtcaaagtgggacgctgactcacaccaccttgttgcctctgagtgtgactatgtgaccagctccctgactggctccactgccttcggggttgtggggtgggagggaaggtaggaaaggtggaaggctgactcacaccaccttgttgctatgagtaggagtggagggtcagcttggctctgcatattgttgatatcaggaaaggggagaagc

SEQ ID NO: 126036 - DNA, 283 bp, Homo sapiens
agagtggtgagggctgggaggatcagtgatcccaaaaagagaaccactagccttgggaggggggatgagtttgaaatgaaacatcttcatggcagttggagaaagatgactagaaatacagttacagtgggtgccatgagcctgggcaagtagtccaaagagtgaggctagagagaaaagagtaagatctggtcttgggaacagaggctgagagacagtccaggggaaagagatcaaataggggagatcagagaggacagggtgggtctgtccaagccacggc

SEQ ID NO: 126037 - DNA, 364 bp, Homo sapiens
tttttctttttgtttatagatgaagatcaaaaaaacagcttttttcccaaggagacaacctggctggggtttggggagtagtgtgttcttaaaattttttttttctatttttttcagtcctttgggatttctgtttatgttgctttttaaatgaaaatgtaattaggccttcttgttgacatttccattaaaaacaagcataacttaaaaaaattaaatcagctttatagaaaagaagataaaaatttattattccttttagagaccctggtgttttctctcctctgttttgttcacttagtgcctcagactggaaggtatttcctctgttggttagtttttaaatctgaaattcttcttttat

SEQ ID NO: 126038 - DNA, 232 bp, Homo sapiens
gtgacagagagaagcagtgaactctgaatcacaaaattgaggactctcagttgaaagcaccccttgaggttgtcatgacagccttctcttccctggaacataatccctgcttgaatcctctcttcagcaatatgtgtatagatgtgagagaatttttgcagtctgttggctagctttccatgcatcatataaaaacagtcctcttatagacttgacttgccagttcacacac

SEQ ID NO: 126039 - DNA, 312 bp, Homo sapiens
ttccggctctctgcataccaagtgcctatagcaatgaccccattatggtgatgacccaaaatactcccctcctcccaaatttccaaatgtccccaccccagctcagccactgtgggcacaaaggagagacagtatctactttaacaccccaaataaagatgccccaacattttatatcttcttcttctttttttttttttttttttgagacagtcttgctctgtcacccaggctggagggcagtggcacgatctctgctcactcactgcaacctctgcctcctgggttcaagcgattctcatgcctcagcct

SEQ ID NO: 126040 - DNA, 331 bp, Homo sapiens
ccacctcagcctcccgtggctgggactacaggcatgagccatcatacccagctaattttttaagtttttgtacagatgggggtcttgttatgttacccaggctggtcttgaactcctggcctcaagctatcctcccacctcagcttcccagagtgctgggattacagatgtgatccacctcaacaagcctgtttttcatttttagaaaaatgtttttcacagattcttgaattctgagtgcattcctcctaggggaagaacaagccttttaaagctgcatgtttgatccccaacagggaagtgtttgtattcaaagggtctgaaagctccc

SEQ ID NO: 126041 - DNA, 219 bp, Homo sapiens
tggctgctacagtcctctattaagcaatgtgccacagcaggggtgcctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattaga

SEQ ID NO: 126042 - DNA, 497 bp, Homo sapiens
ttctggaggatccccttcgagggttctgcttctcttttaaatatgagttccaactttaaatcatttatatgctcctatgtctgaccacaggtgttagaagtagccacaaagcctctgaatgttctgctgcttagaaatttcttccaccagggccgggtgtggtggctcatgcctgtaatcctagcactttgggaggccgaagcaggcagatcacagttcaagaccagcctggccaacatggtgaaactacagtgttatacaaatggagtcatacaatatgtgaccttttggaatagcttttttcacttggcataatgcccttcagatctgtcagagttattgcttgtatcacaactttgttcctttttaattcccgagtagcattttatatagatataccacagtttaaccattcatttattgagggatattttagttgccagcttttgactattacaaataaagctgctgtgagcaattgggtacaggttttttta

SEQ ID NO: 126043 - DNA, 245 bp, Homo sapiens
gcgaagagtggggcaggggcagggatgtggggatggagacgtctcctggacaggcacccactgcagccgggtcctgggtcagcctggacgaccgaggctgggatgtggagtccccagcaaggaagggactagggccctaagggatgtgtggggtccgcaggaggtcacacgggaatgtgtgtgagaggacaaacctcccccactgtaacacttcacacatgtacctgcccagacgctcacacaca

SEQ ID NO: 126044 - DNA, 478 bp, Homo sapiens
cagacgagcaaactgaggctcaaaggtggtgttatgtgttggaggccaccctgcaaggttgggtccacctaactcatgagctggtgccttttaaccaacacgtcattgtcgggggaggctctatgaagaccatggcagccagtcacttgatagaaagaaaggatggtcaaagagaggggaggccaccagtgttgaaactgcagtcatcagcattgcagtatccagaaaggggtacaccacgcctgtaatctcaacactttgggaagctgagatgggaggatggcttgaggttaggagtttgagactagctgggtagcaggacaagaccccattgctatgaaaaattaaaattaggctgggcatggtggcctgctcctataatcccagcactttgggaggccgaagcaaaaggactgcttgagtccaggagttgagtccagggcaatatagtgagacctcatctctccaaaaaaataaa

SEQ ID NO: 126045 - DNA, 290 bp, Homo sapiens
cgagtactcatgtcattacactcttctgattttaatgttaaaatgctttttctctaagtgtctttctaacgccacttaaaccatcctaattggaatctagggcttagtctattaattttttaagtatcagaaataaagaaaacttttttaaaaatcagctttctcatataatactactagcagaatagttttagaaaagctttagcagagaatcaaaagaccagggttttattatcatctcagcaattactaagtagctacataacactgagcaagctatgaaatctgag

SEQ ID NO: 126046 - DNA, 297 bp, Homo sapiens
  misc_feature (265)..(265): n is a, c, g, or t
ttgtgtttgaaagagaaagaaactttgtacattttcctttcggtcttggtttactttacctcagcgtttttcctgctctgtgcacttggtgtcataatacttagggtcactagggcagcaatggaggcaaaatagatttgatagacacataaatgtaaatctgattgctcttgaccctctagcttactcactgctgagtgacgtattgagctagggaaggatagtttccatacattaatgaagaatgtatatttccagccagacnatggtggctcatgcctgtaatctcagcacttt

SEQ ID NO: 126047 - DNA, 664 bp, Homo sapiens
tacttacagctgacatatcaagtagtagatgtatattcaatagaacaaaggtaaacattaaaaaaagccactggtcaggtgcagtggctcatgcttgtaatctcagcactttgggaggtcgacatggatcacttgatctcaagaatttaagaccagtttgggcaacgtggtgaaaccttgtctcaacaaaaataaaaaaaaaactagccaggtatggtgacatgtgcctgtagtcctagctacttggaaagctgaggtgggaggattgcctgagcctggtacgtggaggttgcagggggcagccgtgagcagaaatcgtgccactgcactccagcctgggcaatagagcaagactctgtctcaaaatgcatagataacatacataaaataacaaagaagcagcactaacaggacgcttcctttaaatacatatgtgtcattaattggagatcagtgtttgtttacagttttttcttttgaggtgaaaattatataaatgaaatgcacaaatcttaagtgtgaatttgctgagttttaacaaatagacacacttgtgtaaaccaaacctctatcaagatatataatgttattgttgcccagaaagttccatcggtacacagtataccattgaggaaacacacacttttggagctggaggaagacg

SEQ ID NO: 126048 - DNA, 314 bp, Homo sapiens
cttggattaatgttttcttttaactgcaaagtaaatgtaggcattttggtagaaaatcagtgtcaccgtcctagccatgatctttctaaaaggatccttcagctcctcagatctttctttttacttccaattctccaaccttgctatgaagtgtggataaaggattaaaattcagcagatcacttcaggttaaagaaaggaagaggctttgccaaataccctttataagtgcgaggcataaattgaggctccattctgaggacttttacaaacaaatagagccaggtacccaaattctacaaattatattgata

SEQ ID NO: 126049 - DNA, 665 bp, Homo sapiens
ctgccctttagtatcctggttggctgatgcagggaagagggagagcctcctccctccctgattctgccccataggagggtggaatagaatgtgattccaggaccctgttgactagtgagcatggtcccatgcacagagggggctttccttctttctggaattttcttcttagccctgaggcaggagaagtgaactgtaacggggctgacctctgcagaggaggggaagggacactgctttctgctgtcttctctacccctcaggcaaacggggctggaggagtctaaggtcttgctcagactttgagcctaagccacattctctaacctggtttaccagagagttctgcattccaccccagtgatgcaggtaacagtggcttttgaatctcccacctgcgatggctcctaatgttttgctttcagaaaccaaaatcacatctggtattgcctaaacccctcgtgactcctaacacagatcgtgagtgaaaacctgccttctctgagcagcattctttgtctgtaaaatgggaatagtgaccatgtaggcctcaccggggtggtggggaggactggctgagatactgtgtgaaaagttccagggcctgataccgagagatgcttggtaagtgttagatagtattagtacttttccctttggagcaa

SEQ ID NO: 126050 - DNA, 790 bp, Homo sapiens
acagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttccttaagtatgacacaaatactcatatactgtcttttagagtcagtatagttggagctgttttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaatt

SEQ ID NO: 126051 - DNA, 173 bp, Homo sapiens
gtggtggtaatcctctatgattatactaaaaactgctaaattgtatactgtaaatggtgaactgtgtggtttgtgagttatatctcaatatagctgttatacaaaaaatttaaaaataaggccggtacggtggctcacgcctataatcccagcactttgggaggccgaggtag

SEQ ID NO: 126052 - DNA, 230 bp, Homo sapiens
ctgggcatcattagataaaataagtacaatcaagagacaggagggaactcaaagccatgccttgagggatggccaaaggaaggacctgggactcctgagtccggagaaatgacgactgggagtggggaggatgtggtagcttccttcaaatttccgaagagctattggtggtagagggattgaatcacattagaatctcttaggaggacagaacaaccgatgcaagcgag

SEQ ID NO: 126053 - DNA, 699 bp, Homo sapiens
ggttactcccattgcgattacttcccctaggtgcactgagattggttacttcgactaaaggggcggagacaaggaaaagtcagccccccccgaccccgcctccttgatgaaggaaggttgtgattggtccggagaggctgccgtcggatcctggctctttgcggtctgggagggtgggccttacctagacgccggaggggactgatctctgtttccgcagggctctggagctggtgcaggtttaagtccgtctcagacagtcccctcaacccacagcctaagccccttgcccttgggcctccgtgacacagaacttgcttccttttcctaggtcgtccttcacctcccttcaggtgttgcttcttttgtgaaacctttttagaaccgctctagtgaacctctctttaactggcgaggaaacctctggggcctgataatcaggctgtaatgtgggacgacaggattagaaggactaggcaccttggtggtcttgttccctcttccatgagtcttgggtctctcagctgaagagagcaaaagtgaattttggccgctaagattaatcaactgatctgggtgttgagcagacgcgcattgtttagtcctagaagcccattggcccttccccaaagttgccaaccactgggtgagggaatcttgtgacttggagagagaaagggagagaccacattaaaaaaa

SEQ ID NO: 126054 - DNA, 126 bp, Homo sapiens
tgcccttgaagggctccgtagggctccagtataacctcaacctaccacacatggccatcactcggaaattaggtcttgaattggaaggagcactagaaaagtatgtgtttaaaatacactggaatg

SEQ ID NO: 126055 - DNA, 471 bp, Homo sapiens
agtccaccagattcagtaggttggaaacacaggcatggaggggcattccatggaagggcgttctgtgcctgatcaaagcctggaggtggagaatgtgaggcttggaggagggagctggtggttgggttggtggagctgcaaagggcacagggagagaggactctccaagagctcagtggccaagggcctgggaggtagactctgagcctccttcggggggatgaccagctggcagcagtgatgggatctggagctgagtgggaggtgtggactgtggaagagattttggagctgcagctgtacagatggtagctgaagccagcccatagagagcgaaggaggagggcatcagggcattgctcctcatggaagccaggatctggaagagggggaggagaattgggaatgttgggtcatagaagtcaagggaggagagttttgtggctccatctgcacctggacagagaaaga

SEQ ID NO: 126056 - DNA, 481 bp, Homo sapiens
  misc_feature (399)..(399): n is a, c, g, or t
  misc_feature (437)..(437): n is a, c, g, or t
  misc_feature (456)..(456): n is a, c, g, or t
  misc_feature (461)..(462): n is a, c, g, or t
  misc_feature (464)..(464): n is a, c, g, or t
agggaaggagcaactgcagaaagccagcgccagaggtctggcagagagggaggcctgagaggaggcagttgggctgtccacgtggagagagagtgggaggaaccaatgttacggccccacactcttaccttcttccagggcaccacagaaagcccaaagatgaaggagcccacagatatggtcagcctcccaaagggcagatgtgaattgagaaaggtcaactgtaagtctggaggggcaaacagaaagtgctcagcacaggctcctcttgctcctctgtctccatactttttccaggtaaaaactctgtgtcctcatcacaggaaaggcagctcgcccctgagttagcagctcgcccctgagttagcagctcgcccctgagttagcagctcgcccctnagttagcagctcgcccctgagttagcagctcgcccctnagttagcagctcgcccctnagttnngnaccgagctctaaatcgt

SEQ ID NO: 126057 - DNA, 501 bp, Homo sapiens
cagcaccctgtccccagagttggagacagactgccttgccaatacaaaaacagaaaatattcccaaactcaggcctattttgccaatggaaggaaagtccccagatggttccaacagacagagagcaatggattgaatttaggaacaaggcagtaatttcatacagccctgcagagctgggagattctgggaccagttttagtgggggaggggaggtaaaaatacacttgaggacacattaaatagggccccaaaactaagagcctagcgcttgggacagaacgtgtgtaatatgaagttcaaatgaacatgtgtgccgaaggctaatgagaagcccctagggtgattatatgagctttacctgcaagaggtgacaatcgagtttggcacatgctgagtctattgggaaataataatatcaagagatctataccacatccatgtatgtacagctcccggcgccggcgaggcaggagagtgacttactcagggaaactgact

SEQ ID NO: 126058 - DNA, 320 bp, Homo sapiens
cacactgtggcaaggtctgtgatggaggaagtccaggtgactttgggagctagaggtcaggatgggcttcctggaggaagtggttaggaatgaaaataacatctattcagcattattattatgatgtgtcaggcactgttctctcctcaacaccccgctccagaaggttttcttctcacacacccattctacaggtgagtctgggatcaaagaggcccagtagggtgtcagaggtcacgtagccaagacatggcagagctgagatgaaaccccgcagtgggacactgccccacttgccccccgacagcgctctccagcct

SEQ ID NO: 126059 - DNA, 567 bp, Homo sapiens
tcacaactcattgtggctttgacctcccaggcctaagcaatcctcccacttcagcctcccaagtagctgggaccacaggctcacgccaccacacctgactactttttaagttatttgtagagacagggtcttgctttattgcccaggctggtctggaacttgtggcctcaaacaaccctcctgccttggcagttttgttttttatttttagaaagagatctatagcagctaacaatgtactcttagacataaagttagtaatgtgactagtttttagatagattctgaatgggaatcagaggaatggttttcttaggggcttctggaaattatagttgtttagataccaagtaagtgtgatatggtttggctctgtgtccccacccatatctcctcgtcttgaattgtactcccataattcccacgtgttgtgggagggactcggtgggagataatttgaattaagggggcggtttcccccctactgctctcatggtagtgaataagtctcatgagatctgatggttttatcaggggtttccgtttttggatccttctcattttctc

SEQ ID NO: 126060 - DNA, 999 bp, Homo sapiens
ccttcatcccagcctctctttgccttcacttagactgaccctgacacccattaggctcagcaaattacctgggctgtactgctgcaaggcttcacagacagcccccattacttcagtcaagcccaaatttcatcctcatctgttagtcatactcctattcactgttctcaactactcacacatgccctgctcttgtttacactgccggtttacactctttctccaagacatcacaggtgatatctcctagtgctatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccgtatccaggccatcaccaatcattctatatgacaaatgtttcttcttacatccccacaatatcaccccttaccacaagacctcccttcagcttaatctctcccactctaggttcccacgccgcccctaatcccacttgaagcagctctgagaaacatcacccattctctctccataacacccccaaaaatttttgccgcctcaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggccctgcccgccttaactgatgacattccactattgtgatttgttcctgccccaccttaactgagtgattaaccctgcgaatttccttctcctggctcagaagctcccccatgagcacttgtgaccccccacccctgcccaccagagaacaaccccctttgactaattttccattaccttcccaaatcctataaaacggccccacc

SEQ ID NO: 126061 - DNA, 972 bp, Homo sapiens
aggatcccgtacgctactattggtacgctaccatggcaatactgggctgtactgctgcaaggcttcacagacagcccccattacttcagtcaagcccaaatttcatcctcatctgttagtcatactcctattcactgttctcaactactcacacatgccctgctcttgtttacactgccggtttacactctttctccaagacatcacaggtgatatctcctagtgctatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccgtatccaggccatcaccaatcattctatatgacaaatgtttcttcttacatccccacaatatcaccccttaccacaagacctcccttcagcttaatctctcccactctaggttcccacgccgcccctaatcccacttgaagcagctctgagaaacatcacccattctctctccataacacccccaaaaatttttgccgcctcaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggccctgcccgccttaactgatgacattccactattgtgatttgttcctgccccaccttaactgagtgattaaccctgcgaatttccttctcctggctcagaagctcccccatgagcacttgtgaccccccacccctgcccaccagagaacaaccccctttgactaattttccattaccttcccaaatcctataaaacggccccacc

SEQ ID NO: 126062 - DNA, 568 bp, Homo sapiens
ggctgactctcttttggactcagcccgcctgcacccaggtgaaataaacagccatgtgctcacacaaagcctgttggtggtctcttcacacggacgtgcatgaaatttggtgccgtgactcggatcaggggacctcccttgggagatcaatcccccatcctcctgctctttgctccgtgagaaagatccacctacgacctcaggtcctgagaccgaccagcccaagaaacatctcaccaatttcaaatccggcaggaatgtcaggcctctgagcccaagccaagccatcgcatcccctgtgacttgcacgtatacgcccagatggcctgaagtaactgaagaatcacaaaagaagtgaaaaggccctgcccgccttaactgatgacattccactattgtgatttgttcctgccccaccttaactgagtgattaaccctgcgaatttccttctcctggctcagaagctcccccatgagcacttgtgaccccccacccctgcccaccagagaacaaccccctttgactaattttccattaccttcccaaatcctataaaacggccccacc

SEQ ID NO: 126063 - DNA, 407 bp, Homo sapiens
agaatgcctctaatattcatatcttagcactaaagaagcatatattattctgcagattgaattaaaatgttagttaccaagatatgaacttagacattttcagtaagcatttataggctattctagtagaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagcgaaagtagataaattcatattgtatgtctgattctctttgggtttgaaaagaaataaagactctacttctaaattagcatagaaaaaaggagaatttctcttgatttatttctcagtttgggtttg

SEQ ID NO: 126064 - DNA, 532 bp, Homo sapiens
taattacagggggattgatcaaataagtacacatatggaagataatggtattttcaccatcagaggacaatacaaatatgggagagatgaaaattaggacccctacagtgatggaatgaaattggagatttaagtgtgcacttatatttttcaatacatacatacacacacacatatatatataaatgtgtgtgtctgtgtgtgtataacatacacttgttactttctgattttgatggtatattatggctatatagcagaatatccttgaggaagagagatatactaaagtatttagggggacaaaagagaagcatccatctcaaatatcctaggaaaaaagttatgtactgtacttgtaacttttgtttagaattgtttcaaaatttaaaattaacacattattttcagcacagtaatcatgtgcagtaaataatgacgtacacttctaattatataaaatactttgtacctataattttcagtattttaggtagatgacctttttgagattctaaacatgcaatctgtc

SEQ ID NO: 126065 - DNA, 255 bp, Homo sapiens
tacttattttgctacttataatagcaaaaatattgaagacattctaaagattcatcaatagcatggctgtttaagtaacttatgtctcaggacagaatattggcaaccattaaatttcagctgcatggccaggtgaggtggctcacacctgtaatcccagcacttcaggaggtggaggcaggaggattgcttgagcctaggagtcagagaccaacctgggcaatacagtgagactcatctcaaaaaaagaagaag

SEQ ID NO: 126066 - DNA, 402 bp, Homo sapiens
aggctgtccagacctggcactcacagtttcctatccaccttagtctctcccacatcaactagtaaccaggagaactacatttaatccacacttcctatgtgccaggcaccatgtgagctgttatatgtacacattcttacttaatctgcacaagagtcctattagagtttacaaccaccaccaaaaacctgcacaagttatttggcaacaaactgcaaagtaaaactcaaattttctatgcttcaagctggaactctgttctcctacccatcatagtcttcttaattctacatatttaacatctcttttgtttggctccttatgctgctatctaagttcaggatctcattatatcactggaacatcaaaaagggccagttctggccaggtgcggtggctcac

SEQ ID NO: 126067 - DNA, 156 bp, Homo sapiens
aactgctattagtctaggacagggtttctcagcctcacactccgacatttgagctggataatgttgtaggggctgtcctgtgcattaaaggatgtttagccagcatccccagtttctacccactagattccagtagcactccccacctccagttgt

SEQ ID NO: 126068 - DNA, 764 bp, Homo sapiens
ggcacgtgccaccctgcctgccttgacccttttaaaaatgagttgctgtgcttctagaacatttgaagggagaaaacatttttcgtgtaatgcaacatcaaagctattaactattatgaagttattttcccacagtgatgactgatttctagagttgatatgaaacaggatgtccatatcctcatctgcatgaaaggaaatggttcttaacagaaatgttctcaggctaaaatttgcctccatctcctcttctctagtgtaacatcttcctttcgtgttttcacttatttagtcattcagcaacacttctgaggtgtgtaccattgtgctaacaatgataaaaatttaccacttagtgtagtattctggagtatgtagcattgcccctgggccagacactagttcatttagtgctcacagcagcctggagatgggtgctatttttatccacattatatagaagaggaaactgaggcacagcatgattacgtgaattgaccaaggtcccacaattcgtaagtggtggaattggatttgcacccaggcagtccagctccagagtctgtgctcttctcctgcctctcaccagtaaggagggtgaagggatatcttcagcaattatcatgaagatagcaagggcttggcaggatgctgtgggagcctcctgataatttataaggtaggtattattatcattcataatttactgaaatttagaggtagaagtagggatctatatagaatagtaaccaaaaaatctcatc

SEQ ID NO: 126069 - DNA, 326 bp, Homo sapiens
catttattttccttgttcactctctagtgagatgagcatgaagcggtgcaaaacttagattgaacaagagagcaaagggaagcaaccatggtaaatctgcttgcttgtgggcttaattatattctgggaagaaacactttagggcgatcggtgtgatatatatatattttttgagacagagtctcgctctgttgcccaggctggagtgcagtggcgcgatctcggctcactacaagctccgcctcccaggttcaagcaattctccagagtagcttgggactacaggtgcccaccaccacgcccagctaattttttatatttttttt

SEQ ID NO: 126070 - DNA, 230 bp, Homo sapiens
tgatctgggcagtggagtgtgtccagaggggactggctgggtctagagcccgttggaaagcggaatggacagaccttggggacaggttggatgctgagaactcataaatgacttggaggtatctagcttgggtaactgggtgcgtgacggctctaaaagctgaggtagggaagagaggaggaggtctggggtgaggaggagacagatcaagcattcagatgactcgataa

SEQ ID NO: 126071 - DNA, 441 bp, Homo sapiens
ttcaccatgttggccaggcttgttcgaacttgacctcaagtgatctgacagcttcggctcccaaagtgctgggattacaggtgtaagccactgtgcctggccagcatacattaattcttaatgaattagtaataacagtaccatgtcctcaactcacctgcagggctgcttacacagcctcatttgtttgcaagtgtgggtaagctctaaactactctccaacgtacaagtgctgttataatctgtaaaagctggttttggaattagaaggtgacctgatccccttccctttgcagcagaagtcagggtgcacagtgacctgttagtcctcagttgcactggctatggtgccaactgtgaaagtaaggcggaggtcgccctcagaccagcgcagcttgctctgcctgacctgagaccctacttctgtttgtttcctatctg

SEQ ID NO: 126072 - DNA, 780 bp, Homo sapiens
tacttacttcctaaaaaacgatagcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggtatgtgctgtttataaaacaaaatggggaaaaaatagaattaaccatgatattcattcaagctgctgtttctagtatgttttatttttaaccatgtgggttacagaccatgatcatgaatgtctaccatattgtttataattctactttttgaagaagagattcctttgtcttttaaggaattttttgttttaaaaatgtttctacattgaagtacttcagcctcaacatgccccatgcctccctaatgccttctcttcctcctgtgtcttcctagcctgccttccttggtctgccctaagtcagaattttgtatcatttcattctttttcctcacctgctgctacatccagtcaggtactgaggccctgctgattttacctttgaaatgtctcttgaatccattttttccctctccatttccattactggtgttctggttcaggcccccatcacctctgatccaaattatttcaatcaaaggtgattcctatgtcaggaaaacagacacagatggaataaatagttggaatt

SEQ ID NO: 126073 - DNA, 905 bp, Homo sapiens
tacttacttcctaaaaaacgatagcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctagaaaaatcatcccatctcctggaaaggaacactttgaacgtgttttggaagaatattcacatcaagtcaaagatttacagagaagactaaatgaaagcaatgaattgcatgagaaacaaaagttttatttgaggcagtcagtcattgatttgcaaacaaaacttcaggagatgcaaatggagagagatgctatggctgacatcagacgaagggagagtcagtcccaggaggatttaagaaatcagcttcaaaatacagttcatgaacttgaagctgccaaatgccttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagta

SEQ ID NO: 126074 - DNA, 548 bp, Homo sapiens
gatccacttgaaaatccctatttttagcagaccttgtaggatgccaatatttggggccagagtctcgttactaaaatgaatgctatggagctaaggctgcggtgcccagctgggctagacatttgcaaaaagagagcagactggcagacagtgccaattctcaacagaatcttttgattagaatgccaagttgctataagggtatcagtaacatcctcaccctttagcaggcaaaggaggctgggtatgtgagaaaacaaactctgatccacctgatcctccactgctttttgattctgagaaaaaaaaaaattgttcagtaactccagctgcctgaacagaaattactttctgaggagctagaagccctgactggaaaagagctctgggggattatggcatgggaggagagctgtcaggcatcaggcttatgtgggaaggacccacgctgactacaacagtacaagtaactgcctgagtggctccataacatggaaacagcaatcgtatgttccaaagacagagttactgttttaaggacagaggaa

SEQ ID NO: 126075 - DNA, 241 bp, Homo sapiens
gaccaggtgggggtggctgaggatttgccaagaggtacttgcagcatggaccaggttggggttgctgaggacctgctgagaggggcctgcagcgtggaccaaggtgcagccacaggttaggcagctgtagccaacgtccaggtggaccatggaggtagaaccagtgggagctgccgagtggccggtgaggcactgggaggaccaggtcaccgcgaggaggaggaggggctcccagaaagat

SEQ ID NO: 126076 - DNA, 291 bp, Homo sapiens
  misc_feature (82)..(82): n is a, c, g, or t
accgccccttccccctagccaacatcactcttggctgatgtctccttcatttacctggtcctgcagacagtatggtccaggntcaagggtcatgagggggatgggacggtttgtgggcaagttgatacgttaagatttcagtgtgatgagatgaaatacttataggttatttagttgaaaatgttgaataggcatcttcatattttggccttagtgtcaatcagtgctaatccagaccaaaattttgaagacgtattttaaacttactttcgaaactgtgggcagggatga

SEQ ID NO: 126077 - DNA, 124 bp, Homo sapiens
gaaaggaatgtgtgtgcatgctaactggattggagaattctcagcacaatgtaatttgtgaaggaagaaaaaaggaggggcgggaattgatggaaaagagcaaattgttaataactggtgatgg

SEQ ID NO: 126078 - DNA, 707 bp, Homo sapiens
aggacacttattacctgctagtcacaacctatctatatgaacatatacattggcgtgggaagtttgtctgtgattgtgaaacaagattgtcttgctaaagacattctgaatatgtgaaggcaggagggagagataattgtaaggctttgagtgcctctaaaatcctactggatagttgttggcttcaaaaaaaggcagatagcttctgaggtcatagtattccatcagtggcattgctacagcctgctaactgactttcattgcccacacgctaacattttgttctgctgtatctgatggggaagggttgagccacgcaggcatggagtgctagatgtcttctgcatgccagaagagttcattacttagtattttaacccttcatttacctgattttatttatttatttatttttgagacggaatctccctctgccacccaggctggagtgcaatggtgcaatctcggctcactgcaacctctgcctcccgggttcaagtgataattctgcctcagcctcccgagtagctggttttacaggcatgcgccatgacgcccggctaatttttgtatttttagtagagatggggtttcaccatgttggcaaggctggtctcgaagtcctgccctcaagtgatccacccgccttggcctcccgaagtgctgggattgcaggcatgagccactgcacctggcctttcatccac

SEQ ID NO: 126079 - DNA, 345 bp, Homo sapiens
tgcaaggcaagaccgtcaagaatttgcagaactattttaaaacactacaactttaatcacaatttctagtaatatgctttatatacttttttttacagtctccagtatctctttaggtagaacacttttgaattcaaagccatgggtcccattgttaatttgaacaaaatatagtaagtatactattattttccatgtctttctaggctttttaaactctgcagtgtatttactgtactctcgtagaaggagtgccatcaactgcaattggtacaaattgtgcttatttttctgctcttttcacgttcccaaaatatgttcccattcaaccaggcaggtcttccg

SEQ ID NO: 126080 - DNA, 329 bp, Homo sapiens
cagcgcaccgccaagctctctagctctcctgtctgcagcctccaggagcccacacagggctggggctctgtgcccccaactcacacccgtcggctcccccacagagaaggatactgaggccaggagaggctagagagcttggcgggtgcgctgggcccagatacgcggctcctgcctgcctcatggcctgctcctctgtcggggcctgtcaccgggaaaccccttttttagcagcgatgacgacactggaaccacgctagtctccgtccctcccgctcacatgcgcccacgctccccctcgaggcaggttgagccccggcctggaccgc

SEQ ID NO: 126081 - DNA, 96 bp, Homo sapiens
gagaatcgcttgaacccgggaggcagaggttgcagtgagtggagattgagccgctgtgctccagcctagacaacagagtgagactcccgtcttaag

SEQ ID NO: 126082 - DNA, 480 bp, Homo sapiens
tggccaggttggtgtcaaactcctggcctcaaagtgatccgcccaccttggcctcccaaagtggagcccccgtgccccttgtttgtgacctgtcaatataaatatgcctcagtaatggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagcattcgtaatctaacacagtattgttgccacgagtacgagtatgtgatagactgttgagaataaagaaagcaggcacagttggtcagtcctaagataaaggagatgtttttcttatatgtttgtgcattaaaga

SEQ ID NO: 126083 - DNA, 329 bp, Homo sapiens
tctgttaatgtgaattacattatttagtttttgcatgttgaaccaaccttgcattccaaagataaacccttctcggtcatgattttatcctgttttatattattaaatttgatttgctaaaattttaagatttttacatctacatttatgaatgatattggtctaaaatttcttttcttgtgtttgtccttgtcaggtctttggtatcagtactatgctggcttcattaaataaactggaaagtattccttcctcccttgttttctgaaagagtttgtgcagatttagtattatttctttccaaatgtttggtagggtttcctttgtgc

SEQ ID NO: 126084 - DNA, 736 bp, Homo sapiens
atcttaaataaggggatttattatctcacaaaagaaatttggcggtaaggcgatcctaaggtcggttaattcagcatatcagcagtgttatcagggacccagatatgtttccatttttctttcatcttcagcatggtcttcataggctaactcccctcaaggttggaagatggcttctgcagtcccagacattatgtgcagttacgaaaacatccagcagaatataaaggactatttttccctcatgcttgtcttcataagagataagaaattttccttgaaggcctttcagcaaacttaccctcatgtctcagtagccagaacacatgcccatccctgtgccaatgactggcaagggagaaaggatcaccaaaaatgactcagaccacagaggattaattctgattacttgaaggggtagtgggctctgccagcagagcagaagcaggtggctgttgggtacatcatcagaagtgaacaagggccgggaccaatggctcatgtctataatcccagcactttgggaggctggggtaggaggaaccagccttggtaacatagcaagaccccatatgtacacacacaaaaaaaagccaggcatggtggcatacctgtagtcccagctgctcgggaggctgatgcaggaggattgcttgaccccaagaggtcgagactgtggtgagctatgagcaaaccactgcactcctgcctgggtgacagagtagggctctaactc

SEQ ID NO: 126085 - DNA, 746 bp, Homo sapiens
gttttctccctagtttttctgcctacccctcactctctgcctcccagctcttcactgtcattttcttactatctgacttagaacatggctcatttatagcttttcttacttcattttgcaattaattgcacataatatgatctactaggatgagctccttgtacttacttgctttgcacactcgcccttgtaagaatgagctttttgagtaaagggataactcttacatatttttttttcttcaacttttattaagttctggggtacatgtgcaggatgtgcaggtttgttacataggtaaatgtgtcccatggtggtttgctgcacagatcaacccatcacccaggtattaagcccatcattcattagctattcttcctgatgctcttcctcctctgaggcacagtgtgtgttgttcttcactatgcgttcatgtgtgttctcatcgtttagctcccacttatgagtgagaacatgcagtgtttggttttttgctcctgtgttactttgctgtggataacagcttctaactccatttatgtccctgcaaaggacatgatcttgtttctttttatagctgcatagtattccatggtgtatatgtaccacattttctttatccagtctattattgatgggcatttaggttgattccatgtctttgctattgtgaatagtgctgcagtgaacatacacgtgcatgcatctttgtaatagaatgatttttattcctttgggtatatacc

SEQ ID NO: 126086 - DNA, 445 bp, Homo sapiens
ccacttagctcctcaccatctttttctgctatattgtttcctctgtgccagcctactttccaacttcatctttttgtgcatgctgctaactttggtttgataaaccttctactcttttaccttgaagcattatgactcatctttctagacctagatttgatggcagctcttctgaagcgtttcctgaccctcaagcaaggttagctgctctacctccagtgtttctattacattttattcatttgttagaacatttacttcatacaactgttcactaactgttcgtgagcctgtctttgtgattaaactataaacttttcaaggatagtgactgtagctagtttatcttcttgtaccactagttcttagctcacagcgcttggaacttggtagttttcagtatgtggttgctaaatgatgttgacaaaaccatgagacaatattg

SEQ ID NO: 126087 - DNA, 804 bp, Homo sapiens
tgtcacacgcatggtgctgggctcctggcagcctgcagaactctggttcccctgcagtgatgggggctcactcctgccacgggactgctcagtcaggacgttggtaacaggcccatacctccgtcctagtggctcctgaggcaggtggcctggtagcagctgcagtacctgtgagccccaccagttctgtgacgctttgtggtccagacagtgtgtatcatttcagtttttgtttttgttcttgttttttgagacagagtctaactctgtcgcccaggcgtggaatgcagtggtgcaatctcggctcactacaacctccgcctcctgggttcaagcaattctccggtctcagcctcctgagtagctgggattacaggtgtgcaccatgatgcctggctaattttttttgtatttttttttagtagagatgggttttcaccatgttggccaggctggtctcaaactcctgacctcaggtgatccacccacctcggcctccatcactggaaaacttgagacacagaaaagtgtctccaccatggtatggctgaaggagggcaggccaccaggcagacagaccaagatccgaatgtcagcatctacctttatgtgctttatggcatgaccttgaatctctctgagccagttcctcccctgccaaaaagaatagcaactgggcagtgtctggtcaggtcagcctacagtacgtggtgcctgttcaatctcttgggcgacagtcaggccccaagctcgcagctcagtgtgtgggggctgaatcttcacctgagtcctcttcattctacc

SEQ ID NO: 126088 - DNA, 366 bp, Homo sapiens
ttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaa

SEQ ID NO: 126089 - DNA, 785 bp, Homo sapiens
gtagtttgccaaagttatatactgcagagcaaatggcaaggctaagatttgagctgagacaaacagatagcatttgcattgtactgcattccgtaaagactacaagttgtgttctgtcgatcaatctatctgaaatatatatatttttgattcaaagccaacattgaaagtagacagacattgtcatcctcttgcctggaccagactgtctatcactgtaaaacacactactccagaattctgtagccaaagccgcaaccattttgttatatctcacaatgtttcttgggtcaggaattcagacagggctaggccgggcaattcttctgttctgcctagcatcagttagtcacttgttggtattcaactgcagccaggctgcattgaagggtccaagatggcaatacttgtatatctggtaacctggcggggatagctggaagtctggggttcaactgcacactccatgttttctgaggttatctctacatggttctactacagagtacttggacttctcatgtggaagatcagggctacaagagaacatgatggaagctatgagttctcttataggctgagccccagatgggcatggcatcacttccactgtactccatttgtcaaagtattatagaccagtccagattcaaggccagtggaaatcaaacccacttctcactgaagggagcgttaaaaatatatagccatctttaatctactacagtcatatacgctgttttcatagaatgaaatgaaaaggctgcttttaaagacagggcttg

SEQ ID NO: 126090 - DNA, 533 bp, Homo sapiens
agtagtgtgtctcatctcttaccaggacagatgatagcatccgaagactcggccttgaaggtcctcgatagatcgcattacgtgcctgcgcgattgcgactggatagcacggcttagaaagtgatgcacatgaaataagatgcgcccatatctccgtgtgcgacatccagcagtactgaggtctcccctccctgccttgactctgatatagctactcctgttcaacacccctcccgtgaagccagcttggaatctgctcaaaaccacaagaaaggaaggcctgattggctgactccttagggagaacctccaagagctcatgccacaagccgcaagcccggagtcagccctaaatgagcctctcctggagccctgccctccaaaaccctggaaaagcggggtcctctcgtggttctaagctccttcaccatcctgctcactgccccccagaacatggctcatctactcctccttcaccatcctgctcactgccccccagaacatggctcatctactcctccttcaccatcctg

SEQ ID NO: 126091 - DNA, 138 bp, Homo sapiens
ctctactatgaagtgggtcacatatcctgcagtttgttacttatgaccgtttcttttcaaccccacagctatattactttcacctgagtctcatatcttactaaagcaaatacagaagtccctgggtctagtctcata

SEQ ID NO: 126092 - DNA, 415 bp, Homo sapiens
ggaattgctgagtcataggtggtcgcatgtttgtttaggagcagctgccagaccttctttgcaaatggttgagccatttacacttccaccaacactgtgtgagagttctgttgctgtacatccttgccaacatttggtatagtcattctctttaattttagccattctggtaggtgtgtagtcatctgtcatttggagttttaatttgcctttgtctggtgactggtgatgagcacagagctcttttcagcgtgcactgtgtttgtgtgtgtgtgtgtgtgtgtgtgttatgggattggagtaggcagtctgtgtgtgtgtgtgtgtgtgtgttacgggattgggggagtacgcagtctgtgtgtgtgtatgtgtgttatgggattgggggagtaggcagtctgtgtgtgtgtta

SEQ ID NO: 126093 - DNA, 392 bp, Homo sapiens
cagagtataaaacttatgctctgacccaccatatgctgaggaggtgatgccaggagagtggaccaggagacgagggcagcagggtcaggagaggagggaggagagccagcggaagggacatctcttgctgtaacaggagcaggaggggaatggatgtagataacgatgttcagtgggttaagggggattacctttaattctctcaatacacagtgaagggcctgggttgagtaggggactcaggagaacagtggcggtttggaagtatcccagggcatggggctgcctaggggctttatggaagtcaaagctttagaggagtcagagagggaggtgccagccacacgaggctctgttggactgaggctgaagcctgtgggtatgttccagca

SEQ ID NO: 126094 - DNA, 504 bp, Homo sapiens
cgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacattggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatc

SEQ ID NO: 126095 - DNA, 371 bp, Homo sapiens
ttcccaaccacttcccacttgcaggcccctccacttgtccttgctggttatgaggcactgacgagttttagggcagggaccatgttttacccatccttgcatttccagaggctggtacccagggcaagtgtcaagaaacggttcttgatgcaggcttgctgatggtggtattccacagatgggaaaaaaggagcccagaatgctggcctcctaatccagattgcttctcagtattattttgctgaaactacccagctgctgtgagcaaaataacaatgataataacagtagcaaatagagaagataggtcagttataactgagctggtagcacacaagacgtaattctctgttactagtttcaaaacagtc

SEQ ID NO: 126096 - DNA, 969 bp, Homo sapiens
gacagaaaattctttcaaaggtcaaccaacatttttaagaaacaaaatgggaggggataatggaatctagaattgtcatatatatttgtttacttgtgcaatgctaatatagtaactcggctgtcctttgaatatcactgtgttgagtagattcctctaggacctttgatttcatgagttgggcccaaaccgtggtggaataataacaaaaagaagttaaatgccacaaattttaatagtgagcttacttgaaggatttaagtaggtttaggaggtgaagaaggccgatggagaaatttacagattaattttggaagctctactctagctatcgaacaatcaaaggaatgcacctatcagctacaaagaacagctagacagctgttttttttcttttataaatgtttctgtgttgtgtcaaaatgatttctggtgatttaaactaacagataatcacagctgctgtctaaattcatagtgttgaaaattacaaaatgaaaaaaaaaaaaaaacacttcattacctgtgaagactgtgtctgtgtttttaactatttcttgtacaaatatatgaaaacttttatgaggagactggtgccaagtagctgaataatggggaaagggatattctgttcgtaaaaatcttagcagtgttaccaactctacgatatatatataaaaaaataattaaaacgttacaaagcgacagctatggtacatttgttttgtgtgaagctaaccggacctaacttcctgagtgcctggcttattttgaaacattttttttcattgaccattgataatgctgcaaatcagaaatgtacatacttcatttacaacagggttctttttatacttttgtagattctcatacatgtcacatacatggttgtctttatgtaacttaattttttcatccgcaggtgccattttcataataaacttctcttggatttgttactatctggca

SEQ ID NO: 126097 - DNA, 725 bp, Homo sapiens
cattttcacttttagatttacaaatactatttccttttaatcaccttttaaatatatctgtctttagcatttggatcaagtacatttcaacacacagatatcataaaagatgaaagagtactgcgttgccctgtttttagcacaatgggatacaagtttttgttacattatacttcatgaaaaatcactcctgttaaatgtctaatgggatgagaatactatatttcctttttgtccttaaaaatgtattattcaggccaagtcaagagaattgtttgaggctaggagttcaagaccagcctgtgcaatatagcaagaccttgtctctgggaaaaataaataataaaaaaatagctaggtgtggtgctgcacacctgtagtcctagctactcgggaggctgaggtgggaggatcacttgagcccagagttcaaggctacagagagctatgatctaaccagcgcccagcctgggtgacaagaaaaaaagtattattcacgcatcagttcctgattttgagaaaattcatctgggatactgtcacctgaagacttatagtcaatatgattatgtgcttatatgatcaatttcatcatcttcgttaaagtctagagtgctgctcttggtttctttgcattcttctaattcatctaataattgcaaaacatcttttagccagtttttccccccactgtggtagtatattagttttctattgctattgta

SEQ ID NO: 126098 - DNA, 3195 bp, Homo sapiens
  misc_feature (2990)..(2990): n is a, c, g, or t
  misc_feature (3082)..(3082): n is a, c, g, or t
  misc_feature (3174)..(3174): n is a, c, g, or t
cgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccattactattatttgtcattttaggagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaatggttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtngctgggactacaggcatgcgcagccactatgcccggccaataagctatatttattcttatttgatgtggatgaaaattatcaaaattggccnggcttggtgctcatgcctgtaatcccagcactttgggaggccgaggcgggcggatcacgaggtcaggagatcgagaccatcctggctaacanggtgaaaccccgtctctacta

SEQ ID NO: 126099 - DNA, 2687 bp, Homo sapiens
  misc_feature (2482)..(2482): n is a, c, g, or t
  misc_feature (2574)..(2574): n is a, c, g, or t
  misc_feature (2666)..(2666): n is a, c, g, or t
agcggagaatctctcctgtccagtgacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaatggttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtngctgggactacaggcatgcgcagccactatgcccggccaataagctatatttattcttatttgatgtggatgaaaattatcaaaattggccnggcttggtgctcatgcctgtaatcccagcactttgggaggccgaggcgggcggatcacgaggtcaggagatcgagaccatcctggctaacanggtgaaaccccgtctctacta

SEQ ID NO: 126100 - DNA, 3174 bp, Homo sapiens
  misc_feature (2969)..(2969): n is a, c, g, or t
  misc_feature (3061)..(3061): n is a, c, g, or t
  misc_feature (3153)..(3153): n is a, c, g, or t
cgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaatggttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtngctgggactacaggcatgcgcagccactatgcccggccaataagctatatttattcttatttgatgtggatgaaaattatcaaaattggccnggcttggtgctcatgcctgtaatcccagcactttgggaggccgaggcgggcggatcacgaggtcaggagatcgagaccatcctggctaacanggtgaaaccccgtctctacta

SEQ ID NO: 126101 - DNA, 284 bp, Homo sapiens
agacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatctt

SEQ ID NO: 126102 - DNA, 3001 bp, Homo sapiens
  misc_feature (2796)..(2796): n is a, c, g, or t
  misc_feature (2888)..(2888): n is a, c, g, or t
  misc_feature (2980)..(2980): n is a, c, g, or t
ctctcagaatctctcctgtccagtggtaagagaataagtaaaaaaggcaaatgtctcggaattagtatgaaaatagctttgaccttatagacttcctgatagggtctcaggtaccctctgtggtccttggaccacccattgagtactgctgctatatagtaatgaaaattaagaaactactactatttgtaatattacaaatgaacctcacatgtggtactggacagaagatgctggagaaaaaagtacctcctatatcattccatttattggaaattcagaaatagacaaaaaccactgcatagtgtaagaaggcaggatatcgcctacctttggtggacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaatggttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtngctgggactacaggcatgcgcagccactatgcccggccaataagctatatttattcttatttgatgtggatgaaaattatcaaaattggccnggcttggtgctcatgcctgtaatcccagcactttgggaggccgaggcgggcggatcacgaggtcaggagatcgagaccatcctggctaacanggtgaaaccccgtctctacta

SEQ ID NO: 126103 - DNA, 416 bp, Homo sapiens
tatttctcttatagtacaaaaccaggagttaaaatatatttcttatctttcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgta

SEQ ID NO: 126104 - DNA, 333 bp, Homo sapiens
ctttttagtatactataattcgtatgtcatcaatatcagttaaataaacagatataaatagcctaactgctctctcagagctgcagttattacctaatgctatcccagaatgagttagaatatgcaggtcctctgcttttgtagagtcctgtgatatagccccagaccaggagttagaagatctggctctgccttaactaacaatgggcaggttgcttcagctctctagtcttcagtttcctcccctgtaaaattagagagggctggacataattatctgcaaggtcactttcactttctatgatcattcaagacaagcattaagatgcaagg

SEQ ID NO: 126105 - DNA, 635 bp, Homo sapiens
gaacttgaaaaaaatatgtagtcttttatggcaagtatcaagacattcaggttaatgatatactgagtacttttatagagaatctcatactctccaatcctagaggatctgaaaacaaaacatggcaatatacaacatatttggaggtaaggaggctgcggtggtggtggaatacaatgattaatgcttcggggactttcagtgatgaggtcattgactgctaaggttaatggcaaatgcagtttctgagattctactgctgaggcttcgaatacactaaactatacataaaaagttataatggctctgtcatactatctacaatttatagattcacattttaatacataatcttagacaaatgagataaaatatttccataatacaaagtgtactgagtgttggcgcaattgcaaattctgcaccactgttcagaaaaggtacaaactgtaactcttcagagaaacagacagaaacttttgggcaggttcctgttctaccaagtagtgcaaagtagaaccacagtgctcaatgtagtatttcttctctacttgtgatttgatagaaaacttgaagggaattatgactttagaaaaaaagtgagtgttgaatatagaagcagtaggttatcattg

SEQ ID NO: 126106 - DNA, 656 bp, Homo sapiens
gaaactccagttctggaagtacattttaagccattgcttctatcatgtccactaacattcagtcagccaaagcacataccttgtccatggctaacattgatagtatagataaatatacctgatctctagcaggaggaactgcattgtcttggggaaaggttttagatatagggaggggtgatgagttgggaacaataatgtagtctgccacaaacatattaaagtgtaactggatatggttgctgcagaattttgaacctttgttttaattgtgatttttactctttttcccctatctagtgcccttttgtaatacagtaattctcatgatttttgtctgaattgaaatcttctgagattagattgtctacgaaaatacagtctatcctccttgttttcagcttttgtatttgtgaactcacctactattttttgtaacccccaaatcagtactcacagcctttcatagtcatgtgtttgcgcagagtgtcaaaagaatttgagtttgaacaggatgatattctgccttctttttcagctctcatacaatagtcaggtatcctttttgtggtctatttaatgccatgcttttcctgtttttgtattgtttgttggttgttttgccatttaaattaacccccaagcatagtgctgaa

SEQ ID NO: 126107 - DNA, 449 bp, Homo sapiens
tcagtgttctctctaccataatctcttccatattgtagtagtattattgcctacttgccaggaacatattcctaataccgtgaagaaaaagtattttgtatcactttgttctaccaaggcgtattttatgtggttcactaatgacagcctcatattttgagacttttctcccagtgagtatgccttttctcccctaaatagactttttaaagagcagttttaggttcacagcaaaagtgatcagaaagtatagagttgccatatatcccctggcctccaacctcccccactatcaacatcctgtgccagagtgacgtatttgttatagttgatgaaactgcattgacacataatcatccaaactacatagtttacattagggttcactcttggtgttgtatattctttggtttttgacaaatgtatgtatccaccattatagtagtaat

SEQ ID NO: 126108 - DNA, 170 bp, Homo sapiens
cgacgcctagaggatcccctttagattatagctagagaataatccagagtaatccagagctgcgcattcatacacgaagctagacgtagctagagaataatccagagtaatccagagctgcgcgttcatacacgacgctagacgtagctagagaataatccagagtaatc

SEQ ID NO: 126109 - DNA, 254 bp, Homo sapiens
tgagtagctgagggattacaggcagtaattaattaattaattagcagggggactccaggaccctggaccccactgttttaccagttgccaaatatttggtgtatcttccttgcttgaaagcagtagttctcatgtctgctttccttatggaagagcagtgggggattaacttcaggatgaatatattagtcaccttgcttggaaagttggaggtgttcattttaacataaagtgggatgaatatatagcttgcc

SEQ ID NO: 126110 - DNA, 382 bp, Homo sapiens
ggatgactccaggtttttggtttaagtgtatgaatgatgtttccttgtgttaataaaaggggaaacaggaaagagaacaggttagggttaaaggagagtatgacgaattatggtaagtatgcaaaattgatgcaacattgaggtgacaatgttagaaaggtaattagaagtaagttgggagagtaggtaagtttaggcaagagcgatgtgtaacctaacggggagaaaggctgaggtctaaaaacacagtcttaaacatcagcatttacaaattgggcaaaaggatagcctgcaaaagaaaaatactgagaaggtgagtggtcagagattggagagaaccaggaggagactgatgccatccaatgaagccaagcagagggag

SEQ ID NO: 126111 - DNA, 730 bp, Homo sapiens
gaggctgttgcctgggtgggggtcccactttactaggtgtggcaggtcaccagttccacaggaagcagtggtggctggagaacagccctgaggcgtgagtggagccggcacatctaggagttttcattcagctgatgtttggtgaaagtgggatctgtaggctgggcgcggtggctcacacctgtaatcccagcattttgggaggccaaggcaggcagatcacctgaggtcgggagttcgagaccagcctgaccaacatggagaaaccccatctctactaaaaatacaaaattagccaggtgtggtggtgcatgtccgtaatcccagctactcaggaggctgaggcaagagaattgcttgaacttaggaagtggaggttgcagtgagccgagatcgtgccattgcactccagcctgggcaacaagagcgaaactctgtctaaaaaaaaagaaatgaaagtgggatctgcagatgggaggagaacaacggtgaaaatgaggtgtcctcgggccatgtgatgcctgggggctaatcctaccttcaaggtatcacaggagattctcctcactgcttctgaagtgtgattgaaaggggctgaggtgtggatggatgtcagccctgctttccttcatggccacccagaagcttttggatgctttgggtaggacaaacctccaaggagcttttgggtcacaaagggcccaccttcttgggcactggcgggatctgt

SEQ ID NO: 126112 - DNA, 342 bp, Homo sapiens
tcaaaatagattttagatctaaatgtaagaactaaaaccgtaaaactcttggaagaaaataggaatagatgtttccaattttcagttaggcagtgtttcttatatatgataccaaaaacataagcaacaaaagaaaaaaactgataagtttgacttcataaacatctaaaacttgtgtgcttcaaaggacactattaagagaatgaaaagacaacccacagaatagacatctgaatagacatttcttcacagagtaaatacaaatggctaagaacacaaaaacacatcttgctcaacatcatcagtcagtaagaaaatgaaaaccagaaccacaataagata

SEQ ID NO: 126113 - DNA, 428 bp, Homo sapiens
ggcacgcaaagatgtagaaaaacctggcccataatgaggagagaaattgatcaatcataaccaacccaggtctaacctagatgttagaatgagcagataggctgggcacagtggttcacgtctgtaatcccagcagtttgggaggccaaggtgggcgtatcacgagatcaggagatcgagaccagcctggccaacgtgttgaaaccccgtctctgccaaaaatacaaaaattagctgagcatggtggcgtacccctgtaatcccagctactcaggagactgaggcaagagaattgcttgaatcctggaggcagaggttgcagtgagccgagatcgcaccactacactccaggctgggctactaagcgagactatgtctcaaaaaaaaaaaaaaaaaagaacagataatgacattagagcagttattat

SEQ ID NO: 126114 - DNA, 633 bp, Homo sapiens
ctatcaattaaacagctggatctagctgtgcctgaagcttagactatttctggaccttttagatacatgagcctgtacattcctttttaggtttgcagctgaaatagttgtgactgttatacagatctagtggttggaactgagaacacaagatataagaagatattttctgcttttgtggacttgacaacctaaaagtgagacagacagacatgagtaaatgaataaatgacaaatgcaagaattgatatagaatagattgacagcacagaggcaggagtgggtaactattgaggagggtttaaggaactggaaaaagtcctcaaaaaatataaattctgatttggggttggaagataaatttgcatttactttgtttttctgtaaacaacaaaactgatttttccacagtagcctgtgggagttattttcactattttatagtagttggatgtgttgttacactctaccattggtatgactataccatggcacttttctactagttatgcagaggctgtaggaagtaggtatagcaggttatataatttgggaagtggcattaagtttttttagaaccttattttattcagtgtattttcgaatgagtttccagtatggtattttgcttta

SEQ ID NO: 126115 - DNA, 463 bp, Homo sapiens
cacatcccatgatccctaaggagcattagcccagaggaaacacctgatcaatccctgccaatttacgctaaaagccaccatttaaaaaaaaaaacaaaaaccctcatcaggatgacctcctataccacaaaaccttgccctcagcagaactctctataggtctcaaaggtgacagtatgaagcactgctggaaattcccactctcctagcgtcctatttattgatcacatagctgccttccgggggtagaaccactgggaaatgtgtatgaacagcactcatcaaccatcacgtttttatttggcattagctccatgcccagtgaagtgccaggtacagactgagattcatttaaaaaatagaaagcatggtcctgtaaataatttgcaattaaccagggagatacacttatactggagaattgaagaacagctacaattacgcactgtaagtaggaaagttc

SEQ ID NO: 126116 - DNA, 518 bp, Homo sapiens
tgcttgacacagataaaaggctcattgcatggaatctgactgttgttaggagaatttgagtagatagagagggagcggtgatgcagactgtctggatcaagggcagcctgcacagaggcactcgaggctcctctccaccagcagtgcatccgtccagtgtctcatctgtgtcctagaccaaaccgctggccctcaagtaaatcacctaaacccatatatagcccttccccatgtctttctctcctgcctgaaaggcctcttttctgcattccaaatccttcctctctttaaggcttaggtcaagataaccttcctgcctgaagcttttcttgctagtttctcctgtgtgtattttctcctgcattttaagttatgctctatatcatactccttagacctctgctacattttttattgttagtttttctatgcagtgagttagtcagtatctttcaggcagggacatctttcttttggctgctgctgtgctgttgaacacctcagtacttaatgcttgg

SEQ ID NO: 126117 - DNA, 214 bp, Homo sapiens
tgtggctcctgagctccccaagtatcacagttatcagggtcctaaggacagtgattgcctgcgtcgagctctggcggagggtgtgcttacttgctcccttattttagcctcacctgggcaacaggctcatctcactcccatttaaaattttcctaagtgtggagtctggggctgggagagcaagccccttggccacaattgcgtggctgggggt

SEQ ID NO: 126118 - DNA, 338 bp, Homo sapiens
attggatgccaggaggggacataagcttggtcaaagtgggtctcttcaggtgagggcagttctcaggaagggccccctggcagcagggacagcctggcctctagggcaaggagagcctgggtctcaaagcgggaggggttgggggttatggggaggcccctggaatgcactgcagacccaaccttggtctggtcgctaggccgggccttttgttcgctgcatcctgacacctagcacagtgtcccacacagtgtaggagctcagccaatatttgttgaatgaatgactgaatggagtaacaacaagcttctttaattgattaaaattcataaaactca

SEQ ID NO: 126119 - DNA, 252 bp, Homo sapiens
tggctgagggcataacggcattattgtaagttgctgcggctgaaagcgggtgcatctttctaatcgcacatttcgaggcagagtcctttgtgaggaatgcagtccccatcccataacattgttcctatgggaaaaccagactcagcttcctggaactcagtgtgggggaaagtaggctggcctctctggggtctttttatttctcctgaaggctacgactggagggtagcggggttaaagcagaaagggaaa

SEQ ID NO: 126120 - DNA, 504 bp, Homo sapiens
  misc_feature (29)..(30): n is a, c, g, or t
gtcgtgcggcgggctggggggcgggcggnntggatcacgaagtctcaggagatgagaccataccggctaacaaaaccccatttctactaaaaatacaaaaaattagccaggcgcagtgggaggcgcctgcaatcccaactactggggaggctgacacaggaattgcttgagcctgggaggaggagattgcagtgagccaagatcgcgccactgcgctccagcctgggcgacagaatgagactcagtctcaaaaaaataataacaacaacaacaattacaacattttattttaaaaacagtatttttttaaaaagctgtagtcattgtatatgtatacatgcccacgttttatgtgtatttgcaaatagatatatactttttttttaaagtgtcattatggtcatacaacctaactcctcttttaaactccaaacatatttccatgtaaaaatatttatctaggtcaggcacagtggctcaccactgtaatcccagcacttcagg

SEQ ID NO: 126121 - DNA, 206 bp, Homo sapiens
tgctgtctgtcttgaacactctttccctgacatatcctcacccttcatttctcagctcaaatgttgcatccttacactgcctttccctgaccaccctatccaaagtggtcttccctagttacactctagcatctcactctgtcttttttcccccttactaccaattatcacaatctgaaactacgttgtatgtacatatgtgtgca

SEQ ID NO: 126122 - DNA, 211 bp, Homo sapiens
aaaaaatgaagaatgtcaaaaatgttaacaagaaagtaaattagaagacagtaagtgtatttgtattttctcctcttaattttgttaagagatgactgaacactctgaaaataatgctgtacaggtgggttagtaactaatgtagacaaaatatatatgacaataatagcacaaaggaaggacaagaaaatgaagctgggctagagcagtg

SEQ ID NO: 126123 - DNA, 263 bp, Homo sapiens
aaaccctaatatcttctttttttcaaacaccatatttagtagctgtgtgtcctattgactgaagatctaaaaacttctgtctggaagttttgtatgtgatggtttagattaattatgtttttttactcctaaattttctttgctttcactgaaaatgaatttggtttttcctttttagcaccatcactcctgtagtgggtaagaagagaaaacgtaatacctcatctgataattcagatgtggaagtcatgcctgcacagtca

SEQ ID NO: 126124 - DNA, 223 bp, Homo sapiens
ttgattttgttccattatgtgggtgggaggtcacctctagaacagacatagagagaggggtctccccacccctccaccccctggtgaagagaattcccctggtcataccccgtttgtgatccaggcaaccacatcaagcgctggtgggctgctttttcaacccccagccctgaaacgttcccccgatcattggtcctaacgttgtttcctcttttctcttcta

SEQ ID NO: 126125 - DNA, 309 bp, Homo sapiens
tttatttttaagaattccatatttcagccaatgctgtttatagtagtgcagttaggatggggaatttatgagagaacttactttatgtggtgggtgggatgtaccgttggcatcccaaggatggataacttgagtgatccctgcggtattgtttctactagttacttaaccagtttttttctgagctcttatggtgttgaacacttaaaagacgagatccttgctcttgaggagttctagagatccttactctgggactagacataatgagctcttctaataatagtataacagttgcacatggtacca

SEQ ID NO: 126126 - DNA, 618 bp, Homo sapiens
gggtattacacaagggtatgaataccaagaggcagggattatgctgatcatttggaaggctgctacagtacagataaaccatatgaatccgggcatggtggctcatgccagtaatcccagcacttggggagactcaggtgatccacccgccccagcctcccaaagtgctgggattacatgtgtgagccaccgcgcccagcctcttaactcttttttaaatctgaagtcattaaagctaatatctaaggaatatatttccagcctcttcttttaatgtgcctttgtaaacttagatcaggtctggagcagtcattttgcacattttgccattcctaaaatgaggatgtcagaacttacctcacaagcttgtgaaaatatgaaaaatgcgtatatgtgaagtccataacacatggtatttttccattcatgagacacgtgtatggagaagatggtcagtatttccagtacataaggggtttactaatctatgttggctgggcttgtgttgccatctcccattttgtaatgaatgtcccttatgactttaagctagtagatatggaaaaactgtgaaaaggggcccttttggtctgaattcttcctctaatcattcgcttt

SEQ ID NO: 126127 - DNA, 724 bp, Homo sapiens
gcatcagggatttatttatagcagtcttatattttgcagccagctgtaggacggtcattcgttccatcatggttatgatagccaagacctctactataaaggaatttggaaggtatcagctttggaataatagtgcactatcttgtaagtggggcaataaagaaattggagaagaaaggattgagggagattagaatgacatacattctacctctagatgaaatgtgggcttttattccaagccagatacagcgttctcaagtccagaaatgtgtgtcctgctctaaatctataaagtttatctcgaaatacaatagataataggcatttattttaatcttttcctgaacatcccaagaatagctctatgatgtttctctttcggaaataaacaggatgtctgtgaatttgtctttcagtggagacgctgctaactccctccctgtgtcgtctagcagttgatctcactctgtaattcatacatctttagctcacttgaattttctgtttcctcttccctttttatgtcacagtgagagcctatacatttagttggaataaagtatttgtcagagtggcacacgtgggagtgctttctccatctgccactgacatttaatcactaggctgtggggttgaggagggtggtgttggggcctgaaaaaaacagcagccgaaatccacgttgggacagcatcctcctctgggaaacaccggtagtgtt

SEQ ID NO: 126128 - DNA, 129 bp, Homo sapiens
tacagaaaaagagacagaagggatcagcatgtgcctcacacctgcactggtcactcattcaaggtgcaaggtaggcaggagcaaaggagagagtgacacatgaaaagtatccgggccatatggcagtag

SEQ ID NO: 126129 - DNA, 371 bp, Homo sapiens
ccctggtaacactcacggagttgtgacttgttgctcttggaacactttaattctcatctcgcctcttggctgttaataatacattttctgcatagtctttgttttattttctgtatgaatgttggaatcagcccatctgactctaacaaaaaattagtcctgctttttattttttggtctaactgggcttattgaaactatagattaacttgggaattgccgtctttacactgtagctgatgtgcagatgtccttgcgaactctcctgctcagcaggaaggcactgcatttggtttatccagacctcactgtaggtccttcgttcccatctgtttcccaggtggctgttggctgcactgcatgctatcctg

SEQ ID NO: 126130 - DNA, 432 bp, Homo sapiens
ctctttgttcatttctaccacagaaagtagtcttttctaggttgtatttactggaccaatgtggacaaatgatcatatggctgacccaaaataggcccaaagcacaggctgccttttacagcactatcaagctgatcaactgtgaaggcacccttagcagagacatttgctattgacattttaatttttttatctcatgtaactgctgaagtacagttactagaaactagtgtgatttaaggagagtttcttgctctacaaaagttatttggacaaaagtacataacattgggtacgtggggctgccacaatccaaagatgctattttgttccagaagcatgacttatcactttggtggggtgctatcccggaatagctctgaagctttaaaaactcgctctgaatgcctatttaaaaaaacatcttttatt

SEQ ID NO: 126131 - DNA, 445 bp, Homo sapiens
agaggaagaagtgggggtggtcacacccatgcctgcctcgctgtgggggttgtattgtgtgaggaccagcagtggccttaccctgctctcagggatgggactctcagatggagccaagcctccagagagcctggagactgggggacaggtgggccacataccctgttttcgtcagcacccccctctcaccactaccgccgccacccaccagagagcgtggcctctgtgctgtgtgtgggtttgtgttcttggtttagctttgctttcagtttcaagagtgaactgtcaccctgggaactggtgaggagagccccgactggaggaggggcaggcggaaccttccccatcctctggggctggctcaggccccttttccaggaaatcttctgtgtctgccgcagcccaaacacacctcctctcgccccacgtgccctcagcgctcacg

SEQ ID NO: 126132 - DNA, 302 bp, Homo sapiens
gggattcagcataaggagcctctcagacactgcccagacctgtgcttacccgaggaaggcccctctggcacgcagcccaggggccagggagatggcaagggagatgccccgggcaggagatgggtccgcggctcctagctcccattactgtcacccccactgacagccccgggggagctgggacaagtcccaagtacagaaaattaagtccttgcctgggcttataagtgggtcccaacacaacactgggcagcctctgggaacaagaaagcagggccctgctgagcccaggagggagctcc

SEQ ID NO: 126133 - DNA, 221 bp, Homo sapiens
actgggatagcatgccaaggaggaaggggccaggggtcagacagagtggggatggtcccagtggtggcagagagggcagaagggggcccagcagcccttctaggaagcaagtgtcattgccccacgacttatcctgcattggcctgctagccaaggccagaagggcaccaggacctcatacatggtgtcattggcacagaccatcaccaggaagctgcccc

SEQ ID NO: 126134 - DNA, 264 bp, Homo sapiens
tcattaccagacagaggacagaaatgatgctgtttccagttcttcagttgttgggcttctaattcttacatcactgacctgccgtttcctctgctatgcctcccatgatggagttaaaggggtgaggggagaagcaaaactgacatcttttgagacttccggcactatgtcagacatatatacatatataatatgtatgcatattatatacatatataatgtgtatgcatattgtatacatatataatgtgtgtgttatatgta

SEQ ID NO: 126135 - DNA, 498 bp, Homo sapiens
aggaaaagtagggaagagaagagaagggagggaaatgaaagagaggaaaaggaagggaagaaaggaagtaagaaaagaaaggaaagaggaaggaaggaaggaaggaaaaaaggagagaaagagggagagagaaagaggaagagaaagacaatggagaggtttctaatgggcatggtgccactgtaacagatggtcatgggtgtagacagccaggagaggcctatgagcatcaagggacataagggctaaaggcaaggctgatctggaaccacctaaacatctacctttcctgtatgaattgagagaatatttactaatggattgactggagtctttttttttgttctttaatctaaacaacggctctcttgagattccatacctgagctgagcaggaataaactcttgtacttactaccactgcagagttttatatttggacaattggatagtacttacatgtcccattagctaacaggttacatttatagtcaaata

SEQ ID NO: 126136 - DNA, 441 bp, Homo sapiens
cccgacagtccgatttccaccatccttcacttggaattgctcccatctttgaaggaggctggagggagttaccttcatgctgggctgaggttctggggtggcttgttatgaatgtcttcactcgtcactcccatattacggccaatggccaggtggctcagctccccatgactctcctctgcaccgcagccaggtgtgcctgccaggacaggctgggcggacgggaccttcgcgtctgtgcacactgagggctgtgcttctcgttagccatgaaaggaagctagttcctgtcaggcacattcggagcttcaggtacatgggccacattgacccttgtgttgcctggtacagtgttccagagcctcccagttggaagggcatggactccagcaggggagcagtgaccagcaggtccctggagccttgtgtcctttagtcaga

SEQ ID NO: 126137 - DNA, 161 bp, Homo sapiens
caggaggatcacctgagggaggagtttgaggctgcagtgagcaatgattattccactgcaccatagcctgggtgacagaatgagaccctgtctcttaagtggaaataagtaagtgcgaggagaacacgtgatctttctagttttcagtccctcttgcagtt

SEQ ID NO: 126138 - DNA, 355 bp, Homo sapiens
aagtgttttcttgtgggggcagataaaggaaaagggaggggaacaaatcgtcagatctgggctgtgctcctgcgcctgctgggtggggtttcctgagatgtgcattctgagctatttttttccactctgggcatccgtctctggcagggaggagggcaggctgcctggaccagtcagctgctcctttccatccctccctccagtacacatactctcctcttgctgtaaccccagtagctcaggcctcctctgcagattccggagccttaacccttcaaatacccccaggagagccccagccggggcctcagtaggcagacagcaggattaccacactgagagggctccaggggag

SEQ ID NO: 126139 - DNA, 568 bp, Homo sapiens
ctccttgctcaatgccctgctgagccctctggctctcccttgctccctggacctctatgtgtctctgtacctccttgcctccctttgttcttgcatatctttctgagtcctctggctccccctgatttatcctcagaactccatcttgtttcaggttcctggttcctatgtccagacccctgggcatagcactgcctggggatgagatgttctcattgctgagaaccagctgagaagtgttgggtactttagacctttagaggctggcttcactagcctctggaggtttctcctctgagtagccaatggagatacccctcccttgacccgtggcatcaattggtaaaagccatctaataatacctagggctgttctgagttcagtcaggcagtaaatagtcatgctgcacagttgagaatatccccaagaggagtgagcaaccacatcacatccaacctgagatatatgtataattaggacagtggtaagaatataaaatcgtgaaaatatttttttcacacaaaatttttttggctcctgacccttggacaaatttgaccagttatg

SEQ ID NO: 126140 - DNA, 417 bp, Homo sapiens
agtctctgtcagatggcactgataattaatcctttggaaagatcccaagggctttcaggctctctggctagatgttaacaacaggaacagtgagtagtatatagcaacatgatacttgacagttttaaagcaacactggttttatttaagatcatcgggttaaaccagctaatactcctttggcttaaaacctacttgtagtttttactgtttggtattctcttctcagaattgttctttatatatgtagcagaggctgcacgtgatggctcacctctgtaatcccagcactttgggagggtgatgcaggaggattgcttgagcacaggagtttgagaccagcctaagcaacatagtgagaccctacctttccaaaaaattaaaatattgtctgggggtggtggcacatgcctgtaa

SEQ ID NO: 126141 - DNA, 676 bp, Homo sapiens
gtatagtgaatgtaaaagattaggctgaatgaatactggcttcagcacatacagggtatttttcttaaaagagaggaaaaaagccatatgtgttatgtgtgaaaacatatgtatgtgtaaatagccacctcttaaagtgaacttttaaaaaataattaagccttctggttgtatgtaaccccagttttgtaatattttctagaagtggtcgttgagtttgaatttcttagtccctaggaacaatgttataaaaggatgtttccacaagtaattagaattaaaagtgtatttctgcccatttttaagatatctattagttgccttttttgcattataatataaaatcactgaattatatctgactggaaagtgtttccaatatattctttttagtcaatttattttctttgatatatgttaatattttatattttataagtgagagagaggactataatgatttcattcagcatttttgagatcactcttacaagtataaattctggaattcaatatggattaggagaacaatgtttacctatcttttcatagatcagtgagggaccactaagccaaaaggcagggattatttcactggcttgataaggttataagagtgaggaaatggggagcaatattaaaacagggaaactttgacctaattacaagtttccct

SEQ ID NO: 126142 - DNA, 498 bp, Homo sapiens
ttcaacaggcacgagggcaggtaatctgctgaaattgattaaattcaccataggttagaatcaggaataaataattaaagtcagtttaattgatcagcacacacctgaagcttgaggagaaataaagtagtttcctttcgtggtgacactagtggcagtctttttcagcacacgcactgtttaagcctcttccatgttatatacacatacttgaagactgtagaggaggttatgaaaaccagatagtcaagcagccatttctttctgaacaccttcctttggtaggtggtaagggtggaaaggatgcctggagccttggaaggcagagatggaggataaataacagggcttcccgtaggctgtggatgctcacagcacacccctttaggcatctcactcttttgcctcgatcgtagacaagctagaagatggtgagagggtccgggccctgggcctcaggagcccagctgtgagggcatccgctcttgtgggtgattc

SEQ ID NO: 126143 - DNA, 271 bp, Homo sapiens
tttcaaccaaatttgtccagcaggccaaaactagataaagctctaaacgtttcccagtgtgggaggcatgcggggtgagagagccatgttctggctgtcacatccttgctaggctgctgtgcaacacttttgtagcagcacagccaggtgttgagtctctgtggtttttgttttttgagatggagtcccgctctgtcacccaggctgcattgcaactgcctgacctccgctcactgtaacctccgtctcccaggttcaagcaattcttctg

SEQ ID NO: 126144 - DNA, 353 bp, Homo sapiens
cgtctcgatctcctgacctcgtgatctgccctccttagcttcccaaagtgctgggattacaggtatgagccaccaggctcagccaccatgtttcttcttaatgtattcttccatttttcatttccttgaacataggaatatatttgtaatatcctttttaaagttattgtcttctgattatattttctgtgttatttctgggtctttttctgtttattttctccttgttaccggtcatttctgcatctttgcgtgccttgtactgtttgattggatgccagacagaatgaattttatgttattgggtgctgggatttttgtatttctttaaaaaatatttttgagctttattg

SEQ ID NO: 126145 - DNA, 134 bp, Homo sapiens
ggaaattcggtaccagagaggatctaaatatagttttggaaagaagagtcccagcatcttgatcagtgtctggaacacactaggcattaaatacttataaatgcattttatactttccctgcatagtattacat

SEQ ID NO: 126146 - DNA, 373 bp, Homo sapiens
tcaaatatttctctccctcgcttggatgtaagcctagctagctgagctgggggtgagaaggacagaacgagttggtgtgggcagcctggtctgagttctttttggattgcgtgttgtaaatcttcatcctctgggctcaaatgaccaatattatatttttcagaaatcaataatcatgaaattcatcactgttcatttataggtgaataattacacactgaagaggctaattgctattctataatattttgaaaaactagaaaatggaaaattgctaagaaaatttatccattccctttgcaaaaaaagttgggttttgtcaagaatgtgaaaagtctgaaatttttctctactttcaggctaacaatttatt

SEQ ID NO: 126147 - DNA, 510 bp, Homo sapiens
tacttctccagggtagtggttctcaaactttggcatgcagttggagggcttgttaaaatcttgctgggctccatccccagtttctgatttagtaggtttggggtgggggccctagattttgcatttcttacagtttcccagataatggggatgctgcttatctgggaacaccgctttgagacctgccactcccaaaaaacctttcttgcaactacacactaattataggtgttgctgctcgagaagcttcccattcagacctgaacagagatgattcagtgtttgagccagcccccagataaccagctgcctaccacttagctaattgctgggatcaaggggttgaacagacattttctgtttcagatgcgaacaagggggtgaaaaaattaaaaagatacagggaagcaattgcaatgccactgtgcaagcttcaccagtggacgttccaattaacaatcagagagtacctgctgagcacattttagattaagattaaaaggaaaaatg

SEQ ID NO: 126148 - DNA, 355 bp, Homo sapiens
aattaatattgtaacttagtaacttaaaattttaaaaatatagacatatatttttgactaggcaatatattcacacggtgttaaaaatctactatgtagaaatgaatggatagtgaaaactctcttctgctctgtctccctgtcttcctgctttccttccttggaggtagccagttgtatgcattctgatgcatcctgttaggtaactttttaatgagtaacttggctctctaagcattttgatatcaggaggagtcccctgtatagtcaatatgaacctttcagtcatggaaaaagagacatgtccttttgtaagtaagttgactgtatatacctagctctcatatatgatttg

SEQ ID NO: 126149 - DNA, 318 bp, Homo sapiens
atggaagcttctaggtcttctctattactgaggccatcttctgttacttgtcctcctgaaatcccccacccctagtatattgcaagacccatgggagcaatatggtaagggccatactggttttgctcaccactgttgggtataattctacacggagcctcaggaggacatcgaagttgacccacccgggatgccgaggacactgctgagagaaaattgtgcatattatttctcgttttcattgctgaatttccctagtaatctatttatcaaactttgactcttccttctcctataattggtgattcttttgcacaa

SEQ ID NO: 126150 - DNA, 172 bp, Homo sapiens
ggaatagctggggattcatggagcatcagacagggacagagttggcatttggaagaggaagggtatatggattggcaagaacatatacagcaactgtgggttgtgaagggcagagctgaaactttggtgtagtggaccctgtagagtatctggggacatggggagtagctga

SEQ ID NO: 126151 - DNA, 454 bp, Homo sapiens
actgttacaaaagaatagcacattttgcaaaacacatctgtacttgcaactgaaaacatgtttccaagaaccggctcagaagaactagctgagacacaaaatgagcctgaaactttcttaattatggcatgatgtgctagaggcagaaaaaaaccccatacaacataaataatgagtatggcaaatgtttcattttcaaatgatacagtcttcttattgctaattccttgcataaggatgtttcctgaactctgctaccaaggtaaggagacagtggtatagagaagatatgaggatcgcacctaatttcccttttttggcattctaatgctcccattcacatgtggcagggcatccgttccactggatttagcctagtttggatcaaagcttcctctacttcatttaacagatttgctcagatggaaggtctcagaggagaaacaatgttagt

SEQ ID NO: 126152 - DNA, 409 bp, Homo sapiens
actcacaaaaccctctaaggtaggtactatcattattgctattttgaggttagtaaagttaggattggagaagtcactcacctaaggttaacgctagcatgtggtagagctaaaagctgaacctggctgggtgcggtggctcacacctgtaatcccagtactttgggaggcggaggcaggcggatcacctgaggtcaggagtttgagaccagcctgttcaacgtggcaaaaccccgtgtctactaaaaatacaaaaaaattaaccaggtgtggtggcgggcacctgtaatcccagctactagggaggctgaggcaggaaaatcacttgaacctgggaggcagaggttgtagtgagacaagatcgcgccactgcgctccagcctgggtgacaagagtgaaactccatctc

SEQ ID NO: 126153 - DNA, 436 bp, Homo sapiens
cagtacggactgtgggactcgagagggactctcatttaaagtaaaatcaggctgggtgtggtggctcacatctgcaatcccagcatttgggattacaggcatgagtcaccaagcccagccttctttctttttttttgagacagagcctcaccctgtcacccaggttggagtgcagtggcacgatcttggctcactgcaacctttgcctcctggtcgtaagcaattctcccaccttggcctccccagtagtcgggaccacagacacgtactacagctcagccagaatatttttttaaaaaaataaagcaacattaaagaacatgaacaatctgctagaaattaaaaatgagaggccaaaaacaacagattatctcctagagaactgattaaaaaaaaaaaagaaaaagaagctccattaagagagtcccacatccaa

SEQ ID NO: 126154 - DNA, 502 bp, Homo sapiens
ttaaggctctctgtgttctggtaccgtccagcttaccaactttgattcctactgttacccaatggcttaaatgagtggggtaattaattcttatgaaaaagaagcaggcctgaaaatgccaaaatattttatatgtacttggtattctacctcgcaaaaacaaattatttgtgccaccattcaggtttttttctagaaaagcctgagacacacagccattaccacctctggctaagaaacactagcctgtgctaaaatatactgcattaaaaataggcccggtgtggtggttcacgcctctaatcctagcactttgggaggccaggaagggtggatcacctgaggttaggagttcgagaccagtctagacaatacggtgaaaccctgcctctactaaaaatacaaaaattagttgggcgtggtggcaggtgcctgtaatcctagctactcgggttaggctgaggcaggagaatcacttgaacttgggaggcagaggttgcag

SEQ ID NO: 126155 - DNA, 720 bp, Homo sapiens
tatcttgaacattaatgcctttaagagaaatgcccttaaaaatacctttagcaagcatttccttagcaaacacgctcctagcaacagagagtaagttttgtaagggcatgtgaatacgaaggcagagactggagtgatgccaagaaatgtgaaagatttccaggagccatcagaagcaaggaaaaacgcatggaaaagattccgagtgctcagaaggaagcaaccctaccaccacctgatttggacttctaagctccagaactgtaagagaaatttcttttattttaagccacctcgtttgtggtactttgatatggcagccctaggaaactaatacaattctcttaacaaaaaggcaacaatttccttagcaataataaacttagaaataatgccttctcaacaatgactttgccaacagtggccatagcagccacaccctcagcaaaagcaacttagtgcagatttcttagcaaagcacgccaaaacacactaacaaacatactaagaaaacacaaaacacactaatactaacaaagaaagtgcctttctaaaaactgcctatcaacaatcttatcaacacatttcatagcaaaaatttccttagcacctttgcccctagcaatgttgcctttagcaacagttttcgtggcagcagtgaccatccaaccttgatttagcaaatgcatccttagcaaaaactttcttgcaacaccaccc

SEQ ID NO: 126156 - DNA, 317 bp, Homo sapiens
cagggatctgtagcaaaggaattgagatttttgctcaaactataaacacggaagtaaaaattaaagaaacagaggaagcaatactctccaatatatggtaaacagagctgaatcacctactttaaaatctacatctggtatgaagaatgtaggccatgcacggtggctcacacctgtaattccagcaccttgggaggcagaggtgggtagatgacttgaggtcaggagttcaagaccagcctggccaacatggtgaaaccctgtctccactaaaaataggaatagggtgtagtggcgggcacctgtagtcccagcta

SEQ ID NO: 126157 - DNA, 651 bp, Homo sapiens
catcctataaatgcaaaatatattttgtattaaaaaatctagtttagttcatgaaattaacaaattaaataattatttcaatactattagataaactttaaacatatgtggtctcctagctctccaaagacctcatactaaaataatagttcttcttaatagaaggagcaaggaattattgttcccaaatgtttttacacacctccccgctatgagagaagtgtacttcctggttggctgacatccagcctgggccatgtgacttgctctgccaggagtagcaggaaagcagaaatgatgtctattaagtcttgaaagaggctttaagagctaatacactcttctcccacatcccctcctcaagggtctcactcctaaataaatgttactttttcaacttccatcccagaataaaaaagcatgtggagcagaaatggaacagagtagaggccagctcagtttccatgttataaaaccaaatagacatctttgttgcagtaagcccccatgatctggatgttgtttgctatcacaatataacttactctgtgatgattgctattttaaaaagagtacctaccaaaaatttgtagcgcaaaccatacttactaataaaaaattaaccttactccctttaaaataaaaaacaac

SEQ ID NO: 126158 - DNA, 482 bp, Homo sapiens
ggccctactctgacgagttcctgcgcctagggcttaaaaaaaaaaactgtttattttgaaataaccatagatgtacagaaagttccaaacaaaaggtacaagatcctgtgtgcccctcccctagccttttccagagataatatcttgcacacctgcagtacaccatcaatgctaggaaagccacagcccactgggcctatggggacttcaccagttacacatgcctgtgtgtccacatggttccctctcacctagctgtgtgtggccagcatgatgatacagcacaggaccgtctcctcaccaggctctccgggcaccctctgtagccccctcacctcttcccaccagcccttatccctggcaactgcctatctcttctccatccccatcatattttcatctctcaagtgccacacaaatggaatcatccagtgtgccactttttaagaccggctttctgcactcagccccatgccctctgc

SEQ ID NO: 126159 - DNA, 354 bp, Homo sapiens
tgctcaacatcattattagggaaatgcaaattaaaaccacaatgagataccatttcacaccaactagagtgtctgtaacaaataagacagacaataccaaatgttgttgagaatgtggagaaacagaaaccctcatacatttccagtgggaatgtaaaataggggctttgacagtcagcaactgggcagttctcagaaagttaaacataaaactactatacatgtaacctagcaattccactgttggttacctaccccaaaagaaatgaaaacatatgcccacacaaagaatcggagtgaatgttcagagcagcgttattcacaatagccaaaaactagaagcaacctaaatgt

SEQ ID NO: 126160 - DNA, 402 bp, Homo sapiens
tagtgctggggactcgagggccttggccttggcatggctcttccacccagggcagctggcagccaggctcccaggaggcagaggagatgaggggggaggtgagtccgagcaaaggaaaggaggtcggctgtgcagtcacggttctagaacattccttggatcagcagcatccatatcacctgcagactggctggaaaagcagtctcagaaccaacattataaccagccctgcagtgattcataagtactttaaaaagtggtcaatcatttcagcaaagcagagccacacagtccgggggaccacaggtggcctctgtgtgcttgtctcggttttcctgcccctctccagacatgttgattagacactgccaatgcccagcctcagacctcagtctaatttgg

SEQ ID NO: 126161 - DNA, 513 bp, Homo sapiens
tcagtggtcagcccttgttatcttgaacagaatttaaaatagagataaatgagttaacatgatcagattttgcattctttaacaagccagttgtaaatattaagagtcccgcaatcaggacttagggaccgtaggaaaaatttattatgtaaagtatctttttttttcatattctagccagatttcttttttaaattctgaatattttaggacaattgctgctgcttgtaattatagtttggaaaagatggagtcatagggtctcatatagagctgaagggaaccttggaaatcattttagttaagtgtctggtaatagagtgggggaattgacagccaagtcctctgttaagattgtttactgtatttatatttttccactaaaaacaaacttctgagtagtgcacatatgcatcattgtctaaagttttagttagtattctctgtatgaatagtggctctcaatatttttctattttcatatttcacaaatgtaaaatatatggctttcag

SEQ ID NO: 126162 - DNA, 181 bp, Homo sapiens
gcagtgggagcaggactgtctgagtcctaggaagtgaccgcagtgggagcaggactgtctgagtcctaggaagtgaccacagggggagcaggactatctgagtcctaggaagtgaccgcagtgggagcaggactgtctgagtcctaggaagtgaccgcagtgggagcaggactgtctgagt

SEQ ID NO: 126163 - DNA, 532 bp, Homo sapiens
ataactctctgtggtggaccctagcattatacacatctttcaggcaagaaacttagggtggctaaggaacttgctcgagggtaaagagtctaatagcagagccgtgagttagacgcagccacctgcctccaaagtgctgtctgacctcgtttttcaggacaggaaccctcagactcacctgatagctagttgtgttgaattatgtagcaaacacgtatgcagcgcctaaggtgcctcatgcaaggtatcaggtgctgggtaaccaagagccatgccctgcaaatctaacattctccaagaaacaagatcatagcttattctcttagccagaggccaagaccagctctctatcaaaatggccacaaacatatccatgcaaacatttctagaaagacaacctaggatcatgatgtccaacttcctgatcctacagggtacatagcgagcagacaggagcccgtgaacagctgactcctcacgtgtgtgctgggccctgggctgggagtcaacaaaccacatctgtcactcacct

SEQ ID NO: 126164 - DNA, 425 bp, Homo sapiens
tctcatatttgggtgataatgatatgtggtgaattcaatattcatgatattgtatattgtttttcaacccaatttaagatctgtgtcatttcacaggaagtttaactcagtatgtttacagccacaattgcttccccccacttgcatcacttccctagttttatgccttaagttggtgcacatcagaattgattgaggaagctgctggtggtggtatatgtgtgtagtatgtggtgggggtgtggggtaggaggtgtgtgtgctgtttaaaaacacacttgcttaagcctcacttgaaattctggcttagaaagtctgggatgatcctggggctgggtcttaatttttaaaagactcaaaaggtggctacatctagtaaaggatgaaaatcactgctttaaatatttccaaaacaaactctaaat

SEQ ID NO: 126165 - DNA, 653 bp, Homo sapiens
tggttcactgccccctaacagggaaagctatccatgggtcactgccggatggagcacttcagactgaggtgatgagaagagatttgcaaagggatgtggggtttgggcctttgggtggtgggggaagtggggagatgggaattggactggcagaaaggaatcaggaaggagctccgggtgggcaagtttgaataagagaataagttgagggaggaacttgcaaggggagtgaggagaggtctgggaatgaggcagagtgcaggggccttgaacgctgggaagctgcagtggggctttctgtggcatgcaggggcagtcccagggccagcactgtggagggggtaggcagtgctggggaggcagctgcaggcagagtgcaggaggcctgcagtgctggggtggatggggtgtctgggtggctgcagggaggcttccagagtttcctgcagtcgctagcgcccaggcgtgcagacctgatggaggtggctgtggtaggagggaggagcctgaggggctgagaggtaaggaagtatgagagacacgtgccgctgtcactcgctgcaggctagcacagagtcggtaaagcaggtgcttgtgaataatcggatgataattgatgatgagatggtgaaaaccctagcaatgtccagaac

SEQ ID NO: 126166 - DNA, 880 bp, Homo sapiens
aggctggtcttgaactcctggtttcaagcaatactcccgcctcggtgtggggattgcaggcttgagccactgtgcctggcctggaaccaacctttatgtctatcaatactcccatcagttaactgtctcaggtatcataatatcccttcttatcgggggacctgccccgataatcacgtaggttcttttctattttcctaagcgtcagctggcttgagaaataaaaggacagagtacaaaagagagaaattttaaagctgggcgtccgggggagacatcacacattggtaggatccgtgatgccccacaagccacaaaaaccagcaagtttttattagggattttcaaaaggggagggagtgtgcgaatagttgtgggtgacagacgtcaagtacttaacagggtaatagaatatcacaaagcaagtggaggcagggcgagatcacaggaccacaggacagaggcgaaattaaaattgctaataaagtttcgggcaccattgtcattgataacatcttatcaggagacagggttttgagatcaactagtctgaccaaagtttattaggcgggaatttcctcttcctaataagcctgggagcgctatgggagactggagtttatttcacctctgcaatctcgaccataagagacaggtatgccccgggggggccagttcagagacctacccctaggtgcgcattctctttctcagggactttccatgctgagaaaaggaattcagtaatatttctcccatttgcttttgaaagaagagaaatatggctctgttctgcccggctcaccggcggtcagagtttaaggttatctctcttattccctgaacaattgctgttatcctgttcttttttcagggtgcc

SEQ ID NO: 126167 - DNA, 373 bp, Homo sapiens
caaaaatcagagcacagggccatgtcagatgaaactggcacagttgagggagggcctcaaacgggttacaaacaagatggaacggaggcacctgggtgtgggtgtcctgggaagctgaggcagaggttctctgatccctcagcttagcatcggctctggagaccccatgagggaattcctgtgcactacccaatcccagcaggtgccaacagaccttgggaagcagtggtagcggaagggaaacaagaaaaagaactttgatcttaagcactaaactctcacagatcgactgatttcctttcatacttctcaggacctgggttgcattactctttttaattcctgcacacacatcccagggcagttctggccc

SEQ ID NO: 126168 - DNA, 660 bp, Homo sapiens
ctaggtctatataataattttcagtgtgcattcaccatatgaaatggccccaaaatgtatgaactgaagcaacaatagggctgaagcaacaaaatgagcaataatgggagatttcaacaactaattaatgataaagaattagtgaaagcattttaatgtaattaatactgattcaataaacatttagaataatgtattaaacaattaaagaatatttttcttaagcattgtatattagcaaaactggaccctgtattttaagcatgaggcaagtcacaaaacatcaaataattggtattaaatggataatcagaagcaagtagaggtcagtaataaaggttaattttttttaaatattacatttacatgtttagatcttcacagaggagaaaaagaaatacttaaagcctagttacaagtaatatatatttttaaattgggtattgtagctgaaacagcactttgagggaaatggctttaaatgcttaagggaaaagactaaatgtgcaacttagaaaaacaatagcgaaagcaatgtagaagcaaggaaatacaggaaagggaataaatcaatgaattagaaactgataaagaattatatgttaaagttgttatcatgacaaacagtaaaacgcataattgaacaagatgaaacgggac

SEQ ID NO: 126169 - DNA, 1535 bp, Homo sapiens
gcacagactacacaccaggtgctataattggtactttacatatgttaataaccctgcttcttttttgcagcaccatcttggagtagctggtgtgcttattttacggatgagaaactgaggcttaaaaattgaataaatggctcaagggcacccagcttgtgtatggctaaaacccttgttttttctgtgagttccagttattgcttttaattgttcgatgttattactcagtagaagttgaagttttttgcaatttgttggcatctgcagtatctaacttttataaaagacaggattgctttcctgactgggttcgcccatgtagttttttgtgtaaaggtatgattatgaagcagacctgagtactacttttagttgtgtgattcttgaatcatgctggaacagggagtacccttcatcttgtttttcagactagagacatttaaagtaatgtttctagcctgatttttcaatattagaaaaatataccagaggataaaacacatcagaataaaatgtggctctcccccgacctttagtttctgcctttcctgtggttttgcactttttgctttcatttaaagtgcaaatggcattctccagggtgctttatatgatttagaaagtcaggtagtactgcagggattatgaaaaaaagcagcagaccagtgccctagctcccttcttgacagatttctgctcccctgaggcaactacttgttggaggccaaaagaatgagggtcatgatcaactcagtataccactggaggttatatgagtaagcagcaaactgtttttcataaatgcagaatgttggcaaactgacagactgcgtatgccacccagaaggaatgctgaaggcagtcatgcccaaagcacagtgtttcttgtgattaggtacatctgaagcctgttagtaacaatatgaacctgtgatcaattaagcagctgaccaatccttacctccttctccctgctcttgttacccaataaatatgaagggctgtggaagctcaggggctgcctttgctcactagaagcagggagctcttttcttcttcccctggcccttcctttaaaacagttccttttgtttttttgttatttccatgtttgtcccttccttcagtctcgtaatgacggtctcaagtagtaacagtagtaactgttgtagtgaaggtctcaagtagtaactgtggcaatgtgccacaagtggcgcccgaacagggactatcagtgacaaacagagacctgaagagacctgaagggacctgaggaggcctacagggacacatagagataagtagggataaatagagatagagacagatagggaaagatagggacttgcaccaacttggaggaactaacagggaccgtagagacagacagggacagacagggatagataaagactagcaaatactagcagagactagcaaagactagcagagaccagcagaagctagcagaaacttgcagggacagacagggacagatagagacagggtcctataggaactcgtcagaggtg

SEQ ID NO: 126170 - DNA, 121 bp, Homo sapiens
aacctgaaacccaggcccctgactccacccgcgagaggagacactctccaggccagccaccacccgatggtgacaatcatagaccagtgacctggggctgcaggaggccccagccctacct

SEQ ID NO: 126171 - DNA, 251 bp, Homo sapiens
ctactataatgtcttgcctcttgggggctatttgcttagccccctcataagactgggggtttcccaagctcagggctcctcagctgtgacataaacataaaccaccaccatgaaacttacttaagagggaaaggggaggctgggtacagtggctcatgcctgtaaccccagcactttgggaggattaggcaggtggatcacttgaggtcagaatttcaagaccagcctggccaacatggcaaaaccccatc

SEQ ID NO: 126172 - DNA, 698 bp, Homo sapiens
gctgagattacaggcgtgagccactgggtctggccgtttcgtcagaacaatgaggattagcagggatccaactagaggtagataccagcctcagagtgcatttattttctttacccctggaataagccacagggtggtggggtgttataatgggactagggattccccctaggcagtggtctccaaagtggggagcacacagccctagggaaacacaagatgatcactgggagacagaaagtaatttttagcacatcccttcacattttttaatttatttagagatggcacgtcttgttatgttgcccaggctggtctcaaactcctggcctcaagtgatcctcctactttggcctctcaaagtactgggattataggtgtgagccactgtgcctggccccatattgatttttaatattctttctcatttctacctttgaatgattatatttaacataccaatacagtagtagacataaataattgctaaacaaatgactataacctggagatggatgctcaaaaacttatcaatgggttggacttcccttccgccaactgcatttttaaaaacaaatctattaatccacaccagatactaattcttagtgggcttcctctagttaaacccaataaagtagtactattctccaaggagcctcattccccacctgtatatgtagggattctcctatgag

SEQ ID NO: 126173 - DNA, 421 bp, Homo sapiens
aaggtcaactcaaattatgcttcctgagttttccctgatatttgttgttttgtttttgtaagtttgctccttttccggtttttcatcaaaatttttaaattcaggcaaataatttactaccccacaatataactttgagtaagtcttaacagttacgaatcagaatctttcacagaactgtgacttttaagtaattttattcttataaagtatcctcttaaccataaaactaattttcttaaagtatattaataattacaattttcccaacaggaaattttcctcaaatctatttctctttaagctttatgattttgcgttttcctggtacttattgacaatactgtagtcatttatatatttaaattgctcaaagcaagaaaccagttgatttgacaaaattaactcagtgctggaatga

SEQ ID NO: 126174 - DNA, 194 bp, Homo sapiens
tcggtaacatttgtaactatgtttaactttataggttaataggttcaaggaacacagaccaagagatgtaacccataagtagttgaactgaaacccttctactgttccattgcatcgtctttgacaaaggcaagccagaaataacagtctgtggccccgcctctctgttcagggtcagctggggagccagtggg

SEQ ID NO: 126175 - DNA, 182 bp, Homo sapiens
ggcctttcaggtgggcaaataacatggacaaagatatggcacgaaagcaaatgtggtctctatggggtcagaacttggttagctatagtttggtttgtttgtttgtttgttttgagatggagtcttgctctgttgcccaggctggagtgcagtagcacaatcttggctcactgcaacctctg

SEQ ID NO: 126176 - DNA, 828 bp, Homo sapiens
gatgatatattttacttctgtttgcactaagtcttcaaaatccagcatgtgttttacaattcagtgcatctcatttaggatactagattttctttcttttttttttttgatacaggagcttgctctgtcacctaggatggagtgcagtggtgtaaacaggatgctaagttttctttttttagtagagacagggtgtcaccatgttggccaggctggtctcaaactcctggcctcaagcaatctgccttcctcaacctgtaatcccagcactttgggaggcccaggcaggcagatcacctgaggtcaggaggtggagaacagcctggccaactatagtggaaacccctatctctacataaaaatacaaacaaaaacacaaaacattcaccgggcgaaggggcgggggggacgccggtaggccccgacgaacacccggggaggcgagacgcgagcgagacaaacggcgtggaaccccggggagcgcgagaccttagcaacgggacagaaaccccgaagcaggggccgccccatggtgacactcacaagagccgcgggggggcggcaaacactgtgggtggacccactccgtggggtgcgccaagaagacacgaccaaagccaagtgtccacacaaaccctttgccaaacaaacaatcggggcgagggcgtaatacaaacccgcctgagtacaccaagcaagagcagagcactgaagtgcacagcagagaattaccgaaccaagaaacgactctctacccgcaggtgacaacatagaaagacgcaagggcacgggcacgcagaaaagcccccagaggggggcgggaggaac

SEQ ID NO: 126177 - DNA, 786 bp, Homo sapiens
aattacccaggatattttgtatcctgagtatacgttatatagagattggtggtggtggtgatttttgttgcatttgggagttgctatgaaagttgagggactaattttttttttctttttgcttaggcaaactcctgaaaactacttctcttcctattttcatgcagagaaacttaatttctccttgccttttctccccctgtggagttaaaaatagtatggatgcatttattttgtgtcaatttccattaggatgcctgcagatactaacagattcttcaaagtccaaaaagcaacctcagattttcacattggggtaagtggaaaatagaaggcccttgattcctattaactaacctgattgggtatcaccattgttttcattgctaataattgttttccaatgagaatatgaatatttttattttaatggaagttttatacctacagtaaattcataggcattagttcattcactactaaaatgtatacttctctgaactcagacacacaggccatttaacaggatacatgtgacataataaattaaagtgacatgaaaatgaaagtttcatctatttagaactgcagagaagatttcaggttgtcagattatatgttattactaagtcttggttattgaggttagtgcagtaaattgattgagtgcttcatttaaaatactaattgagcacctgtctgtaaacagcagttaggcaatatgggtgaatactaaaaaggtaactttggtaatattgggaatactaaaaatatatacagagagaa

SEQ ID NO: 126178 - DNA, 332 bp, Homo sapiens
agcagaataatgggtgtgggtacttttcaagattcttggctttgtgaggagacaatggaaatcagagtggaggctcatagtgaagcttagggttggaggcatttgcttgtttttgctttgttttgaagatgggtgagatcaccaatgactcattcttttccaaatcgtggttgtgcattttctttctcttaactgacctcttaactgattagacactgttgaaattctttggtctttggcgatataactttttcctggtcctggtccttatgcttgtgacaaagaaagggctgtttccttaaatagttgaatttcccaggctctgtcccagc

SEQ ID NO: 126179 - DNA, 562 bp, Homo sapiens
aatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactaca

SEQ ID NO: 126180 - DNA, 317 bp, Homo sapiens
ctgccctgcccattttcctaggactaagcaacttcctcacaacctggcaaatgaaagtttaagcccttaagccctgatgcagcaagggctccctctgcttggatatccccatgtcacaccagctgttaactattctgaatatcaccccttgcttctaagagtaattctgtggaccattgattcctgtcttcccaagatgtgtttagtggatgatgtatgaatggccagagttatttactttatcccaaacacagattgtgctcaaattgaaattctaaataatattaaatttaaatatcacaactacatgtatagca

SEQ ID NO: 126181 - DNA, 259 bp, Homo sapiens
taaatcaacttagtctctgtttcttcatattgcatctctccatttttgccattcccaaagtgaatactccttttatgtatcctctcttaagtgtgcgtttgattgtttgcaaaatattcaaaatcgtaacaacttcttctttcttagatattcctaagtatcactcaaatcagtccgcttctctccatttcctttgccaccatgccctgctaattttaaattttttggtagagacagggtcaagccacttagccaagga

SEQ ID NO: 126182 - DNA, 363 bp, Homo sapiens
atctagaggatccgaattctgcacccacagcagaggcaggatacaggaagaggacatatcccaatgcacagaacagcgctgaacctgagacgcacttggtgaatatttatgggggatgcgggagggtggggggcaaagagcaacactgtgaaacaaagagggggtgttacctacttgccatactgccactgctggcccactgcttactactctggtcaataacatggagaaggctgagcacggtggctcacatctgtaatcccagcactttgggaggctgaagtgggagaatcacctgatcccaggagttcaaagagcaacctggacaacatagaaagaccccatctctaaaatttttttttg

SEQ ID NO: 126183 - DNA, 1161 bp, Homo sapiens
gttgaaataattaaagtttttctggtagattcttaaccataaaaacgaagcgaactgcttattctgccccatccacaggtagcagcctcttcatgcttgcccctgcctggaatgcccatgcccggaatgtcacatgtttggctaggagtgcatttaggtcagagcttacaggtcacttcctgcccttgatctgcttttctaaaaaactgtttcccatttttctttttctttcccatttttcatttttctttctttcatgcatgctgctttatttttgctgcacgtatcattagccaacattgtactgtcttctatctggaacataaattccatcagatagggactatgttgtttattgctccatctccagggcctgaatatagtaggaactcaataaatacttgttgagtaaaagtatttgctatatccctgtcccttcagtttaaatgatacataaaaataatgcagaaattgagcttacatagaaagaatgaaacaatattttgttttacaagcataaacaaaggattttaattacattcatttcaaaaaaaaaaaaaaaaaaaaagagagcaggttccaaacccaaaattttatataaatccgcggagtgtataaaatctgtctagaggaactatgagtatttacaagagaaatttttttttaatttgagagacacgagagagaaagagaaactctctctcatattgtggtattggggaggaaactgcgaaaaaggtttctcccacttataaattgtgtcgccggaaggctaaagggggccgaggtgagaaaattcccgggggcgggaccagttgggaagcttcggcctttgttaatctccccactccttgtgtgtcggggccggagggtgggggggggggactcctttggaagcaccaggagttttcgaggaaaccaagcgcgtggggcaacattatagttgggagacccccaatttttttacgaggaaaatttataaacaaactactcgctggcgcgtgggggggggttgaccccgtgttggtcctaatgttccccaaggaagtatgagggcaagaaaggcaattgtagcgcagggagttacaagcggtcagggaaccgggaattggacgatggtcccacgggcgtgcaaaaggaaccctggccaaaaaaataaat

SEQ ID NO: 126184 - DNA, 444 bp, Homo sapiens
caggggacacaattcaacccaggacatgggggcccacctgcagatgcccctgttggtcctgcccgtcctccccaggcccctcaggactctgtatcaacagatctggcccctgctgtgcacagccctccctccctgagtcctccctcagaaaggagaccccccctctgcctccactccccctgcagctgttttctggggcctcctcaccactcactctgcccaccgctgccccgggcccttccctccagccctgcgcctgtgccctgaactgcctcttgtcataggcaccagcttccctcccaggcccaccctcctccctgagggctggcagcctctcctgtggcctggacccgcccaacacagtggctctgcagccccgagcccagatgtccagcaggggccaaagcccttcctcctccctggcaaaggatcccttgcttgttc

SEQ ID NO: 126185 - DNA, 387 bp, Homo sapiens
agacacctgtaatcccagcaactcgagaagctgaggcaggagaatcacttgaacctggaagacagatgttgtagtaagccgagatcacgccactgcactccagcctggggaacagagtgagattctgtctctaaataaataaataaataaacaaacaaacaaactgtatttctatctactaacagtgaacactgaaaaaaggtaactaaggtaggaaatatatctcaaacttcagacactagtgtacttctttcaaatgattttttggcatattaaaggcatcatttacatcatcttatttgttcatttatttaaaggtagcacataaaagctaaataactgtgctttatcataaccactactctctgtgacaccacagatttttta

SEQ ID NO: 126186 - DNA, 615 bp, Homo sapiens
ccagggctggagtggctggagcccaggtagacctgtggcacctggcaggtgccaagggcagttttagtcagcagttggctacaggctcttgccaataggcaatgagaggcctgtctagactggggtttgagggcagccttcactccttactcctagaaggagtaagttctggagagaaggacaagggagagccacagtcttggcagaactgggctgctgggcaaggggtcaagtccatgccttaagccccacaaggagtttcaacctatggggttcaaggcagaagaacaaaataaaacttccgccattaaaattggagaaggaacttgggggtagaactaacagtagagctggcttccttcggcccgtaaatcttcactaattatccctatgacccacttgccagttggagtcctggcctctactcagacccttgacatcactgtcctccggtctgactggtggccacagtggccacccactctgcctgcgcctgccttggtccacactaccaggagtttccttcctgaagaggatccaaggatcccatcacacatctcagcagcctttgcctggacccctccagataggattcagacctgcccctgacctccc

SEQ ID NO: 126187 - DNA, 890 bp, Homo sapiens
gtggcaacctggttggtgacagcacaaatgacccatcaatggaagcagctggcttcactgctcaggtgattaccctgaaccatctcatggccaatatgaagcgccgggtatgcccctgtactgggcattgccacacggtatccagattgcatgctcagtttgctgcagctgaaggggaaaaagattgatccgccggtatctggtaagaaagcgtggagagtatgggccatagaagtttctgtgaatgtcttggtgatgcgtgctcgattgttgatatggttcgctggcaaggcccgatgtgtgttgtgagaacttcttgtagaaatttcccccgttgtggttgtgtcggacagccccgcaggggacgtagtaattagtgagcacatgcactagggtttggccggctcgaggtggtcaatcaacaacgccaggtggacaaagaagggctgctggagcttggctaagggtcctgccataggtctgccatgaataggctcagagaggtagtctgacctattactccctaataccctgtcacccaattcttaagtcacgtggtggaaagaaccggtctcaataactgattgtttccaagttggccctacaaggtctcggcgcgtacaagactggttacttgataaccatggcatcgtaccagaccttcagacggacacgagcgactgtcggtggaccacttggttactaatattgcgtgtggccgcttcacaggtatagtggtgaaaatcgtgcttgctcaggacaccattgggcacaattgcacggacttcggaccatagaccgtactgcaacgcgacctgtcacgaccacactgtgcggtcgacgaaaattatacatcgtgggcccgcccggttactgaacgccaagcgcaa

SEQ ID NO: 126188 - DNA, 172 bp, Homo sapiens
ctgtatccctatgaccatttgctcctacaaatcacaggttattaattgattataactagtaacacacataacagtctacttctaaaggacttttaccaaacattactattaataacttttgctgaaggatgttcattaattcacacagtaactactcataggtcagctctcc

SEQ ID NO: 126189 - DNA, 569 bp, Homo sapiens
tgtgttttcaatttctcagggaagacttttttctttcttttctttttttatttacagctgagacagaaacaaacttcttcatttttcctctgtaggaaaacatattctccccccaccccgtcccccaagatcttcttttactggtagtccagtcctttgaggcatctcgtaattaaggcgtgccacttctaattttatgcaatttttagtactaaggcttcaaaatatttgcatgcttgggcaacataatctgaactcttagtcttaactgactttgatagtcccattttcccactcaagagctattgcagaatcagacttagcattattgctatggcttaatttccccctttattcctatcttctggtattttctttttttttcttaagaggtaaattttaaataagtttgttatattttatctagcactaatttgttttgtatttattcaacaatgtttccagctttcaacttatttttattatttctttttattttgataggtatttgctcaccctaacctacaggtgaggaaatgtgactatcccagtaccatgtgctatgaagt

SEQ ID NO: 126190 - DNA, 683 bp, Homo sapiens
cacggaccgtggctcacacctgtaatcccagccctctgggaagctgaggcagcctactgcggattgcttgcactcaggagttcgagaccagcctgggtaacatggcgaaactcccatctctacaaaaactgcaaaacctaactgggtgtggtggcccacacctgtaatcttagctacctgggaggctgaggtggaaggatctcttgaacctgggagatcgaggctgcagtaagccatgattgcaccactgtactccagcctgggtgacagagcaagatccagtcccctcacccccacaaaaagacccagccaaagatgggaggtctttcttgtgaaaagattttgctgtttgcttcactagttttcctaagaatatagatggatgttaataggacttaaatctcatgatgggtgttggggggactgggagggaagatcttccagactgatgggccatggatcatttgtttggccctcatggtgtttcatacgtgttttgaatcagctgccaacactttaaaataaagcaggcacagacacacacacacacatacataccacctccatttccagtgtgtaaaggcttggaagctctaggaatgctgagacaacattagcacatggctgcagtaggctggagctagggagcacctgtcccttctagacaggcatgtgctccccac

SEQ ID NO: 126191 - DNA, 273 bp, Homo sapiens
tcacttcagttattcctgtctttattttactgtttgattgctagccttggttcccagagcaactgtctaattttttttccttttttttgcacattgcatcttctaacatgtctgccggacctttagccctggttccatgaagatggggatgaggatggtgacactgagaagtctccctggcacacaacagcatgcttagatgagcccaagctcaggtcagtttattattttctttcagacatatagagaaaggagacagattggccattacct

SEQ ID NO: 126192 - DNA, 677 bp, Homo sapiens
ggggtgactatggaaacaaataattagaatggcaattctaatcagctgcttccagcaggtctttaaaataattacattcccatattttgactgccagagaaaagccacatgctgtggattactaatgaagtttaatacttttgaaataagtctattatttgcttcttccctttcttacttccttttttcctttctctttctttctttgggacaaaaagaggctgtagaaaaaaaaacaaatccaaagcagggaaatgagaaaaatctcttctactgcgcatgagattatacctcaaattagagtgtagttaaaatataaaatcccaaatgacatattctaattaatgagtagctgttactatttttaactgttctgtgtcaatgttatttaataaatatgccttttaaagtcccatggctgcaatccctagttttagttgcttagatagaagcgtatcctctctaattgtaatgtttcatggggctttgacaggaactttttcttgacagaaattatgtgggtgatatttcatatttgtctgccataataattatttttggcaattgtaatatgaacatttcattctgacagattagctttgaataaagctttttgttttcttttcttttctctccccaacaatctgaaagagttattgaccaatgttttctggaat

SEQ ID NO: 126193 - DNA, 373 bp, Homo sapiens
caccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcttggctcactgcaacctccgactcctgagttcaagccttctcctgcctcagcttcccgagtagctgggattacaggtacctgccatcacgcccggctaatttttgtatttttagcagagacggggtttcaccatgctggccaggttgg

SEQ ID NO: 126194 - DNA, 561 bp, Homo sapiens
ctaggcaggtcgtgctgaggggtccacatgctaccctaaggaaatgagaagcgacatcatccaattttaaaatgaaggcgagcaagacagggaggggagaagtaacgattccctgaacaagggtagcgatgaaggacgtggaagaaggggacagatctgggataagattttggaggtgggaactgccgggttttcttaaggattggactgggtgtagacatgacggaaatgctgaaggataaatctcaggtttctcaagtgaagccagtgtgggatggcaccactcactagcatagagagggtctagggaggaacaggtgagtggagagaggctacgcctgagccacctgtgagacccccggtagcagctgagctcaggggcctgaagcccacaggaagtgggctgctcactgatcacacacatttgagccccctccaaggacacaggtggtttttcagtcccaagactggatggagaacccctagggagaagggcagctagaactgagcctggagaaactcacattcagaaattgtgttgaggaaggagaagccagtaaa

SEQ ID NO: 126195 - DNA, 389 bp, Homo sapiens
tggcctcgaactcctgacctcaagtgatcctcccacctcgacctctcaaagtgttgggattacaggcatgagccactgcgcatggtctctttcttctttattcgtgaggtgttttctccctttacacttgctggcccatggaaggtgcttagtaagaatggtggctgacttctaatgcttccagagagcctgacaggctgacatgggtgtcttccactgtctgtggggaggcttagaaagaggagtggcttttattaatattatgagtgtggatcagatcctgctggagccaatggcaaagcctggagccggcccagattctgcgagagtgctaggctgcacggtcacagatcaaatgtgcttttcaagaatggcccctctcctgggat

SEQ ID NO: 126196 - DNA, 354 bp, Homo sapiens
cccaacaaaatgcagggagaagaacgcagcatcaattctgtgataatcctgccaaagatccatattctaaatctaatcatgaagaaatagcagacaaacccacattcaggaacactatacaaaatagctggcctgtaatcttcaaaagcatcacagacatatacgcaagtcaaggaaagacatgtgaactgtttcagactgaaagagactaaacaatccaaattccacaaacaagaacaacaaaacaatgtattatctggccccttcctatctccctggcctaatttcttagtacatgttcctttaataactctactctagagttctggtaaagttcctttccaacaacagggt

SEQ ID NO: 126197 - DNA, 276 bp, Homo sapiens
aaagtgggtaaattattttgaatttttaagcatttggcatagttggccaggaagtctcacccccaggaatgtggtttatagaaattcctggagctcacaaaaatgtaggtgcagggaaacctcagggagtcccccaaaatggggctgcagaagaatgttgatgatggtgtttaaggtcacaaaactgtgagtctgtgatcccattttgatagaaaaaaatgcagtgagtcacatgtctacaatatgtgacataggctgagaaaggcaagagaaact

SEQ ID NO: 126198 - DNA, 343 bp, Homo sapiens
gtaaatgtatttatagccaaaagctttcaccagttaggaaatgcagcagatgccaataagtacattcattattttgattatggcaatgtcagactttcagaaaacttcctccatctctatctgtagcacaacctcacatagggagggaccatgtgctggtcaggaaataaacagctttctggcaggagttaaatgaaaatactgtttattactcttataagatgttataattgacggttttattgtaatacaatagcgattatgacatgttgtcccaaaccctaattttgttgttttgtagcaagttacgtttttatcaaggaacacagtggtttaaaaaaaa

SEQ ID NO: 126199 - DNA, 454 bp, Homo sapiens
cacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagtt

SEQ ID NO: 126200 - DNA, 407 bp, Homo sapiens
cgctggtcccctattaggctttggagcagaagctcggggtgtggtcatcaggaactgtggagtttgcagcctgcgtgagacacgtttcgtacacacatctctgccaaattgagaactttgctgctcgtcagctctaagccaagtaaccttttacccaaaacttccaggggtgctttcactttggcctcccagagtgctgggatcacagacatgagcccccactcccagcccagagcattttacaccagatgtcaggacattgctggtaggaacagcagttggagcagaagctcggggtgtggtcatcagggaactgtggagtttgcagcctgcgtgagacacgtttcgtacacacatttctgccaaattgagaactttgctgctcgtcagctctaagccaagtaacc

SEQ ID NO: 126201 - DNA, 316 bp, Homo sapiens
tcccaacagataataaatcactaacctattaattcatttctcaccaactaaacatgcaccccattaagcaaataattattctagaaagaacatttgtgaatatacaatatagaaattaatattattcattattttgaaacatcctttaaggagcttttatacttttttttttttttgagacgaagtcttgctcttgtcaccaggattgtaggcacaaggcagcatttatactttcttaggttatgtttcagaaaacatgcttcccggccgggcgcggtggctcaagcctgtaatcccagcactttgggaggccgag

SEQ ID NO: 126202 - DNA, 667 bp, Homo sapiens
gtgtctagagagggggtgtttctcatagatggcaccttcttgctacaccctcacatggcggcaaagaaagggcactcccttcaactttttgtaaaatggcattaatcccacttatgaaagcagagccctcattacttaatcacttctgtggggataccaactttcagaccatagtgggtgttttccaagatgagagggacttgaccatgtttaaatgtaatgagtaggtgctagtaaggaaaagtgaaaataataggagagagaataattgactgggaaaaatccctaataaggtcttaatttgattatgttttttaaacatgtctgctctttgccaaaggttgttttaagaaacaaactacagaaacgtaaagccatatataattttaactgtagaatagcttttgtactttaaacagtttcaattataaggaagggggcatattactataacttcattcagacagtaaactgttcactgatttctactcagcataaatgaatctcgtacaaaaagtaaaagaatgcttatgcaactatcatgtttaattatacacactactgtataattaaaaatctggtttttttggaaagctttatagtgatttttccctgatgaaactgtttagtgtttgaactgatatatgttgtcttactgaaattacca

SEQ ID NO: 126203 - DNA, 576 bp, Homo sapiens
aatcctcctgcttcagcctcctgagtagctgggactataggcacatgccaccacacccagcagacagagcactttttatgtgccatatcttgtatcaacagatggatcgtaatcacctgatcatttcttctcccgaatcttatcttggttaaaagtgctgcccaagtccagttcgtggcccagtacggtgcatcccactggtaaatttgaactctctcttgtgacagagaaaattctgtttcctcctctttgtactgttattgcctggttctggttctctatttctctattttctgtctctctaacctgcagtcctaatctgctaccatccacactctcctttgttgcaagcaaagcctattgcctgctgtcctgtccctgccctgcatcaaaactctcaatgtctccccagtgtctgcagactttttaatctagagttcaaagtcttcagatgctggttcctgcttatgtaacttcttgcattgctaagaagttagtcttctaacaccttactaagctttagccacatcaggctgcactgtttcctacacacatgatgaaactttgcacctccat

SEQ ID NO: 126204 - DNA, 453 bp, Homo sapiens
tggagacgctgccaggcttgctgcagcggcccgaccccggggcgcttagcgagcgcagctggagcagctgcgaaaattcaagattcagactcggattgctaacgaaaagtacctaaggacccacaaagaagtagagtggctcataagtggtttcttcagagaaatatttttgaaaagaccagacaacatcctagaatttgctgcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttcctgctc

SEQ ID NO: 126205 - DNA, 548 bp, Homo sapiens
tttgggccccaagatgggcctggagcagaaaacccagagaatccctgagccctctgatggctctctgtgcgtcagcaggcggaggagcaaacggtgcgaactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttcctgctctctctgctttatttcactcaagaggaggaagccatccttcaggggagggctgctgtgccccactttgacgtgtgaggcagccggcctgtttctgctttcagggcggccaggggcctcttgctgggtcagtgggctgtcgtgcccaccccctgggaagaacacagctgatcacgggggcacagaaacaagcaagtccatgctt

SEQ ID NO: 126206 - DNA, 406 bp, Homo sapiens
tggagacgctgccaggcttgctgcagcggcccgaccccggggcgcttagcgagcgcagctggagcagctgcgaaaattcaagattcagactcggattgctaacgaaaagtacctaaggacccacaaagaagtagagtggctcataagtggtttcttcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttcctgctc

SEQ ID NO: 126207 - DNA, 608 bp, Homo sapiens
tggagacgctgccaggcttgctgcagcggcccgaccccggggcgcttagcgagcgcagctggagcagctgcgaaaattcaagattcagactcggattgctaacgaaaagtacctaaggacccacaaagaagtagagtggctcataagtggtttcttcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttcctgctctctctgctttatttcactcaagaggaggaagccatccttcaggggagggctgctgtgccccactttgacgtgtgaggcagccggcctgtttctgctttcagggcggccaggggcctcttgctgggtcagtgggctgtcgtgcccaccccctgggaagaacacagctgatcacgggggcacagaaacaagcaagtccatgctt

SEQ ID NO: 126208 - DNA, 797 bp, Homo sapiens
aactggaccaggggctgtggcagcacaccttgagttaccaacacttctttttaatagaatgtgtgttttctgccacaggcctccctactccctaacgtctctctcctcagccacctgtcatatgtgtggcctgcatgcattttggttgacagcccttgccttaggtgtttggagtgctaggaggatagactctgaaaactgtaggcgccatcctttttctcttatatatagggaaattggggcacagaggattaatgatttatccaaaactcactgagattcatgcttctggctctagggccctgctggtggggtatagggatgagggtgaagtcagagggaagggggatctaaggtcagctacttggtgctttctagaagagcagttaggccgaagcatcgaccaggattgtggttttggctatgcttactaaagacataatagggaggctgtgcgtggtgactcacgcctgtaatcccagcactttgggaggctgcggggcgaatcactcgaggtcaggggtttgagaccagcctggccaacatggtgaaaccccgtctctaccaaaaatacaaaaattagctgggcgtggtggctggcgcctgtaatcccagctactcgggaggctgaggcaggagaatggtgtgaacctgggaggcggaggttgcagtgagccgagatcatgccactgcactccagcctgggtgacagagtgagactccatctcaaaaaaaacacaaacacagcaacacaaaaaccttttttggcccctaggcccccaaaaagctttctaaac

SEQ ID NO: 126209 - DNA, 693 bp, Homo sapiens
gggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcgtccctgccctgtatggtatcctctattttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggat

SEQ ID NO: 126210 - DNA, 741 bp, Homo sapiens
ggttgcagtgagccgagatcatgccactgcactccagcctgggtgacaaagtgagactctgtctcaggaaaaaaaaagaaaagtgcacacccccacacctggctaattcttgtatgtttttgtagagatggagtctcattctgttgcccaggctggtctgaaactcctggactccagaaatccgcctgccttggccacgcagagtgctgggattataggcatgagctgccacacccacctgtgtgtgcttttaaaatattgggcctctgatgaggtttgttgaaccaagggtttctcaggtgagggaaaggcttaagaatcttgaatttaatccaattgcatttgcttttgaggaacttgaggtcccttgaagttgagtaacccaccctgggttgccggtggcatttgctcctgcctggctggtgcaggccgtctctgtgtcagtgtcactgttttcttcccacttgctgacaccatggtgccctcctggtgctctcttctctccttagggttactgtgttgaggctgagtatggtttgtgttgcgggcaggggaaagaccaggccttctcctttctgttgtcaagtaatagttccttttaactttcactcattgccctccagctatccaagaaccctttaaacagcaaaaagagctgaaaagggacagaatttgttgcttccttctgatgtgggttcacatctggctgcatgtcagaattgcctgatactcccttcagcc

SEQ ID NO: 126211 - DNA, 185 bp, Homo sapiens
ttctgagtagcatggagcagctggagagctgtgtgccatgcccaagagttggttgaatctgttgaggttgtgggttttggttcgttttatcatgcgttctcaaacaggggcgtttctaatgctttctcccaacattctccatcaagatgtgttccctgaaaactcagatctgccacctttagcac

SEQ ID NO: 126212 - DNA, 595 bp, Homo sapiens
tgctgggattacaggtatgagccaccgtgcccggctggacaccttcactctgcctttgcagtgaagtccttcatttctttaactcttctgtgtgtactctaatgtgtacacatttttaggtctgagcaacctgggatggtaggcattaacttcttttgggttctggggaaaaaggggcgggttttgtttttgttttttgagatggagtttcgctctgtcgccaggctggagtgcagtggcgcgatctcggcacactgcaacctccgcctcctgggttcaagcgattcccctgccttagcctcctgagtagctgggactacaggcgcgtgccaccactcccggctaatattttgtattttttagtaaagacagggtttcaccatgttggtcaggctgctcccgaactcccgacctcaggtgatctgcctgcctcagcctcccaaaattctgggattacaggtgtgagccaccgcacctggcctccatgtttcaatttttaaacaaacaattagttaaaaaaataggaaactaagagaatgaactatttcctgttttattcagtgggttataatctgttactatcattgtttatttt

SEQ ID NO: 126213 - DNA, 3895 bp, Homo sapiens
  misc_feature (117)..(117): n is a, c, g, or t
  misc_feature (134)..(134): n is a, c, g, or t
  misc_feature (623)..(623): n is a, c, g, or t
  misc_feature (899)..(900): n is a, c, g, or t
  misc_feature (995)..(995): n is a, c, g, or t
  misc_feature (2016)..(2016): n is a, c, g, or t
  misc_feature (2325)..(2325): n is a, c, g, or t
tcagcagccttggagaagcatcagctgagaggagctatcacatgggagccgggactgctcagcaaagatggatttatgaggaaactgaaattcagaagattcacagagttagtaatncccagaactgggactanaaactaaattttgtgctccttctactccccagcagctcttgccattctgaggagacaagaaatcaggaaatttacataaggaaccctaaaactgaggcactatcccagagatcagcagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagcnctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccannctgttcactccagtggagccacagtgcctactgccagctttttgtggtggtctttgctgtcctttactttctgttgcccctgctcctcatacttntggtctactgcagcatgttccgagtggcccgcgtggctgccatgccagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggtacaagagacttaangttgggcatgggaagggtggggtttccatgatccattaaatgccttcctactcccattcatcgctctcaaaattagcttcagtgacaaagacttaaatctctctcctatctgcagcactgggttggagagagggcacgggagttggtcttggctgttcattgattgagactgtaggaactgtgttggttggtattggtggtggtattttcaacaaacagggaataactgcaaactggacaggacacccatctgggaccacctgtccatcctacttccctcaattgaatcaggtaacactaacggatcanggcagggccagagggtggtgtggtctctatttgaacaaattcctggctcactgagcatcaaaaggggaaatgggctggtgggagtgggatagtctcccatttaagcagctaataaataatttttatgataaaaggttatactgataacaacattgactcctttagttcaattcagtgcataatagttgaacacccactagtccctgggacccacacagggcgtgtggtcattgcttttaaggagttcatagtctaagttgatgagataccttatattttcacaaagcactttgatttgataaagcactacagaatgtgcttgagaaatatattggagaatatgtccatggctctaacttctgagagttcagcccgtggcagcaagatgcataccttgaagcttcctgcagattgtggaaagcataggggttgtaaatgaaactctctaatgaagaaaaaaaattaaatgaaactgggcaaacagctttccccctttgttctaggaaaatttctaggttgtcttcctaccactagattattataccagtctagtgcctattacattgtggaagttccctaaaaacatagtatatatagggaggagagtcctttgtgattgaaaaacatgttcacctctcctccctattaaaataaatgcatacagaggaatcaatcattcctagacagggaaaaaactcttctttcaaacaccactgatcagctattagatccaaggaattgccagcaggtggcagtgtgagcccaatggaaggaggaaaggcgagtgtacgtggtgggaggaggaaggggagggcattaaacattgcctggcagccattttgttaatttattttgccttttcctttgactttgccctccagcccttccttcacatacatcaaagaagaaagttttaagagcaagggtatctttaattcaggctgaaatttcctgacactgtgatctcactggtgtttattacagagtttgacatacatgggttcatttgccatttatttttccctgtaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtcagttactttttcctgcatcctgctggtgttggggtaactcccaatcctagatgaaaaccttagactttctgttgtcaggtgtccccaggcaatatcctacgggggcatgatagaaaagggtaactctggggtcagatagatgtacttactcactgtgtgaagttgggaaagctgcttaatttctctgagcctacttcctcacctgtaaaaatggggatcattattacctacctcacagggttgttgtgaggattaagagatgggatgtgggagcacctagccgtatctggcaaataggtactcaataaatactggttttacttccatttcctc

SEQ ID NO: 126214 - DNA, 2541 bp, Homo sapiens
  misc_feature (117)..(117): n is a, c, g, or t
  misc_feature (134)..(134): n is a, c, g, or t
  misc_feature (623)..(623): n is a, c, g, or t
  misc_feature (899)..(900): n is a, c, g, or t
  misc_feature (995)..(995): n is a, c, g, or t
tcagcagccttggagaagcatcagctgagaggagctatcacatgggagccgggactgctcagcaaagatggatttatgaggaaactgaaattcagaagattcacagagttagtaatncccagaactgggactanaaactaaattttgtgctccttctactccccagcagctcttgccattctgaggagacaagaaatcaggaaatttacataaggaaccctaaaactgaggcactatcccagagatcagcagggtcgctggactaggatgggggatgggcctgtgacaggaggtaccctgggtgccctctttcggccccatggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagcnctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccannctgttcactccagtggagccacagtgcctactgccagctttttgtggtggtctttgctgtcctttactttctgttgcccctgctcctcatacttntggtctactgcagcatgttccgagtggcccgcgtggctgccatgccagcacgggccgctgcccacgtggatggagacaccccggcaacgctccgaatctctcagcagccgctccacgatggtcaccagctcgggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatgatgggccgctggacactcggagggatatggggctggggccagttatgattgcaaggaccaccttgtgggatcaccttttcccagctggctagggctgaggctggggtctctgcacacagcttttgcttagtgtttcctgggtcaggaacagagccaacaggatgaacgtgtgcaaaagccttggacttggctgtgatctttgactgctaggggagggaacctgggtatggtgagacggtgacgagagaaaagggtcacaaaggactggcctccctgatctctctcctcatggcagcgacccacctccagtcccctggacaatcgggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtcagttactttttcctgcatcctgctggtgttggggtaactcccaatcctagatgaaaaccttagactttctgttgtcaggtgtccccaggcaatatcctacgggggcatgatagaaaagggtaactctggggtcagatagatgtacttactcactgtgtgaagttgggaaagctgcttaatttctctgagcctacttcctcacctgtaaaaatggggatcattattacctacctcacagggttgttgtgaggattaagagatgggatgtgggagcacctagccgtatctggcaaataggtactcaataaatactggttttacttccatttcctc

SEQ ID NO: 126215 - DNA, 422 bp, Homo sapiens
  misc_feature (36)..(36): n is a, c, g, or t
  misc_feature (79)..(79): n is a, c, g, or t
  misc_feature (86)..(86): n is a, c, g, or t
  misc_feature (104)..(104): n is a, c, g, or t
tccacccaccccaggacggtgctcccagagggaccnatgtaacaggagtagctagggtgagagcatgagggtggttggngcggcanagaggagggagaggcagnaggtgctcagggcaggagtgtctggagtgaggagggagaggcaggaggtgctcagggcaggagtgtctcgagtgggtctggacaggaacaggaagggcattccaggcagaggggcccaaagaagcaaaggtcctgaggccaccgtgagggaagaggcccatgtggctggaggacatgaaggagagttgcaggaaacggagtaggcaggcatcgatgaggctggtagggcgagggtaagaattttcggtactctaagttcaatgggaagccattattgggctttaaagcaaggggtgggtggagagcgggggtaccgag

SEQ ID NO: 126216 - DNA, 746 bp, Homo sapiens
ggtaacattagagctcttcctgtagaccaagcactatgctaagtgctttttcatagcatcaccttcagtcctcacatcagataggtactcatttcagaggagagaaaactgacgcttggaaaagctgaataatttgcgtgcaatcacaaagctggtgaatgcaaagcctttatctcagagggtggtgtttcagaacatggcttctgggtcagattgctaggtgggcattccagatctggggcctggcgggctgtaaaatgttcaacagagtactttctcgaagcctcagtttcccacatctgtaaagttggagtaataaattataatatttacctataaaattgtggtgatgattagagaatgtaacatggtaactaccggacacatagtaactactaactatgggtcaactgtaggttggaaccaccatgaattttctattgtagtggaccaaaaaattatcaaatattggcaatttcatatggttcaatctagtattactaaaagacatccattctttgtaaatatcaatgctttccttattcatctcataatttgtgaaaggacaggttatttaattgcttttaacttttccttgttttagtttccctaaagagtgacatagaggctgggtacggcggctcacgcctataatcccagcactttgggaggctgaggcgggcagatcacctgaggtcaggagttcaaaaccagtctggccaacacggtgaaaccccatctctact

SEQ ID NO: 126217 - DNA, 330 bp, Homo sapiens
cgacgctgtgcggcaggcggtctgatacctgatgagctcggtgtggcggggtcggcagcatttcctccggggttttgagctctggccacttctccttttgttccacccaatctcacccacttctgggcttcgaggccagagtgtcttaacaagggggcacgtcagagtcaatgaagggggtgcctgtaccccaccctagagactgtggtcccacagatctgagctgggggaggcacaggcctgccttgacaagctcagactgccacactttcctgagaaggccatttaaaaacagtcatcagctttgttatgttttgagacagcatctcg

SEQ ID NO: 126218 - DNA, 372 bp, Homo sapiens
aacgtgccctgtgcacttcaggtccctccactgcctcttttaggagcgggaaggccttccctcctccttcctcccacttttgctcctaaagaaagtgagcgagaaattgctgtgttggatttaactaaagccatggtgaacatttgtggctattcattctttccttttttcaagatttagatgttaaggaaggcagcctaccagagagatttaaaaaaacaccacagaaaaccaaggaaagaaaaggaagttgcacggtgagggcaatgtatttcccaacgatcctggctgatcagggccccactttctgccccggcttggtgtcagctatggagtccacggttattaaacttacctgagtgtcatccgtgg

SEQ ID NO: 126219 - DNA, 158 bp, Homo sapiens
ggtcgtgagatgagtttagagagataatctctggagatagtgcagaactttgtaggccatcttaagggatttggatttcaagtgaaatgggaaaccattaaaagatttaaacaggggagtggtatgatctgatttacatttttaaaaggtcaatctgg

SEQ ID NO: 126220 - DNA, 293 bp, Homo sapiens
ataaaggcaccagagagaggccagcatttctcccctcagaaagatgcattacctctcacgcatgctaactagggggtgtggtgtaggtgacaaaacggagggctgaaggtgggaagagaacttatcctgaggccccttctcagtttcagagtggggccgctgtgtgtcatgccactgacaggtgtcactgccacacatcagccttttaaatgtgaagggactcttagcacagcaccagaacatgggaccccagccccggttacgtagtccccactgacgacttcagttaccag

SEQ ID NO: 126221 - DNA, 159 bp, Homo sapiens
gataggtcggtcctctccctactgtatcctagggacgaaggggtagtggaggaagaggtgggaagccatcaaggctgaatatatttcagagacccagcaggcaggctcgctagtgaattagaggtggaggatttaaaaagtaggatacagtagggaagg

SEQ ID NO: 126222 - DNA, 570 bp, Homo sapiens
gagggggacaatagtatctgggtgtacttactctgttctcttagtatagcttgctcgacttcaaggccataaacccagagtgtggacttccctttctctttacctctgggaccgaaacctgcaaggaagaaggattgctttttgttctggacctccacagagagccatcagagtctgacaaaaaggacaaaggctttggagccaagtagaccaggaagtctcatcactgtctaattctgtgacttcagtcaagccatgaaaccccttgggaccctactcctttgcataattagataatatataatgcatggagttgtgaagggcaaataaatgagatagtatgcttgaccataaatgttagttgctttcttcctggttcttttgtaatttactgcccaactttgctctggggacctaaaggtctgacctatggtgagaatctgacctgttctacccttttgggaaaagaggattaggagtgtagagaatagctgggagtggccgggcacggtggctcatccctgtaatcccagcactttgggaggctgaggcagggagatcacaaggtcg

SEQ ID NO: 126223 - DNA, 232 bp, Homo sapiens
atgactttctaaaaagatgaagataaaatccaagtatttttgaattcaaaacacactagcttcaaaagtttcagttaagagactggggatggattttacccattccgcctggagtgaggaaaagaacattccaatatttgcaattcactccaagtttctgaagcaaactcgctttgcattgtgggctcagagatgccagcatgaaaaatttctattcttcccccaaagaaca

SEQ ID NO: 126224 - DNA, 193 bp, Homo sapiens
agagggcggaggagagatgatggagagattgttgagggccctgtggcaggggcgggaggggacgtgggcttttcccgggagggaggcaggaaccatggggggctgcaggcaaagccgggactgccccgactccgtgctcacccacgccctctggtgactgcagggagaacagaccgtggacggtgccaggtgg

SEQ ID NO: 126225 - DNA, 460 bp, Homo sapiens
aactctggactgcctctcttggccctcaaatagtcccactctgacacgacttgtccatggagagggcaaaaggagctaaaaagtttgtttgctctcctccttgaactcagggtcctctggacttccttgctcacagttgaggaggcagggaaaggacttccagggtgggggttgaatttcttgtgatcagcttatctcccgacctgcctgtttgtttcaaggaactaagcaacctcaatttagccatccctgaaacatgggtggctgagggataaaggtggacttgggaaaggagccatgattgggtctctatcaccttaagttttacagattcagagactttaaagaggtaaactctatctctgccatgctcaaaaccataccacttaggcttctagtgcctgtgtagcacctgcatcaagaaaggaaagcttccaagaggtatttaggcagtgttcct

SEQ ID NO: 126226 - DNA, 518 bp, Homo sapiens
agagcctctggaaggaactggccttgctggcaccttgcttttggacttctggcctccaaactacatttgcactgttttaagccacccaggaaacgaatccattcgcaaccccttgttttataaatcctcggctcttgtggtttctgaataatcaactttctgcttaagacttgtattgcagatttgccttgaaaaagaaagttttgagggtggggaagttggggaggtagaggatatgaataagcttagagtcagaaagccaaacctcagagattcacgtcagtcccaaagcctccagagaaagaaaataagccaggcctggggctggggatcttgagcctggcactcggcataatcaaatgctcccctgctggcatggttccagagacagctggaattcaaatatgctgatgaataaataaggagggagccaggttttctctggagatttccatctgattttgcattgtgggttggggcaaagaagagggtggcccaggaggaggtggtctgcattg

SEQ ID NO: 126227 - DNA, 167 bp, Homo sapiens
ccaccccagtagtccctctgccccccacagcggtctccgttgtggttcctgcttccccatggctccgccctccaggcccatgtcaacaggctgattttttataagggttcatgtgccaggtataatcttggctcatctgaaggaatgacatctttccttagaaggct

SEQ ID NO: 126228 - DNA, 666 bp, Homo sapiens
aaaggatagttcttcatagctttctctggtgctttaaacaacatgctttcaaaccttgtggcttttgatgtttgcttactctttgcttaatttagcctggttttctagtcctcactggagctgcccctgctggcatggcctggtttggaggggaatggggtgggggcagtggcactgggtatgttgggcatctgggaatggcagaggaagctagaattctctcttccctgtcctctgagtggctcccctggtctctcggaacattaccagtgctgtcaacggcggcatagcactttacagttaaactgcacagccagcttgcctcacgggatcttctcacacacacccacccccaaccatcgcccctcacagcacaggaaccatctcagtgtcctcgtctccccggtacacatacacacgtgcacacacatacaagtggtgcacacttgcaagaaccagcatgcctcaaagagctccctgatgggggttgggggcagctgctgtccatgaagcccagggacatctgttgctcctgcagggccccccttcccccaacaacagggctcagcttaccagatgaaaggccgaatttttccaggcccctctcgaagcccgagccttggaaagtgcccaggaggcgggatggtttggggaggcgggatggtt

SEQ ID NO: 126229 - DNA, 502 bp, Homo sapiens
ttctagaggatcgcctgggcgtgggaagagggcttgggtggtgaaaagggctgggctggggaagagggctgggctggggaagagggctgggttggggaagaaggagacacagagcagaatccccaccagaaaagtaggaagcctaccagagttcacctgcttcttgcaagattatatgaatggatgagtgaatgaatacacaaatgctccagaattctctagagctctgaggtagatggagacacaacactcctttgttcattagagggacatgaattgaagaccaacctagtaggaactgaggattccaaatggacatgacacaattcctgtcatggagcagagcttggtgaagtcagtggggtcagctggtgaatgagcaaagtgctctgtgaatcctgggtggccgtttgcatccagtggagagcatcattcagtggagacagggtgggtttgggaagcaatgtgaccatgtcctcacttcccctcttcccccagccta

SEQ ID NO: 126230 - DNA, 910 bp, Homo sapiens
  misc_feature (910)..(910): n is a, c, g, or t
tgtggggacgtgaccagcagatttcgataccacaggatgcccgtgctccccctaggacaaccttctctcgaaattattcacatctcctttctggaacgttctgctggggaatttctcctccatgccattctgatcctttcctcccgggccctcaataacagctgttcacttagggacttagggccaggacctgcccgaaaatgcctgtgagttcacacaactttgagtccgcacttctgtgctttaaagcattttaaaaacacaactttttttttaatttgagacagggtctcatgctgtcacccaggctggagtacagtgacgcaaacatggctcactgcagcctctacctcccaggatcaagcgatcctcctgtctcaccctcccaaagtgctaagattacaggcaatgagccactgtgcctggcctaaaaatacaatcttttgaaataaaataaaagataataagaaagaataaaataaaaatgaaaacacaatcatcataggtatgtaagatatgatcggccgggcgcggtggctcacacctggaataccagcactttgggaggccgaggcgggcgaatcacgacgtcaggagatcgagaccctcctggctaacacggtgaaaccccgtctctactaaaaatacaaaaatagtgggtgtggggggactgtagttcaggtattggaggcgagagagatgggcgaacgggtgggtgttgagcggattggatggttggtcacggtaggaagtggttcactcagcttgagggggcagggtggcagcccggtttttatttgtggaaggcggttttaggaatgtaaggacagattaaataggaggagggagggagtaatatacaaaatcgggggcgcagtaacatatgcgcttggttagtgtgtactttcgn

SEQ ID NO: 126231 - DNA, 607 bp, Homo sapiens
tacagtggctcacgcctgtaatcccagcactttggggagcagaggtgcacatatcacttgagctcaggagttggagaccagcctgaccaacatggtgaaaccccatctctactaaaaatacaaaaattagccaggcacagtagtacacgcctgtaataccagctactcgggaggctgaggcatgagaatcacttgaacccgggaggtgggagttatagtgagctgagatcatgccactgtactccagcctggatgacagagctagactccatctcaaaaaaaaaaagaaaaagaaagaaatgctgaattcttgtaaatctctaaatgacctttactcccatgcctgagccgttactattcgtctgcccaaaagcctcagttatctctctctgcataaccctacttactccccagccccaaggtcatgtggcatttattcatccttcagttttgagctcaggcaatactgagtgtccaaacaatttcttcaactcctcagccaatagattcttccctctgtgcccccagagcttattgcacatttctttattatagtcctcacgattgtctctattaatattttgagggtatggggatcagcatttta

SEQ ID NO: 126232 - DNA, 879 bp, Homo sapiens
cctcccctctaggtaacccggaaccctgactccggtgaggaggccacgctcacctgtcttgggtcccctaagtcccaggccttgtctgcatgtcagcccagggctggggctgcacccctgcctaggtctcccaggcccagcctctgactgcattccaggcttctcgcccttctaactctcctgcggcctccctgcctcgcgcccaggtctgtttgggtctaggtaaccagggttgggtggcggcctcgggaagccgatgtgctgtgggaagtgtggatgccgcgtagcggtgcctccatgggaagccgtgcctccagctcagggacagatgtcctcagtggggcccactgtccagctggacatctctagagcctccgggacaaatttagactgaaacccattgaacctttggaaacattcatcaaataaactgaattgggagcataggaacagaaataaatgaaggtcattccctgcagagaagaaccaaaaccacagagaatgaagaactaggttttagaataggagcatctaaaaatagtttgtacaggtgcagagaggctgcctttttgctcatgatgacaagaaacatcagaacctcaaaacagggcttagaggagccacctttccccacaaaaaaaggtgtggattgtacctctctttcctttaaagaaccccaggattggttaatggttctgtgggatatgggggcctaagtcctggcccagaatttattgaagtgtttgggggaacctgtaatcaatacgattttattcttaggaacattttcagcaggacacggtggctcagacttgtaatcccagcactttaggaggcggaggtgggtggattgcttgagcccagcagttcaagactagc

SEQ ID NO: 126233 - DNA, 208 bp, Homo sapiens
ttatgtacatcataacattgagtgggtttgcgttatcgtactgttaacatgtgatagtagagaggtcagaacatttaagtaccctaggtaattagtttgtgtaatcccagctactcaggaggctgaggcaggagaactgcttgaacctgggagcggaggttgcagtgagtcgagatcgcgccactggacaagagcgagactccatctc

SEQ ID NO: 126234 - DNA, 473 bp, Homo sapiens
ttagcctcccctgatttcatgtggaatttggaaaacatttcctcagaaacaaatctagcttgaaaaactgcaaagatcactagacttggatactgaaggatgaatgggtttagatttgagatctacaaagatatgagttgtgtgatttgggatgaattattcatggattccttccttaagttgccatttgctgaatacctttttcagctcagctcaggtgtaacctcctttaggaagcctaccttgattctactggctcctccttggcccttagctgctccctccctgtgctcccattataccttgttcatatctctgctaactctcttttcacatggaattaaaaattctataatatttctcaatattcccccactaaactgcaagctcattgagaaaatagcattgatttcctgttctctggggacagtgctcatattttccttgaggaatcacctctccccctctcttgg

SEQ ID NO: 126235 - DNA, 361 bp, Homo sapiens
accagttaacttggttgggaaaatggggacatattgacggaagaaatccttttaaaaccagtcaagcctccagtaagtttcaagaaataggaagaaaaatgtagtgttcattacatgaatatgaaaatcatctatgattatgcctttctgatgtctgttcagaatctcaaggaggggagaagaaagaaaaaaagaagcccccccaccccgccaggtacagccttgccaactatcagaattgcacaggaggccaggcgtgtaatcccagtactttgggaggccgaggtgggtggattgcttgagcttgggtgttcaagaccagcttgggcaacatagcaaaaccctgtctctactatatata

SEQ ID NO: 126236 - DNA, 299 bp, Homo sapiens
tccagaaatctgatctaaatacatgcatttatatgcatgtattacatatggtacttaaaaagccttgttctcataaacaaacagacaacttattttatggaatcttggggtgagccaacccttcacagggcagaggtcacctacaaggggagaggcttatagggttattggggaccagaatgaggaagtggtgactttaggtgtgtgtatcagaactgttttgatgcagcaactggctggcagagaattgtattaccaggaaataataactcactccaggttttcataaaggccagggg

SEQ ID NO: 126237 - DNA, 381 bp, Homo sapiens
aaaagctgggcaggtgatgtggggggcggccagggtggctgccctgaagtcagcaaaagggaggcctgaggtgggcagcacagggccaggtcacgtgtgcctggagggcctgcaacaccgatattttattttaagtccgtgaaaagtcctggaatggcccgaaaagcttcaagcaaggaagtgacaagtttattttatttcctttatgagccacaaattatcctctaccttacacaaaaaattatgctgcatctgaaaaacaaatctaggtctatcccaataatgtcttatttctgtggtagttttgcattaggatatagtgataaccaaaaataatccattgaggaccaggcatggtggctcacacctgtaatcccagca

SEQ ID NO: 126238 - DNA, 206 bp, Homo sapiens
tggaggggagggacagtgaaagcatccctgaagatgatacattaaagctgaggcctaatggatgagaagttgccagcagggtgaactcttggggaagatgtgttctaagggaggatattcatctgcaagggccatgagaccagatgggctttggtgattatagaaaccaaatgaacgtcagcacagcggctcatgcctgtaatccc

SEQ ID NO: 126239 - DNA, 512 bp, Homo sapiens
ctatgtgccacgtagaatctttcagcctgccgcaggtattgctgggagagagcttatcctttagagatgaactttattgttttcaatactatatgtgattagacttactttaaaactaaaataagactaccactgaccctcagaaattgaaagggtaagggcatcttaagaacaactttatactaatccattagacagacgaaactgataaactccttgaaagacacaaattattggctaggcgtgatggtgcatgcgtataatcccaacactctggaaggcctaagtgggcggatcacatgaggtcacgagttcaagactagcctggacaacatggcaaaaccccatctctactaaaaatacaaaaattagccaggcatggtggtgtacgcctgtaatcccagctactcgggaggctgagacacgagaatcacttgagcctgggaggcagagattgcagtgagctgagttggtgccattgcatcctagcctgcgtgacagagcgagactct

SEQ ID NO: 126240 - DNA, 640 bp, Homo sapiens
ggtctatggacatatttgaggatctggtaaaaagctttagcttgtcttctatacatagatgtatacatgtacattatacatgtataattttgcatactgtttcaggggttttatagttttccttaagtttactcatggacttccaattaaaaaactcttgaacaaatccaaatttgttgaagttttatctagaaaagaaatgctcctacttgcaaactcaatttagaaatttcaaagatcaaacaacagaaagtgttgacacaaaggaacatgaactcttcctaccattgagggtaacattaacaattgtttaattagtaaatatcactttagaattaccaacaaagggacttaaaactggctcttagtatgttgatttgtctgtaggggagctgccgtattagaataagttcaggactgacaaagttagtaaacctggccctatcactattaacagctagttgtattatctcagacaactcacctagtcttcagtttcctcctctgtaaagcagggaagttgcactagtctaggaatctctagttccttttaaagctaaaaaaaggatagaaccaataataaaactgagtaaaagcaattgacttggctctccagtgagtaatatggtttttatggtga

SEQ ID NO: 126241 - DNA, 153 bp, Homo sapiens
gaagcaggaaaaattgtgtcctcggatttcaagaagaaaacactgggtagagcagggagtcactccacaccgtggcatcgagcagggagagtcaccccacaccgtggcatcgagcagggagagtcaccccacaccgtggcatcgagcagggag

SEQ ID NO: 126242 - DNA, 266 bp, Homo sapiens
tctgagcaagctgggagtgagggtagagaggggctggattcagaaagaagcatccttgggcactgggatggagaggagagagcggctgagccatgggaagggccagcttgaccacagcggaacgaaccagacatggccacgcagagaggcccagtgtctgttccagagaacacatgtgcccttagatacaagctcacaggcagagagattcacagacatacacagagacattcggatcattcccagcatgctcagacaaacacatg

SEQ ID NO: 126243 - DNA, 292 bp, Homo sapiens
ccactgaagaaaattgtgcccaccctttgctgtgacctatataaaatatctctttctttgggatatcatcccctgattttctgcagaatagctctgcagctaaatatataccaggcaagcatgtattgtgttttgatttattatctttaaacacatgatatctcttcactttttggaaagttagatttctctgtagattatgaaatgctttgcagtcaggccaagatgctactaggtggggatgatcactaattcaaaaaagctggaagaatcctatttgctagtccaaact

SEQ ID NO: 126244 - DNA, 414 bp, Homo sapiens
tcacctaccttcctggggtatgtgtgcaaatgagcaaaagagaaacatgtctcccagcgcacctcagccttctagctctaagcaaactgccatcaagctttgagtcctctggataaacttacaagtgttagagtgggctgggtgaggtggcacatgcatgtaatcctagtactttgggaggccaaggcgggtagatcacctgaggtcaggagttcactaccagcctgattaacatggtgaaaccccatctctgctaaatacaaaaatattagctgggcgtggtggcgcgtgcctgtaatccgagctacttggggggctgacacagaagaatcgcttgtaactgggaggcggaggttgcagtgagccgagatcatgccattgcacattgcactccagcctgggtacacaagagcg

SEQ ID NO: 126245 - DNA, 490 bp, Homo sapiens
  misc_feature (21)..(21): n is a, c, g, or t
cgagctagaggatcccccacnggcaggttgtactgctgaaaatgcctaatctgtagtctaagatctaaaaacagaataagaatctaatgaaatcaggtcctataaagagcacgcaggactaaagtaggtttccaggaatggctgggctcatctgagaggttcaagaacgtaatggctgaggacatctctggaatcgaactgagtctactcagtctgagtcggtgttctgtcctaccagtttctaacgcaggacttagcattttgacctcaatttttgcatctgtacaatgggttgtgggaactaaaggagatacatttaaaatattaatagtagtcatacaagatgaattttagctgcaaaatcaaaatcaaaatgacagtcgtcattattattcccacctaaatagaaaacctacaactggagtcctccacctcttgaaggcaaagggatttgtgttgggctaagcggtactcagtttcccagggtcca

SEQ ID NO: 126246 - DNA, 860 bp, Homo sapiens
atatcgtcgaccgcgccgtcggcatacaccacacccagctaatttttgtatttttagtagagacggtttcaccatgttggccaggatggtctcgagctcctgacctcaggtgatcctcccgccttggcctcccaaagtgccgggattacaggtgtcagccactgcacgtggccaacttaaagtttttgatagataatacattaacgttaaaaattcaaaagataagtataggctctacagtacaaacccttctgcctcctagttcctctccctggaggcaaggtgatcagtttaacaatatttttttattttgagacagggtctcactgttgcccaggctggagtgtagtggcgcgttcacaacttactgtagcctcaacctcctggctcaagcaatcctcccacctcagcctgtcgagtagctggaaccacaggtgcacaccaccatgccaggctaatttttgtattttttgtagagacagggtttcaccatgttgttcaggctggtctcaaagtcctgggctcaagcaatcttcctgtctctgcttcccaaagtgctgggattacagatgtgggccacggtgcccggcctacatatgtattttttccttttcttccccaagtggtaggatatgatacacattgttgattttttgtttagttatgtatctcagagcttattctttatcagctcatgaggaacttcattttttattttttttggaagatgtagtttggctcttatagcccaggtgggagttacagtaaaccacaatcttgggctcgcagcaacttctgcctcccagggttcaaggcagactctcctggcctgcctccgagtagctaggattacaggtgcc

SEQ ID NO: 126247 - DNA, 283 bp, Homo sapiens
tcacattgactaagagagtatcagcttctgttctgattgagcctaaatttatctgctttctctgtcttcagatctcctaaaacttacctacctcctgtgctaatttccttatatgtatgacaattatgtgtttcagagactcctgctatgttactgtcagcagaaaattcttctcatttgcttatgcatgagtacaaagtttcttttaagtgaaacctctatccatagtgtcctagggaagccttggtccttttcaacatcttctaaaaacacaatggccttt

SEQ ID NO: 126248 - DNA, 358 bp, Homo sapiens
cacctctgcctccacttcctccattcacctgcaaagcagaagcttccatggaaccaggggtctcctaaaacgcccaactccaaggaagctgctgcctcctgtgaaaacagcctctccctgttcatctcccttcctactgggaccctgatgctcacagccaggaggatgaggccatctcaagagcctccagaaatctctggccctgtgtcttcttgcctccttcagccccattcctggccacactgtcaagaggactctcagagatctcaccggggcaggtgcggcagcgtacatctataatctcagagcctggggagtcttaagcaggaggactgcttgagcccaggagttggaggct

SEQ ID NO: 126249 - DNA, 149 bp, Homo sapiens
tggtgcctagaggatccctctctaattatcagctcatgggcaatcaaattaggaacgggatagctccgagtgcgagtcgaacaggtatcaaagaccccttttctcagccggggtcaaagctctcagaagttccttaacactccccctgc

SEQ ID NO: 126250 - DNA, 546 bp, Homo sapiens
cgggggaaaccaaggtctatttcccttcatctacctctcccacgccaggaagcagagcaaaatcacacatgtaaccctgcaactagacccccgggctgtgtcttacccatttttcatcctctgtgcctagcacggtgcctggcacagaggaggcactcaaggggcactggactgaacccagtggcttcagaacagctcccaggagaagctggagtgactccattcaaagggcactggaaagatgcctggagtccttttctacccaggcacaagccttttctttattgcccaactctgatgcctgaggtaaagcaatagcatgactgaatgtctttcacattagagtgtaatttatccacatcagccgcagcctttgatctcaccaagctgagagaggagagaagtgatgaggcgtacaatgtgtacgaggtgagtgaggtgtatgtgggctgcagcagctgaagggagggaagggccaggaggctgcgggtgtagatagaacgttcccgttgggacttggaggcccttggccagcacatacaaccc

SEQ ID NO: 126251 - DNA, 328 bp, Homo sapiens
aacattgtgccactgcgctccagtgtgggtgacagagtgacacttcatctcaaaaaaaaaaaaaaaagatttttaaagatgcactttgcctcagaagatttaagctatttttctcagagttttggatatctttgactcttattttccatcttgtcaaacattcctatgatctaataaaactacctgttctgtttctttgttaactttatcattctgatacatgctgtttatctagatctttcctactttcctttcccgaaaatctactctttctgttttccatcagctttaattttcttttcttttctgaagtcttgctctgtcaccc

SEQ ID NO: 126252 - DNA, 168 bp, Homo sapiens
aatagggtattggagtaagtaattcatgacacattctccatgaatcacggtagataagaatgaagacatatttgcttatagaaaaatgtgtctaaaagagaaaaaaagtatgccacaaaatagtagctaattaaatatattaatacaaaaacattctggaaagatata

SEQ ID NO: 126253 - DNA, 725 bp, Homo sapiens
ggagaagaaatttcctctttgtaaaggaaaaaatttatttaattttaaatgacttgtccaaggtcacttggctggaaagtgtctgggaagagactctgcttttctggtgttctgagttggccttaaattattgcaatacttcacatacaaaaataaaaaagaaagataaatttgattatataagaatgtaagtctcctgcacagccataaatattaattaaacaatataagataaataacaaataggggagtaatttaccccactagaaaacagggttaattttcttaatatataacaatttccttgaatagcaataaaatgtataaacaaccaaatacaaaataggcaaagaaggaaacatgcaattagtcaatgaccatgaaaagatgcttaaacttatatagttaaagaaatgccactgacttatcatttttcactaactggcataattaaaaatcttgatgtaatgttggtaagaatatggggaaaaactgttggtgggagtataatttgagacagcttttccggaagggaattggcagtatttattgtaacctattagtaatgtctgcaatatctggtagggtgtgaacattgagttccattagcagaaataaagtattcctggagttacaggataaagcacttatcaaaccacacagagtccaaatcatgcaaatcagaaggcttcctctctaatcaccttattaatcccctctcttag

SEQ ID NO: 126254 - DNA, 687 bp, Homo sapiens
gtctgagtggcatagagtcttcagtgtgctgcaagaaaaacacagtcaactagaaagccattgctagcaaaatcatctttcttccaagaattgataatttttttaaaaaagatattttaaatttggaaacaacaacagcaacaaaaactgccaacccccagaattctgtattcagtgaaagtgttcttgaagagtaaagttgaaaggatgacatctgttaataaaacactaagagaatttgttgccagcacatctgtaccacagaaatgttaagagaagttcttcaggctgataggagggaaaaccagatggaaactcagatcttcaggacagaatgaagagcatcggaaatgggaaataatttgggagaacatttcagaagtaataaggatataagaaaatttgagcggcacaatccataagcttatgaatttgttgttcccagcaattggagaatacacattctttgcagtcacatgcagaatacttggaaaaaattgatgatgtcctagacagaaaagctagtctcaacaaattgcaaaaaattggtatcacatataacacaatttctgatcacagtacacttatgtaaaaaatcagttaaaaggataagtagaaaaccttcatacacctaaaattttaagaacacttctaaattcttgagtcacagaaaaaattataatgaaa

SEQ ID NO: 126255 - DNA, 485 bp, Homo sapiens
gacctttttgtgcggtgaatgagtgacagggtctagtgtctgcattctgcctattccctctaaatgtaatattcagagaagggcagactgccagaaaggcactttgtgtcttctatttgcatgccatagacgctaccatttgtatgcgcatgactattaggtcaaagaatgtttgtgtgaccctttgatttataatctgggtctcagtttttaaaaaatgtgattatatgatatttttatttttttcttccttaaaaatagaactagaaaagtgagagggttggtttaagtttcattagaacatggagttttttaaaaaattaatctcaagtgtgttcaagctttcaatttccttaaatctcataaaaattcagatgtatgtccaattattcctcattacagccaggaagttaatttgctgtcatatattctcagcattagggagattcttgaatgttttcctgtattttttctcactatacttg

SEQ ID NO: 126256 - DNA, 339 bp, Homo sapiens
agaagatgtgctggggagaagaagtttagaattcattttccatcaaattagagggatttggtaactatttcagactttgcatcgaaaacccagggtgtaggccttaggattaggaccacatcacagaactcaaatctagggtctaggactgagggcaacactaagatagacctaccctcgtaaagcctaaaatgaaggcttagcagaatcagggtgatcgctagtaaccaaactctgctaaaacaaaagtttttgtgggaaaaaactgaatccagagtgtctatagtatattattcagaatgtcctgtatataaccacatcagtaggcacgacaggaag

SEQ ID NO: 126257 - DNA, 786 bp, Homo sapiens
ctgctgtattattttgtggtgtgaggggagcaaaaagaaaactggtggggcaggatctgttttctaccttctactttaaatgcttgaattatctgagaagctagggcccagtaattgcttttagcagtttatatggctgttttgctcttgttgcccaggctggagtgcagtggctggatcttggctcactgcaacctcggcctcccaggttcaagcgattctcctggatcagcctcccaagtagctgggactgcaaatgtgccgacatgcctggctaatttttgtttgtacttttagtagagacagggttttactgtgttggccaggccggtatcaaatccctgacctcaagtgatccgcctgccttggcctcccaaagtgctgggattacagttgagagccactttgcccggctgccatttttaattagaataatttgatgtgaacttattagatatattaacaaaaattctcatactccgtagatattttttgctggagtctcatgagggccttaacagcctagcaaacaaagaatggaaactataagtatggcagttgttttgggagatataaatatgatttaagtcatccactctggtttcagatgcatgtgttagcaattgtatataattcaaaacaaaatggaataagaacttctgatgaggttcagagcttgctatctttattgtaattataaacacgaaagttcagaacataaaattccttgacagctttacagatacttgtactctagagagagtattttatatttttctaagaaaa

SEQ ID NO: 126258 - DNA, 479 bp, Homo sapiens
gaacaagtgaggttgaaacttgatctaatgtaccaggaaaccatcccatctgagtgatctagtggcttttcataggctagagctgaacagtttctgatgactgctcaaaagcaagtcaatcagcgagtaatagagttcagaatctttattctctgttttgtatctggactgtgaacaacccttaataaagagtacattcctttctgccagaactgcccaatggaagacaacaagtctatctaggcttcttataaaagccaacagaaacctcccaagggagactcaaacctcagatcattgcattaggagctgaaaattagagtgccattgactgttgttgccatggtaatcactgctgacctggcaggttcttcctcatgatagccttctcaacaggttcacttctgctaaggtgtgaggtgtgtgtctctgtttgtttgcttgtggcaaagttgtcatgttttactctaaatacaaag

SEQ ID NO: 126259 - DNA, 412 bp, Homo sapiens
ggcacagatcagtagaaagactgttttccaaagttcactggcccatcagcccagggatattgatagagtggcttgttggccccttccctgatactgtcagagggcagagcagcctgcagagagctaagccaaaacagatgggatgaacccaggatggggtaagcactatgagtccttctctcatcagcatcaggtacaaaagtaattgttacctagataatcctggagggaaattgaatgcgtatcacatccatggggcttggatccactggctctggtaaaaggctgggctccccattgcttcccaagtctacttcatggtcaactcatttggaaatatatgtttatttacgtggctgtgggtgcatcacaactagcttataggcttttttaggacaggagttgtgtctcc

SEQ ID NO: 126260 - DNA, 421 bp, Homo sapiens
gagaggacagcctgctgagagacggcgggggtgtgcaccagggcatactgagcctggccattgtggtacaaggcctgggcactaccagcctcgtgcctgctgggggtccgggaatatttggggagcactgtgttgagggtgagcctgggtgcccctccagtcacacctgaggaggtgaagaatgtcaggactgggctgtcactcgagtggagtatccatgtcctagagctgccaggtgccacacactgagggcttataggcctgagagttctggaattggggtgtgggcagggctggttcgctctggaagcttcgagggagaatctgccccatgcttccccttcccgcctccatgtgttaccagtcatcctcggcattcctgactcatggcagcctcactccagtctttgcctctgtcgct

SEQ ID NO: 126261 - DNA, 641 bp, Homo sapiens
gaaacggggcgcggccggaaaggcggccgccccctcgcccgtcacgcatccataatccttctaatagctatcctcttcaacaatatactctccggacaatgaaccataaccaatgctaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatctctccctcactagacgtaagccttctcctcactctctcaatcttatccatcatagcagggccagttgagggtgggattaaaccaaacccaggtacgccaaaatcttaagcttacttcttacaataaccacactataggagtgaataatagcaagttctacccgtacaacccttaacataaccattcttactctaactatctatattatcctaactactaccgcattcctactactcaacttaaactccagcaccacaagcctactactatctcgcacctgaaaacaagctaacatgactaacacccttaattccatccaccctcctctccctaggaggcctgcccccggctaaccg

SEQ ID NO: 126262 - DNA, 675 bp, Homo sapiens
ggagcccattaggatgctcagtctcgcatttcctggggatgctttctggaaccatatgctcaaattatcatctgtatgccaaatagttttgaaagaaactgaacttttgtaccttttttggttgttatattagcctgtaagttcacataattgctaaagttaagaatgcatgttgtgtatgataggtgatgggtttccaagtttggagaatgatttagggcaataattttaccctgaacttactgctacatttaaaatatttgggttgaatttttcctttatcttccatttttggaaataaataaaaattataataatcataatataagtaaaaattcagtattaagtgtagggacagtataaaaaattactactgtattgtgaaacttccttattttttccagctctttgtgtcaggaaggatgttcttgagttggattgtgcaaaagttcattctgtctaaaagttgaatttatctgtttttctgcctcatttttgctttttaattaaaacttttgctaaattagaggtgagaaaatttattctaaaatgtttgctgtggtcaccagaactcttttaataaggtatatctgacatagctcctttgctagaggagaaaaacaaaatacagtttctgttgctttcagcaggccatcattggaagttttataaatg

SEQ ID NO: 126263 - DNA, 278 bp, Homo sapiens
aacacaaaaatagataatctgtagtatatatacacaacgaaattctactcaacaatataagggaacaaactaacgacccatgcaacacaaatgaatctcaaaaatattatgctgagtgaaagaagccttacacacaaagcacatcctatatgattccatttatgtgaggttctaaaactggcaaacataacctgtgattaagaaaaaaaaagccgggcgcagtggctcacgcctgtaatcccagcactttgggagtccagggcaggtggatcacaagg

SEQ ID NO: 126264 - DNA, 420 bp, Homo sapiens
ggtcccctggctctgaattaggcaacaacgagcagttccccctggagatgccaatctacacattccagttgccagacctgagcgtgtacagcgaggatttcaggagcttcatcgagcgggacttgatcgagcaggcaacaatggtggctttggagcaggcaggtcgcctgaactggtggtccactgtgtgcacgagctgtaaacggcttcttcctctggccacaacaggggatgggaactgccttttacatgctgcttcactgggtaagctccacagcacagacagagggtggccaggctccaggcctgcgtaaggaaagacatatgctattgaaggaaacactattgaaggaaaagcatacactaaatagagtcacccatgtcactgtcatgagaaagtccctaagagacagagccaac

SEQ ID NO: 126265 - DNA, 779 bp, Homo sapiens
ttaatcttgtcccattgacccacaagggaacctggaactgtagtcctatggtgatccttgagaggggtaagaccagagatatttgccaaacagtattaatgactagcatactttaccagatatcaagaattataaaactaataattaagataatgtggtatctacacagtatggcaaataaatcaatggaacaaaatttgtagttcagaaatagtcatataggaaacttgctacttgccctgtgaatctaaggagaaaatggatttttcaataaatggtgtttagacaattagttctccctatagggaaaagaaaaaaggaaattagtttcctatttcataccgtaccaaaagtaagaatttcagatattaaggactaaaatgtgactcacacctctaacctcagcactctgggaggccaaggtgggaggatcgcttgagcctaagagtttgagactagcctaggcaacaaaatgagatcctgtctctacaacaagtcaaaaattagccaggcatggtgatgcgcacctgtcggcccagctacttgggaggctggagtgcagtggcactatctcagctaactgcaacctctgcctcccaggttcaagtgattctcctgcctctgtctccccagtaggtggtggctaatttttgtatatatttttagtagagatgtgatttcacgatgttggccaagctggtctcgaactcctaacctcaagctatctgccctccttggcctcccaaactctgctgggattccaggcatgagtcaccatg

SEQ ID NO: 126266 - DNA, 257 bp, Homo sapiens
gtaattgaatgccaacaaattggataacctggatgaaatgaacaaattcctagaaacacaaaacctgccatgatagaatcatgaataaatagaaaatctgaatagacctataaccagtaatgaaaatgagtcgataaaagcatttgacaaaattcaacattctttcatgctaaaaaacactgaaactaggaatagaaggaaattctcaacataataaatgctacatgtgaaaacccccagctaccatcatagtcaat

SEQ ID NO: 126267 - DNA, 378 bp, Homo sapiens
ctcaatctcccaggccaagcaatccccccgcctcagcctccagagtaactgggaccacaggtgcatgccaccaaacctggctaatttttcagttttttgtaaagacagggtctcactatggtgtccaggctgttttcgaactcctaggctcaaatgatcctcccaccttggtctcccaaagtgctgggattacaggtgtgagccaccactcctggtctagatttcctgattagtcaaaaatcttataaattttggagtctctggagagactggtaaaaaaccaggccactgtccaatttcctacatctatttccaaagctgcctccgctgtttaggctttgaaacaaaataggagattggtgcccaatggcccaccag

SEQ ID NO: 126268 - DNA, 449 bp, Homo sapiens
ttggaatgaagcaaaatcataaaataaaaaacttagatgttaaattctctcaagaatcttatttgtaaaatggaaataatttctaccacagctatactgctatccaggttgctgaaagaccaaatgaggcactaaaataatgatacttttaaaaagttaagaagtagtagtagtagcagcagcagcagcagcagcagcagcagcaatagtagtagtagcagcggcaaatacctattgagcatttattacattctaagcactgttcttagtatttcacacgtagttacccaggaagtactcacacctatcctgtcatgtagatattattatcatctgttttatagatgaggaaacagaggcacaaactggttaaataattgattaataagtgatagaaccaggtctcagaccagacaatctgtctccagaacttaacctcttaactacca

SEQ ID NO: 126269 - DNA, 723 bp, Homo sapiens
gtaatttattgtacattattttgcctaataaaactgttttgaaaacagagagataccttgcccaaggtcacacacatttttctgcaaatcttgactgcagtccatgtctgtggattcctggtatgtccttctgcttcctgtgttgcttaccaggtgggtaatgaggctcagggttttaacagtaatgatacccatttacaataacatttatttatgtattgctctgtgctgaaaggagaactttgattttacactttgaaggtgttctctatcacttttctaaggctctatctcttaaatttagtgaaaatcaagtagccaacattgattggatagtatttgaggaactgcaggttaatagcacttttatatgaacaaattgagagaatttaaatgatttgaccgaggtcatcaagaacagcagctttggcacaggaattagaaactggattgcccttgcattttgtttttcagcataaaagctacatttctgttctctccattctttatgggcaaattgtaactctttttccccccaaagtacctaaaataatctgtttctcacagtccttcgtgcgtgtcttctttttctcgcttgtgaataaggtgtactaaatgcctcccagcacacacaggactcagtgttatgttctttttttcctctcaattcaccgtgtaagagaggcaccacctattaaaaacaatatccacagacctgaagtc

SEQ ID NO: 126270 - DNA, 355 bp, Homo sapiens
gacataaaaatctagattcctggcttctcttgaaaaaaaacaaaaacaaaaacccagagatctggcaatactggaatcgcatcacgcatgacaagatcagctcgagcagaggaactcagcagccgtgccagcgtcagcttgctacactcctctcccacctgtccatttcagttctgttacctgcctgacccccgagctttcatcccctgtcccataatgtgatgccttcttccaagtgtactaatgggtatatatggttgtttctaggcagcttggctttaggctagttagcttttggagttctgtcagcttcgagctttcctctctctctctcttcttcttttttttttttttg

SEQ ID NO: 126271 - DNA, 858 bp, Homo sapiens
ccccttctgttccagcactcctgtcttggctccaactgtaccagaatggacacttatgcaaatgattgttgtcctcctactcagggctggttatacacgtttcccatatggtgtcccatatggatccatttttctagatagaaggtagctccaaacatagtgtggatctctcccatccagtcaacagcaccttcaccggcagcccatggcaaacacatgtgcaggttaactggatgagagccactttggaggctgctgttaaaacatggggactcgttgaaactttagatgataaaaccagagatcacagggagacagtttgggcctatcgtgaggaccatctctctaccaattttcttcccaaaaatgaaatggggagggctgggtggggtggcttacgcttgtaatcccagcactccaggaggccgaggcaggcagatcatttgaggtcaggagtttgagaccagcctgggcaacatggtgaaaccccatctccacccaaaaatacaaaaattagttgggcatggtggagcatgcctgtaatcccagctactcgggaggctgaggcaggagaatcgcttgcggaggttgcagtgagccaagattgtgccactgcattccagcctaggtaacagagcgagtctccatctcaaaaaaaaaaaaggaaggaggaaggctccaacagagaggctccagaaacacttttaaaagtggcttttggccaggcacggtggctcatgcctgtaatcccagcactttgggaggccgaggtgggaggcctcacaaggtcaggagatcgagaccatcctggctaacatggtgaaaccccgtctctactaaaaacacacacaaaaaatt

SEQ ID NO: 126272 - DNA, 449 bp, Homo sapiens
ggaatggagttgtttagtgggtatagagtttctgtttggattatgaaaaggttctggaactagatagtggcaatggttacacaacactatgaaggtactccatgccactaaattgtacacttaaaaatggttgaggctgggcgtggtggctcatgcttgcaatcccagcactttaggaggtcaaggcaggagtatcccttgaggctagttcaagaccagcttaggcaacaaagggagaccctgtctctattaaaaaaacaattatttagctcaagcagcagttctttacatttgtgcagtctctgaagaaggccaagatgtaatcctttggtcctattctggcctggagggccacacctttcttccactcagcagtcccagagacttaagagctgctgtatcactgctgctgaggcttctttcgaaggtcctcactgaagctgctcagc

SEQ ID NO: 126273 - DNA, 670 bp, Homo sapiens
agggcatttatggtccacagcacagagaagggaaacctgggcggagcccagtggactctctaagttgaagaaataaggttgggagtcgggggagggcgaagcagctaaagttctcagggcaaagtactagagttcacaggtcagagagtagggaggaggaggaggagaaggaggaagacgaggaggaagaggaggaggaggaagaggaatacgagaaggaggaggagaaggaagaggaggaggaggaggaggaaagagatctggagtttagtaaaggacccttcttgtcttcagttgagtcatgatcagcccatgcatgtcaggaaaaggaaaccatcagagatcaaggaaaaaccacttgagaggattagaagaacaatgagggagcttccacagggctgagaatagttcctgttcccaccagccagagtggaaaaccttacaataatccttggacactgggtagagttctagaaggagtactcagcagtcctgccaaagaaagtttaaaagcaagactcaaaaggaccaaactgttttccctaacttaactggatcccagaagagagttcaaaaatattcataggaatataaaaatacccagcatccaataaggtaaaattcacatcgtctgccattcaacaaataatgaccaggaatgaaaaaaagt

SEQ ID NO: 126274 - DNA, 760 bp, Homo sapiens
gctcagtgagtcagtgtgttttcaagtctcttcacatgtgttttctgtcagttctgtcacactgaggctccactgagttgaaacaagcatcctctgccatgtgctcctgactgggaacttgggtctttcagggggaacaggatggtgtttcctttggagtttagggtggggcggcagtgtgtccccttctgtccgcagccactgcgcaggccgcctcgatgctgctccaggttgcataagcacatcctactttgctttgctgctaagcaacttctctcccacgaaggatgccatgaggggagaggttttcaagtgcaactcagaggtgcagaggcggctgagggaaggagtgcagagggagcgggggcggtggtgggggtgctaccaggggctgccaaggacccagggcttgcataatcctcccggcacctctcctgaaagagagcagggtttagacgcctgccagcagcgaggggctgggctcacagccttgagtctggggttcttaagtgggggaaatgctggcagctttgagagggtcctgtctgttcaggctgtgtgcactcccctctcatggagccctctctctaccctggcacacttgattaggggctgtggccgggcaggttatttctcacacttgcctgctgctgttgaacttgtccccacctacccagtaggcagtaagatggtcctgaagcccctccccaggaagccttcccaggtggaattagaggagggggtcagcttcaacatcccc

SEQ ID NO: 126275 - DNA, 559 bp, Homo sapiens
caagtatagaagatttaattcaatctataagtttgaatctataagcctagctattagcattgtagttcagaaatttatcccattataataatctatttcaggatactatgaagctatgcggtctcttgtgctaattttacattattgttgaaaagttgtaactgatggatcacacatttttaatccatggtgccatctggaaggaatttcagtaattttaattatgtgtgtgcataatgcaaaagcataggacactactttttttctaatgttctattaaagacaaaatgctaatctgccttatgtaatgggttcttttatatagcacaataacattatcggtgttttaatgattataaaggcagtactaagtctcatgctcagccatggaaggccgtaggtggacatcttattaatttcctagactaaaggcaggatcactttaagataatcaggataaggagattcagaaatcattacccacctgaccaccccttttacttaatatatgaggaaactgtagctcaaagagataaagtcttttttttaagactgtgaa

SEQ ID NO: 126276 - DNA, 461 bp, Homo sapiens
atcaccatcaccatcaccatcaccatctccatctccatcaccatcaccatctccatcaccatcaccatcaccatctccatcaccatcaccatcaccatctccatctccatcaccatctcccgaactttttcgtcatccctaacaaaacctctgtgcccattaaacatgaactccccattcctccctgttccccagtccctggaaactagcattccactttctgcctttaagaacttgcctattctaggtccacacagcatttttaaacttcctgaagttgctaacatttaacagatctcatgaccgcacataaaatatagattttaggcttttattgaagaattctgacatcaccaggcccaaattcctccaggtggctggaggtgaaatgtgactgtccccttagatgagacacctgctctccaggttgctggtctctgcccagctagtaaattgcacac

SEQ ID NO: 126277 - DNA, 583 bp, Homo sapiens
cagatcagaaatagtatccccaaatggaaaggccccataatagatgaatttttataaagggcctaagtatttgaatattactgtaagacatcattattatagcagagtgacacgatgttccaaagtattcccatagtcatccagaaaagttcagcatgtttatgctgtacagtaacaaaaagaagtgagtgctgtaacttagaaaaattcgttttaaaaaagtcagtgttaaaaaaaaagtgagtcctttctccctattaccttccttcctttgtgtaacaaagattaattttacttctgctgtgtgccagaacagtactgaatgctgtggatacaaagatgaataaaacatgttctttgtcctcaaagagcttgctatgtaattgttcaaatagacataagaaaataattagaatatgatgtagtattttgatggtagtgttcaaaatatttctggagagcatagaagaagagataataatgaaatcttcctgacatggtatgcgggggacctatcaggactagcttcaggttcatggtgaattttccagttaatacttcattttccagtggtgtcaaataa

SEQ ID NO: 126278 - DNA, 398 bp, Homo sapiens
tggatagatggatggatgggtgggtggatggatggatggatggatggatggatggacggacggacggacggacggacggacggacggacagatggatggacaggaagatgggcgactggatggatagatggatggatgaatgcatgttagctagggaaactaaaacaatggtaactgaaaatactcagatgaaaccacagaggccaggcatggtggctcatgactgtaatcccagcacttcagaaggctgaggtgggtggataacctgaggtaaggagttcgaggccagtctgggcaacatggggagaccctttccctactaaaaatacaaaaaaaaattagctgagagtggtggcgtgcagcatttgtagccctagctacgcgggaagctggggtca

SEQ ID NO: 126279 - DNA, 415 bp, Homo sapiens
agataacaataaaaacaccgaaagccaaggtgaccatgtcaatctagaaccatgggttgcacgggacagagaagactgagagagaggatgcatctgagagggctgggacgtgtgcagaagcacaagtttggatgggaagtctccagcaggcatcctactcccccaagacagcatcttttgccagttgctgtttatggattttctccacactccaaatcacatacttatacctccgttcctcagttaccatctttagacaacagctattcactccccaatacctaagatgagcatttagctcactactcccaatgtctgaactttcatgactatttttgactcctgcatgagcatttcctcttctgacagcagtcgctgattcccagctctgtaagatgaggacatcagtgcccct

SEQ ID NO: 126280 - DNA, 586 bp, Homo sapiens
gatatatatatataaaaaataaataagataaagagtagatttcctagatataaattaattagcattataatagcctattgaagaaaattatacattttccttctttgaaggattctgaggtttggatttactttattctcactggaatgggatgaagtgcaaagcctctgtaggcagagttcttgtcccaaccttaaatgtgtgtttggctctttcaacgtggagctattcaaatgcctacagtggtgaagccccaaggttagaaggggaaagaggaagatatggtactgcagctaagaggcagtacctgagatctatttcttctctgaggagctcagctcaggatgcagaaacacccatcaagaaaccacatggacagagagaaagttgacgctaaaggaatcgagaagagtaatatgtgaacttcaggctgcttaggggttcttccaaaatatattttgttatatccctaatagtaatctttttctaaaagataatgcctgttgaatatagaacactgctttaagaatgcagaattatcaatctgaaaataaatgattattcttcaggactacagacaaagata

SEQ ID NO: 126281 - DNA, 444 bp, Homo sapiens
cctgtttatacgttcttctcataagtcacagcccatactaagcattcaaaaaatgtttgctacattaaactctaaaaatacactatctgcttcagataggaaaaatttactttcagtgcagaatttgtcatttcaagaagcaggaactggccagtctcctgcttcttgaaaacagtatttttctccttttatttggattttatttcacttctttcagcaatgttttatagttttcagtgtataggtcttgcacatcccttgtcaaatgtatcccttaattttatgctattataaatggtgttttaaaatttccttttttcattgtttgttgccagtatatagaaatacaactgatttttctatatagactttgtatcctgagcctctcctcccttgctttgaaaattgaatttaaaagagcaggaacctgaaaatttcaagagc

SEQ ID NO: 126282 - DNA, 410 bp, Homo sapiens
gtgtgcttggagctcccttatgcctgtcccctcagggaagagagtccctgggctggaacaggttatggggtgtgagtgggcagcaaagcctggaaatctaattccactcacatgggggtgggaaggcactgctgaaacttcagagagcctcaggggatctgattctgctatctgccccaaacaagcctgcagattcggagttgtggttgagacggatctgtgggtgcagtccctggcccagaaccaacgcacgagaaggctagtttcatgaagatggacccagcaggctcccacatacattgtcctccagacctgcactagaccagcagtgtgcttgctacggagaaaggccactaggtagcctttccccatgactccggtcccctctgctccgaggtcccatctctact

SEQ ID NO: 126283 - DNA, 299 bp, Homo sapiens
tgaaaaaatgtatcttccaaatccaacacatatatacttctaaatatttctcttacagaaaatcttatatataaggcacacatgtgcaaaactattctctgcattttgtaataatgatagaactggaaacagtataaatgtttactagtagggaaatggagaagatttgagaggatttatgtaatggaatactagaatactatataccagtattttattgtgtgaatctatactatggataaatctcaaaaatacagtattgagtaaaatagcaggttagggatttgtaagatgtgaag

SEQ ID NO: 126284 - DNA, 500 bp, Homo sapiens
cttttgcccttcactctctccttccccttttggtcactcagcaacctttatttagaatgaaatgctaaggaattatccatccaaacctcatctaaggttgctcaggtcatcctcctagaactacttgttaccctgactcttagctaaacaccacagtccttcctactgcacgaagtctcagggtcttgccctggcattctgtcctcctcagtttgatcctgaccccctgggctgaatgcctgaatcgcctttgtccatactgccttcctggaatgccctccctttcacttatcagaatcgtagcagacattctgcagattcacacacctagaccccaactgcagacctcagacccagagcccatctgcccctgcaggcaggtgcctcacccagttagcaagcactgccctatatcaaggtcagccttcccaccaaccaagcccagttcaaatcctagtgactaaatgagactcccacacacaccccataatgatagcacc

SEQ ID NO: 126285 - DNA, 213 bp, Homo sapiens
ttggatcaagagaggctatttgtgttgaaagggggtgattctgcagcaccccccttatgctaatgaaatcaatgagatggaaaagttattgatgcagaaaagcaaggacaactgcagaaccaaagtccgtaatacatgagaggggacacaatggaagacacaagcagaggagctggctttatccgcagtctttatcccattttaccaggacag

SEQ ID NO: 126286 - DNA, 396 bp, Homo sapiens
cagaaatacatacatgcatgcttgccttacccctagagtgtcaggattgaggtagcctgtaaattaactttatttcttagaaatatgcagcaatcatatactctacccagagcccacctatagttacctgcgttggacaagaagagaaggatgaacactaggtcattctctcctgcttatcatggagtgctcgtgtctttcattaacacagagaaaaagaaattcatgataggctttccttcatttcatttcaaacaagtataggatttttactatgcttgcaagaaattatatacagtccatttggagaagcagcctgtgttatcaataggtaagttttctagttatccaggtgtccctgctggtagccttttaaatttcacttcgggagcaaat

SEQ ID NO: 126287 - DNA, 298 bp, Homo sapiens
aatggattccaacacccgctctgtatgcggaacaaaagtgctgccagccaccccttcctccaaacgagcccctgggaaagaccagtcatcatttgtgtctccaaatctagacacagcacgaaacatctaggtgtctcccctctgcccacagcctggtaccctgagaaggactgagcctagactcagtcagagctgcggcaggtggcctcccagactccgcaccaggaaacaaatactggacacagcttcgcaagtgggaagccacggcgaagagaaggccaggctaggagggaactcc

SEQ ID NO: 126288 - DNA, 105 bp, Homo sapiens
ttatctcagttcaaagtaacataatcactttcagtttaaaactcagtgtttgagggccaggctcattcagttccagattcttccttttctttctgcagtgatggg

SEQ ID NO: 126289 - DNA, 133 bp, Homo sapiens
aatataaacacaataatcctcaacaaaatactagcaaaccaaattcagacacgtataaaaagaactccacaccatgactgagatctattctagaaataaaaagctggataaatatatgaaaaacaagaaagat

SEQ ID NO: 126290 - DNA, 303 bp, Homo sapiens
cccgacttggcctcccaaagtgctgggattacaggcataagccaccatgcctggctgggattggctttttaaactcagtagaattctgaatgtattaatcgtttattcctttttatttcttagtattctgtggtatgaatttatcacaatttgtttagctattcattaattagaggacatcagaattatttctaatttttggctactatgaataatgctgctataaacattagtgtacaggtttttgtgtgaacacaggtcttcctttcactgggataaatgcccaggagtgcatttcctggg

SEQ ID NO: 126291 - DNA, 133 bp, Homo sapiens
attctcttacagaggacgtgtagtaatatgctgagaaagttgcgacagaggaaagtggatggagagttttggaaaagtgaaaagggctcagaattaattgagcagaatgggaatcgtttccagcaattctcag

SEQ ID NO: 126292 - DNA, 449 bp, Homo sapiens
gttttcttcccttggcttctgagccaagagtctatcctagttcttatcctacctttctggtctttttagtcttgaacctctcaacataggaggctccaggactcagactttggacatctctttatggtctcttttcactctgtggtgagctcaccagtctgatagttttaaataccatctatacattaaatactcccaaacttacacctccaggctagtcatctcccccatctccagatttgtacatccatctgctactcaacatctgcaattgattatgtactaggtatttcaaatttcacatgtttaaaactgatgagctccaaatattcccccaaaaaccagtgccctcctgaactccagatatccctctcaaaaccggttccctctgggaggctgaggtaggtggatcatgaggtcaagagatcgagtccatcctggccaacatg

SEQ ID NO: 126293 - DNA, 259 bp, Homo sapiens
aatttcgaggaatcattggtataggccccagagctaaggagattgcaatttgaaaatactgtttcatgcacttattagactaaatcagcaaacagagagcagcgtgccaggtcctcctggaagttgccagaagtctcatggctgtagcctccctggctgctgcttcagggggtcccctagacccctcaacccagaagaggaaggcaaggatccatctctcctcgttttaagagttcctcttttccccgctttatgtctc

SEQ ID NO: 126294 - DNA, 270 bp, Homo sapiens
ctcacttcccccattcctggagagggggtggggtgggtatttgaaaatgctttcaattaacatccattccacacactctcacccctgcccctccctcagggaaaagatttcttaaatatgctttgggtgaattagaaaactgtgtgtgtatgcctctatgtatgtgtgtgaaacgtggaaatcgatttattatcttcaaaatcagaactcacttggctacagaaggcttggtctcagtgtaggtggcaccagcagccccactcctaaccc

SEQ ID NO: 126295 - DNA, 709 bp, Homo sapiens
ggtctccacaacctcttatgtaacccagacagttctttctattcatagtaactcttgcaaccaattgccaatcagaaaatttttttctacatgatctacatgtaactggaccccccacccttggagttgtcctgcctttctggaccgaaccagtgtatatcttaaatgtatttgattgatgtctcatgtctccctaaaatatataaaaccaagctgtgccctgatcacttgggcacgtatcatcaggacctcctgaggctgtgtgatgggtgcgtccttaacttggcaattttgagacggagtctcgctctgttgcccagactggagtgcaatggcatgatctcggctcactgcaacctctgcctcctgggttcaagcgattctcctgcctcagcctcctgagtagctgggactacaggcatgcaccaccacacctgaccaatttttgtatttttagtagagacggggttttgccatgttggccaggttggtctccaactcctgacctcaagtgatctgcccaccttggcctcccaaagtcctgggattacaggtgtaagttgccatgcctggcctgcaaaataaactttctaaaatgacagagtcctagccagagcaatcagacaagagaaagaaataaagggcatccaaattggtaaagaggaagtcaaactatcactgtttgctgatgatcgtatgcctagaaaac

SEQ ID NO: 126296 - DNA, 335 bp, Homo sapiens
tattataacattggaattttaagaaaaatttgttctacatattaaatttaaattttaactgttaaagtatgttatgaaaaccttaaattattaaacgaaaatgactctaggttcacaagtttgggtaatcctgactatactatgttttaattgagtaaccttggggaaatgattaacccctccaagttcctgtttctttctctttaaacagggaatgatagtgtatgtaatacattatatcgttgcgatgagcaaatgaggtaattcttgtcatgcatgagccaagatcgtaccactgcactccagcatgggtgacagagtgtgactccctctcc

SEQ ID NO: 126297 - DNA, 732 bp, Homo sapiens
agtctaagaaagacagaaaagaggaaaggaagctgcactgtttggatttgatatgaggatgtagacagccaggccctgctaaaagctctcttaatttcgaccttctgaagaccacctcccactcttaaagcctaagccttcatgagcacaatgagacggtcctgctgccctgccacccactctgcctggtctcagggcatcctggcctgcacaccttgtgcctcttgaaaaatcccatgccatttccacttaatcacccaacccaagacccttgtattgcctcacagtgttccctgacagacacagagtgatatattctcttctgtcctggttcctgctgagaagcgaggagcatttatcctcatttggaagaatcaggactgttctaactgcatagtacctactgttgtgttttctgggcaagacaccatgccgctgtggcctcctatccacctccttcctccctggggactctcaggttgcaagtatatctggttccacaatatcaatcacatcagaacacccttgctatctagagtcacgtgatgcaccagcttcagtccaatctagaaatgacagggggaaaatcacatcaaaaggcaaagcctacaaaagtattctgtcttttcaagcccaaaagccatccaaaaccaagttcgaataagtgtagcaatggcttattgatttatctttaaaaattgcgtttcttctcctcccttgtcttcatccctg

SEQ ID NO: 126298 - DNA, 391 bp, Homo sapiens
ttggagatgttaatgtaccaccctcagtttaagacagatcaagtgaacagagaataggaagatagaagacttaaacagcgtgatcgtagtaaggtagatcatatgtatgttttctgaactctataccttgatgatagagactatacctcctgcccaggggcccctggaacattcacaaaaattgatcaggtattaggtcacaaacaaacatgtaagtagttccataaagtagaagtattacattatctgatcacactgcaagaaaactagaaattaccaacaaaattaaaatatcaaaggcccttttactggaaatttaagaacctattaaactacagtcatgtgccgtgtaatgacatcgcaatcagtgatacaccgcatatatgacagt

SEQ ID NO: 126299 - DNA, 607 bp, Homo sapiens
ggattaatatgagcgtgttatttgtacttagtggggacccaggcctaaactaagggaaaatgaaaacaattctgacagccatttccttgctttctttctccacccaagaggtaccagtggttaacagtatggtggcaacaagtgggtcagaggtcagcccctcagtaagctctggtttccatggagatgaggcctattcatccagcacacagagcctcttcacagccacttacacacaattgagctattactgggagcccaggagagccctgtctggagcacagtgcgctagacagggcagggtttaatggagctgattaaatggtagttggggaattatccagagcaggatttgagaacacccttcagaaacaagttaaatccccaaacctcggcccatccccagcaaccctctcctgcagagcctctgcaatccaagccaccctttcaccttcaatgatgccaacatctgcacactcaagctgacctcacctttcttcccatgtgtccatgagacgacaaagccctattctgagtttcctggacctcaccacctttagcgtcttcatcttttgcttagcatcatggtgattttgtgatttagaaa

SEQ ID NO: 126300 - DNA, 557 bp, Homo sapiens
gaacggcaagtatacctttatgactctagtggagcagtgggatataatgagacataccagtggacaggtaaggacgaagtggaagagttagaccaatgccagtggccttgggaattgacatgctgagtggttcttccattgaggaggttcatctagtgacagagtatatgatttatgtgttgaggtcctggaataaagcagtaggagtggcttaggaaagaccatatgaaccctggagctacttcagtggaaggaatgatagattgagtgtatgattcactactcaggagctgtcagggggacaccaagagttttctattttctagtctaaacaagtgtcacaatatggtcttatgaggcctatcagaacagtatgtttctttaacaacttattttcagtgggcctgcctaagcagtatgtaacattgaacttgacccattttcatccattggcacatcttcctgagtttcactctttttcaccctattagacatatgtcatctcttctgaatactcctcattctctgagatccttttgcttcctgaacctcattaa

SEQ ID NO: 126301 - DNA, 728 bp, Homo sapiens
gtagggaagcctctgactgtgtttctcctctgttctcatcacggcagtcatcctcacggaagaaggcttctgtgacaaaggtgtggggggttttccccatacagcaagcagtggacaccgactgggtgtcctctgattcagttccgataccatctacttggagatagtgctggatcccaaaggttgggggttcagtcccccagacggactccccccacaacagcagtcgaaagtatgggcctctagaacttatgaccaactggcttccagttgggattcccataacttcctctttgggttcaattattaataatttgctggagtggttcacagaactcagaaaaacacatttaccagtttattataaaggatgttgcaaaggatacagatgaagagacgggttgggtgaggtatggggaaagggtcatggagtgtccacaccctccctggggaccaccctccaggagcctccacaagtgtagctgtgcagaagctctctgaacccagtactcctgggtttttatggaggcttcatgacatcgccattccttcccccaggatatacagtgggactgtgtctggggagggtcttaagacccacagtcagaaaggtagacgcttgtaatcctagcactttaggaggctgaggcaggagacttgcttgaggcctggagttcagtatcagcatgggcaacatggcaagacctcatctctataaaaaaagaaaa

SEQ ID NO: 126302 - DNA, 474 bp, Homo sapiens
ctaccacacaattctaggcattcactggcattccatatgttatctggttgacagaaatctgacatctaggcttccaaaaacagcttactggggtcaaactgacatcaacagcttctcccaaacaacttccttcgtggacaatttttcaggacttttagcctcaatttaaatctcaattctctaaaaattcccataagactattagatgatcaattcttagacataataccaaacagggccaggtacagtagctcaggcctgtaatcccagcactttgtgaggctgagacaagcggatcacataaggtcaggagttcaagaccagcctggccaatatggtgaaacctcgtctctactaaaaatagaagaattagctgggcgtggtggcaggcacctgtaatcccagctattcaggaggctgaggcaggagaatcacttgaacccaggaggtggaggttgcagcgagctgagatca

SEQ ID NO: 126303 - DNA, 679 bp, Homo sapiens
aggcacaagaataacttgaacgcgggaggcgaaggttgcagtgagctgagatcacaccactgcacaccagcctgggtgacagagaaatactctgtctcaaaaaaaaaaaaagttagaaaaggaatagtatgtctggacaattaccttcagcaagcattgtggcccagaatgtgtgcacaagagagccttaggcaaatttctggctgtttgtttctctttaggctcttacccaaatgatctctacctccttctttcctgtaaatttcctggatttccacttataaataaaagtatgtatttttacaacatggaaagctatgcagccacaaaaaagaagaagatcatgtcccttgcaggaacatggatggagctggaggccattatccttaggaaactaatgcaggaacagaaaagcaaataccacaggttcttacttacttataagtggaagctaaatgatgagaacacacggacacatagaggggaacaacgcacaatggggcctattggagggtagagggagaggatcagaagaaataactaatgggtactgggcttaatacctgagtaatgaaataatctgtacaacaaacccccatgacacaactttacctatgtaacaaacctgaacatgtatgctgaatttaaaataaaaattaaaaaaaattaaacaaataag

SEQ ID NO: 126304 - DNA, 328 bp, Homo sapiens
gaggcaaatacacatgcgtctcctcacaccatgaaagtaagtggagaagctgagcctccctcatttcacagctcctgggtctctgtttttccccaactccacaaagcagaggtgggggtggaggttgaaaatgctcagctcccagacccccgggattagcaggtgattgtcaagcatctgaaaagacacagagtgctcttgtcattattagatcgtaatagattcatactcaccccctccatctgaaggcgtctatttcaggtttaacgtaacaatagagtattgttcctactccagactcgggtaccaccccgaggcgatggcagca

SEQ ID NO: 126305 - DNA, 263 bp, Homo sapiens
ccaacaatgtatgacatcatttatgaaaactggacaaccaaatgagttaccaaacttttgagtttttaccaatgtgacaggtagaaaactgttttactgtagttttaatttgcatttcttttttattttaggtaaggttgcacataccttcacatgtttaagagccatctatacaattggccctccatgtttgtgggttctgcatccatggattcaaccaaccacagatcaaaaatattcagaaaaaaaatagatggttgtgt

SEQ ID NO: 126306 - DNA, 337 bp, Homo sapiens
gggagtaggcagtgtgggtcgggaatgaacggtggaggagtaggcagtgtggaagagcatgcatcccctgttgcagatagtatgtttctgtgaactagaagcagcccagccccggaaccttacacttgaacttccctgggagactttgttagaatgaggcgctctcctgccccctgctggaaacctggtgtaatacagcctctcatccatcaaatctccctgtgactggacccccttggggcggtgcgtgcatcgcagggtcaaggtggttgaatagcgcatggtgtggcaagacaggatggcccaagctgtgtcctctctctcattctcattcttc

SEQ ID NO: 126307 - DNA, 408 bp, Homo sapiens
cttgaagagggagacaagaagtaaataacccactaaagaagccgggtctggtcacaggagaggtgtttctgtgaacacttttatgaaaaggtgcgatgtacttgggggcagtcagggctctgcacaattagtgaaggccattgcattttcagcacttgacatggggtgggtgataaggaaactgacaagtctagtccctgccacgtggccagcctcgcagggctgagaaggcgatgggagagggctgacttgtggtctgatttgcccaggccagcgaggtccatgctgtgacctgggtgaaattactaatggcgctcccgtgcacccctagcacatcccgacatggaagatgagttctgtggacagccagctgtgaggagatggcatggttaaagctccctcgccatt

SEQ ID NO: 126308 - DNA, 299 bp, Homo sapiens
gtgccttttgtcaaatagtagataaaaagcacccacccacatacaaacctcagaaatgtagcatctttccaaggatgtgtaactgccagagatctggagtttaggtgttcagtgtcttggtgcagttggctccttccacacacagctgacatgaccttggacctcctgagctactgagggacaggtagctgggtcatgcccccgtttccttcctcacgactaaacactctgcttgccttcctgattctgcctttgtgagcagggctccctgaactctcacagtttgtcttcccagccaa

SEQ ID NO: 126309 - DNA, 626 bp, Homo sapiens
agcttttcctattacaccatgctgtctttttagtgctcaagataaagtggttctgtacgctataggtatgaatgaacaattatggtattcaagatttacactgcatttgaatcacagatatagccaatactgtaagaacttataaaactgttaattttactaatagtgaagccactaaagggttatcattcagaggaaagaatagatttatgctttctagaaggagtattccagttgccatgtggaaggtggattgggagaattatccagagtggtgtcacataaaccaagatacatgtggaaggggccacactaacaaatgctactgggagataaagtagcaaagacttaaaaccatctactgattggatttagtgacaaagaagtcactgggagccctggcagttgtggtggagtgaaaataacaggcatgcagtctgcagaaggttggagagaatataggtaactctttaagcaggtttcattatagagaccagaggcaggcaaatgtagaaaacaaggaaggttttctttgaagatgggagtgatctaggagaggaagacatatgcagtgggagaggccaaagataaaatacagggagtatctgaataaaatgcccagagtc

SEQ ID NO: 126310 - DNA, 359 bp, Homo sapiens
ggtcatttagggttattaattggcctaatttcaatgttgttatgtctcagataatagggaggcccaaggagaggaagagacaggaatacaggaagagcaggtggtggagcaatgagaaaacacacagcgtttatcgatgaagttcactgtcttatatgagtgcagttcatagtgccccgaaacaattacagtagtaacatcagacattactgatcactgtaacagatacagtaataacaaaaaagtttgaaatcctgcaagaattgccaaaatgtgacacagagacagtgaacatacgctgttggaaaaatggtgcagatagacttgccttagggttgataaaaagcttcaatttgttt

SEQ ID NO: 126311 - DNA, 729 bp, Homo sapiens
catgttcatcatcacctcctcgtaggccagctctacatcttcttgggtgaccactagtttaatattattccatttcttaggaatatccagccactgatgcacagccactgccccctgtgtccccaggggttttgtcaacaccagcacatcccctggtactgcattgtctggcatgataaattcactgggctgacagacagtggtagtgactcttcccaggacaatccaggggtttagtactgtttggccgcccattacagacgtttctgcctcctcagctgcgtctttaaaaccttggataatcagaggcatcactttatccatttccctgttggtcattttattactgactccaaggagcatcagcatattgtcacattctgtgacccccattgcgtagaggtcactgaggacattggcacatgctatcctgcctgtcacgtaagagtcgtctacaattgggtaaatgtaatctgtagtttgaaccaaggaaagcccaccgtgtctcaaaggaatgacaagtatccattccaatgccaagccttggcataaaggctcccagaaactgctcatcttcttggaagtggttctgtaaagattccagcaatttttgcaggacatcttggggcactttgtagcctgtgcccttcagttcagtgaatctggttagccggaagcttttgtccaattcgtaactttccgggttaaaggactcccatgtagatatgg

SEQ ID NO: 126312 - DNA, 266 bp, Homo sapiens
ctgttgctaccccagcaatctcccaatggcagtacctcaagaacttccgggggcagtggtctcaaccttggctttaaactggaatcacctagagaccctgaaaaaccacttagggtctcatccccggaaatcctcattcaactggcctggcacatggacctgcactgtgggccaactttaacttctgccaaggcatgcacgagaacagacgagtcccacgctcggacttccagacacaagtctgcccgaccacctcccccagccct

SEQ ID NO: 126313 - DNA, 544 bp, Homo sapiens
atgtggccagggggaattaaggttgctaatcaagcgacctcaaaataaagagggtatcttgaattatccaggtgagcacattgtactcacaagagtccttatatagggaagaggcagaagtcagatcagaaagagaacatcctaagacttggaccaccattgctggctttgaagatggaaggggccatgagccaaagaatgcaggcagcccttagaggctggcaaaggcaagaagtggattttcccctgggcctctggcaagaacacaggccctgatactttggttttaccagcggggcccattttggacttctgttcttcagaactgtaagataacaaatttgtgttgttttaagccacaaatgttgtagtaatttgttacagcagcaataagaaattaatacaagaagctatgtcaatgggttaaggatttttcttttttctttttttttttaaacagtccagaggtctttcattttttagacacctattatgccatgaattcatagggaacaggttccagcagctcaggctccttcccatt

SEQ ID NO: 126314 - DNA, 318 bp, Homo sapiens
ggattacaggtgtgagccatcgcacccagcctcccattgcttctttacgtgagccagcttgtccagtgactgggagcagctccccgactgagggccatctccaaaacccatagtttcttgtaagaattgtcatgaagcttgtggagatgcagtgtaggaggctgaacaatggttcctgaatatatcaggccctaatccctggaaactgcaaatgttaccttatatggaaaaagggtcttggtggttgtgattaaattttttttttttttttttttttttttttttttttttttttttttttttttttttattttttaa

SEQ ID NO: 126315 - DNA, 283 bp, Homo sapiens
cccccatctaacatgtcttactttgggtcagctgacacttttggcatggcttgataaactcccagctaaacagtttgtttactcctgatctgtaaaggtcatttctttttcaatttaacattgaggaaacaaactttgggattaaatttgacattcaggccaggcgcagtggctcacacctctaatcccagcactttgggaggctgaggcaggtggatcacctgaggtcaggagtttgagaccagcctggccaacatggtgaaaccttgtctctattaaaaat

SEQ ID NO: 126316 - DNA, 521 bp, Homo sapiens
cagtacggatgtgcgggccatcggatgtgcgggccagtacggatgtgcgggccagtacggatgcttgttccaaagagcaaataaccaaggtccaaggtgtctgattactgtctaaagcaggaggcagccaacacacccatattgttaagaaacacccctcttgatgagcctgaaatgatgtggctacctcagagtatcgatagcagtcctcttcaggtggtagaacctaaagaatttttagtttttcctttttaaatgttctaaaataaacatgtagcgcttctgcagacagaaaattacaacttgtttctatattctcaggatgttaaaagaattcaaagaattctctctttgaatcagttttcaaggtcaagttgcttaccacccctaaaagaaatttaaatgatgtttagaaatagacctgccttttcatgtcctcctccttcccctctgttgagtaaacaatgctttgtttaagctaacagttgctgagcccacattctgtacctgttggcagctgg

SEQ ID NO: 126317 - DNA, 424 bp, Homo sapiens
ggtcatttattttacggaaggtttttcaatttggacttgtctgatttgatctgattagctttttgattgtagtcaggttatgtttagtcagaatgttacaaaagtgatgttttcctctcagattatcacatctggagatacataatgcccacttgcccctcattagtgattttaacttcggtcaagatatagtctggttcttctactctatagttactatttttccttgtaacaagcagtctgcttagaggtaccttagtgttttatggtttttttttttttccttagtgaaaactaagtgtagtaataatataccttatatttgtatagtgctttctatatatatgtgtataatgtataagtatatataattgtatatgtataattgttgagagtttaaggcttgtgtagaagaggtttttga

SEQ ID NO: 126318 - DNA, 324 bp, Homo sapiens
ctagcccctgggagcacgccaccagggtttcctggaggatcatagctggcgccccaggccctgtttatcctgttcccaccctcacaattgcgcgggggtagctgagaggaagccctgatcgtgctttccttatagtgcattatatcagtgggttgtgggtacagctctctcttcccaggaccttccatcttcacaagaggcctctagagggagtgggtttggctttccacatgcccctagaagcacagggctcctcaggaagcccagtctccctccctaagcaggaagtaaaaatcctcttgtggttaaataccaagtgccagg

SEQ ID NO: 126319 - DNA, 490 bp, Homo sapiens
agaaaagatagttgtcaggatgtttttctcttatcattgcaccagcaagtatcagtgagccccagaggacagtgttcaagacaagtcatgtggagaatggacagaggctttggtggcagggatccatgcacccgcaggcagcggcatctgcaatgcaggggtgagcggacgcgaggaactgaggctgtgacagaaacacaggacgtggccagggtgccagagggaaggggcgacgcattccaattggccagggtgccagagggaaagggcgattcattcgagtttacagagaagaaaaagtcataagaagattagggataagccagaggaaataaaagtttccatttcatataagattaggcgaatctccaaactttcaaagagaggcgaagaactttaacttcagagtgagttccgagagcctcactctgaaggtctggtgctggggctgatgcttgttaacgcagacatctgaggcacatggccaggg

SEQ ID NO: 126320 - DNA, 419 bp, Homo sapiens
gattttccttgcattttaaaagataagtttttatttttattcccaaatccccaggaaattttaagtgctgtcagttttgtgaaaaggtaactagagagtgagtagggaatgcgcgagtgatatcacatatcaataaagattatttaatagagattattaatatgacagatgattctcattaaagatggcagattaggccagtgttccccaacatgacctcagatatcagaagagctgacaagtgtagacgtgacttttataacttttgctcttgggaggcgtgcgcgcgcacattgtcttaatgagctttataatttattagtgttgagtacatatttttatttataatatattaatagagattctgataaatatcagttaatagtagaggggacgctgagagcgggaaggctcccgtg

SEQ ID NO: 126321 - DNA, 514 bp, Homo sapiens
  misc_feature (11)..(11): n is a, c, g, or t
  misc_feature (41)..(41): n is a, c, g, or t
cctatactagngtatctaaaaactagaagctactttgcagngcggcttctacccctgttacacacctgaaatgaagccaaaaactcttttagctttacattagagtgaaattcaaactggtctgggtgactataaatggttactgtttgtcttggctcctacctgtatcagatttagactgaggaatcttagggaagaaattacacgggataaaatggatatttctaaattacaaggcctacaattccagtggctccaaatatcagctttctgtttcatctcagcctgccagaaagaaaatggtggggccagacaataaaagatagacaacgtttactttccagagccaaatgcttcttgttttgattatactggagaaggaggttgcagatcctgatcagttaagtcttgttagcaaattaaatggttgtagactacaatggtgtaagacatgagttttagcccctggcttcaagtcgaaatgacaaaagtatacattctttcaacccatttt

SEQ ID NO: 126322 - DNA, 412 bp, Homo sapiens
tagatttgatggctttgccaatggcctaaccatccttagaaatctttttagtcctatatttcttgcaattataaatcagtctgtctaagaaacttgacaggccctcttatttacatcagacatgccaacctcttagaaatcagaactgtagtctctaatttagctcttgatgtgttgtgcatatcaatagctttatacatgtgaaattagaaatagttttattttctttataggcttgaagaaaattaacaaacaaatttgacttatgaaaactgaatagaaataaattttatggagtaaaccagactctgcctcaggaatgcattttcagagtagatgttcggaaacagatttataaaaattaaaatactatatgtttggttcatttttagggctacctatagcttgatac

SEQ ID NO: 126323 - DNA, 219 bp, Homo sapiens
ccatgatgtttgggacaacttgcctctgcaaccaattaggcagctgcagctcatcacgagagagttacagccacctggcccctgcaagagaggggactggagtggagaaaggaggctgcgccatgtcatagagcagccgttggtcacagacaccttgtgttagggacctggcactgccattcacaggctgcgtgaccttgagcaagtcgcttaacccct

SEQ ID NO: 126324 - DNA, 812 bp, Homo sapiens
ttctgactccgtttaatcaccttagatggagctgggaatgtttacagtgttcatggatagctgtgccacttagacttgacatgaagttagactgaaggctgtgcttatgggtgatttccatggaaagacggcatcactgttaggagcacagctggctcttagggcacacaattcacagggctgcgattttcacaaccacttccaggagcatagcttcataacatcagaaacatctgccggcccctgtacacagtacgcaaagtaatacattactgcttcattctgagacgaaacactttgaccttgtgcttctccatcatagtttaagaagctgccctagtttatgttgatttattcttaaacagttcttagcaaggcaagtaaacgtataatttttcttaattttcaaagacaacggaaactttcccaaatagcctttgccacctcatatcgctgtcaactgctagtttttgttaatttcacatcaatcatcggctataaatatttgtgccatatcagcaggggatttattagtgagcacgctttagcaatgcatctgcccaaacaccaagcatgagggacagtttgtttacgcatctcactccctccacctgctggtggctgctggaaatgagtcccccaaaaatccagccttcactttgtaggaagtggcactgacaaatccacctagtactgctttacttagctgtaagtaacagcataattgaaagtgctatacgtgtttatcagaacaaaaacacaggagcaggcacattaaggcagcagcaggcccaggagtgagagtaagctga

SEQ ID NO: 126325 - DNA, 791 bp, Homo sapiens
ggtctggatgggtcatggtggtgtcggtgagtctgcaccaatgcaaaggtctgaaatacatctcaaagatcaatcataggtttgacaatagtgacattatttataggagaaattggggaagttactaatcctgtgatccctggctatgtgattctcaagcagtaagcaattatagaaaggcaagctatggaataatggctggtttttgtttaactgtgcctacatcttagcagaattcaggcccctcccataatcctaaccttgtagactttgatgagacttacaaaggcagtttcagtccctgagcaaggaaggagttagtttcaggaaggaattgttatcatctttaacaaagtcagttagtttgtgctattggaagcaagatgggagtatttatgtcagatttctctcactttcataatttttgcaaaggtggttttgataaccaaaagctaattaaaatgaagggataaaaggagaaaagctttctttctttccatggcttagtagtattatcaaataaattatctggtggatgtgatctgatggatgtgatctgatgagtttgatcaataatagagtctgatcaagagattcttgtttggttttacttgcctgaaaaagtactttcaccttttatataactgtgtgtatattccataaatagtggttaaacaagtcatttaaataataacatattatagctaaaaccagatgagtgccattgtaaaacaaattagcaaatattacatttccatctgaaatcaaggagtttctcaggccaataattg

SEQ ID NO: 126326 - DNA, 973 bp, Homo sapiens
gctggctatgatcatttgctaaaccacaggacagttctggccaccatttccgagattagcaaagctatgctcatacttattgccctttcttttaggttcttgtatgtttcctcaacctctcccactttctctcactctgatatagccagttcctctttttcttgtaatccggtatttagataagtccagtcaatactttgcttcagatgggcaaacatcctttctttaattttttttttttttttgagacggaatctcactctgtcgcgcaggctggagcgcagtggcgccatctcagctcactgcaacctccgcctccagggttcaagccattctcctgcctcagcctcccaagtagctgggattacaggcacctgccaccactcccggctaatattttgtatttttagtagagacagggttttaccatattagccaggctggtctcaaaccctgacctcaagtgatccacccaccttggcctcccaaagtgcagagattacaggcatgagccacctgcttttaacttgttcagctacaaaggcatgtctgtgaatgcacaaccataatgactcatcatgggcccagagctataacaatgataaggtaccaagcatcttacaccatgtgcgtgttgatgagaatcaacatccttgcctgttcttgtgattttgtggcagagtatagcttcttgggggcaagtatgtattctacaccactaggagcaagcttctttatcatacacttctgggcttctctggggaagccaaactctaaaggccttttctgaggagtgtcgcaaatgctgcctgcagtacgaggcacattgccagttcctgactgcattagcaggttccagctgccaggacgcctctgagtgtgtaccttgtgacagaaaggtacttctcagctgtagtaaaggatgctctcaagggtactctgcaaagcttctgactgcgaggcacttctcagt

SEQ ID NO: 126327 - DNA, 412 bp, Homo sapiens
gctgcccctggggtgtgcaggatggagcctagcaaggcatgagggaaggctgagcgacccgggaggtgtctgttgcaggaaagagatgatggcatcttggtccaaggttatcttattgcagatgttcagtagtgattgggttcaaggtatatttggggactctaggcaaaaggccttcttaatggattacatcggaggcaagaaggagggagagaattaggactgttaatgtagagtcatattctgagatacagaagactttgggagtgggggtgcggacacattggaagttgggagcaatagttttgagtaaggtaaatttgatttcagatgtgttgggtacacaaaggggccaggctagagattacagactttagagttgtctgccttcacctagtatttgaagccatgg

SEQ ID NO: 126328 - DNA, 2272 bp, Homo sapiens
tagccgccttcctcattttcgttctttaaaaaaaattttttttggttgtgtttgacttttcatggaagggtgaagactgcaaggtttctaactcaatactcttgatttcttttaggatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaaaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaattatattaataaataataaatataatatataaaaataaaaaaaa

SEQ ID NO: 126329 - DNA, 2150 bp, Homo sapiens
gttagtgctggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaaaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaattatattaataaataataaatataatatataaaaataaaaaaaa

SEQ ID NO: 126330 - DNA, 2227 bp, Homo sapiens
tccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaaaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaattatattaataaataataaatataatatataaaaataaaaaaaa

SEQ ID NO: 126331 - DNA, 2174 bp, Homo sapiens
gttagtgctggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaaaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaattatattaataaataataaatataatatataaaaataaaaaaaa

SEQ ID NO: 126332 - DNA, 2248 bp, Homo sapiens
tagccgccttcctcattttcgttctttaaaaaaaattttttttggttgtgtttgacttttcatggaagggtgaagactgcaaggtttctaactcaatactcttgatttcttttaggatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaaaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaattatattaataaataataaatataatatataaaaataaaaaaaa

SEQ ID NO: 126333 - DNA, 801 bp, Homo sapiens
atgcagaaagagcttaaggagaagctctgacaagggatagacagtttacttatggaaacaagcagaaaattaaatctggtctctgcccagcaagcatctcacctcccaccatagcgtctggcagagaagtgagccaaggtggcccctggcgcagcaaatgtttggcacatccatttgcacaggagggggaagaaggcgcattctcaaacacccttcccatcacctttcaggatcttaggtgccttctctacagccatggcacaaacctttaccactagggggcggctagacatttcgattggctaccaggcaagcggccagctcaggacaggagcagtgctctgtgaaagaatggattcctggtttgttctaagtacaaacaagggggaaatgcttctgcagggttaaatgaggttgacacgctccccgcggctgaccagacagtccctcctaactcttacccaccctgggcagctctctcagcgcggtgtggggcgggagtgggagctgatggggggtgctctctattcagactctacttgttctagactgagtcactggtgggggcagcggtgtttgaaagtgggcatcactcttgggctcccacattgactgtagttttacggaatgtttggctctctgcgtgatgtttttacttaccaaagacacagacctgggcttcctggggtcccccttctgcagctgtgataatcagcagtcttcccaggacagagtcaggttctgttgcccaggctggagtgctgtggcatgatctcggctcactgcaacctccgcctcccg

SEQ ID NO: 126334 - DNA, 189 bp, Homo sapiens
taaacctctgcagggagagctctggccgtgactcctgggagccggtgaggtttagccaaagccccgagtggggaatgtgaggggctgaaccgcacaggggggatctttccaacagaagaggctaaaggaactggaggaagtcgagctgatcgcccatcgaggccaggggcctgacgctgctgccctgtt

SEQ ID NO: 126335 - DNA, 631 bp, Homo sapiens
gtacttgccactctaagcctactacactttgctgaggaatcagaaggcaagactcctcagaattagtaaggagcctggattatggacaattacgaagatgttccattttatcacttttctactatgcatagtaaattataaggggctaacaaagtatcacataggagcattcttttggaggatctattgtagtaaatagaaaagacagttgaatagttttctatatgaacagtgcttctaagtgcttaagaagagcttatgtcatgtaggttgagcaggcatgctgcaatgctttttatgatatttatttgttttgtcaaccctttcactccttaaataaaggtaaacttccgctcaccccgtcagaaggatcaacatggagaattagtggacctggagttcataaggttttactgtaacagcgattaggaaggaatgcacatgtgtttgtctccaggaaggttagaaatggaaataaatgcaaaaatatgctttgtggcacgtcatcatttttcatatgaaaatggaaagcacaagacagctttgttttgcctttttggggggctcgtggctgattttctcttcttgcttcctggtttttgttagaaagaaacttgttcatttcccaccc

SEQ ID NO: 126336 - DNA, 299 bp, Homo sapiens
  misc_feature (285)..(285): n is a, c, g, or t
  misc_feature (288)..(288): n is a, c, g, or t
gctgttgactaggtagcctgggaccaatttatggaaggtgttgaaagttagatagaagaagttgaactgcatgtgataggcaatgggaagctttccattttttaatgggagagtgacttgatgaatgtgatacattgaggaaaacaaagaaaaacattgaaacggatggtgaattgaagggaagaaagttctgacagcagggcagatcagctggaggccattgcgttttagtagatgtcagttgagaatctggttagggtgaagatagcaaagaccccaaaaggngtnccgagctcgaa

SEQ ID NO: 126337 - DNA, 394 bp, Homo sapiens
tcctctcctccttccccctcacacctgctttctctttcgtcatgtaagactccctccctcaggagacatttctctcctggaagatgaatcgagtggttaagcccccagctctgaagccaaatgtcctagcaccgagtcctgcttctaccacatgcatgctgtgtgactttgcctaagccactcaacctctctgtgcttcagtgtacatcagttgctcagaacagtgcctactgaattttgataaacatcagcgactacaactatgactaggaactcctgagtcctgggcctattttgatctgtgggcactgagagcctcagaatcactgtctagttcttggactgctagaaaggtcagtgccaaatcttggctccaactgcagcacctatgaag

SEQ ID NO: 126338 - DNA, 897 bp, Homo sapiens
gggatttgagatctggtccaaagtttgcataaactacgataacttgaataggttcccccaagccttaacttgctgtgaggcagcggtaattctaccaagcggattatctgtcacaaaaggcagcctcttctagagaaatgagctgttcagtcaattgaattaagaccaaaatgcatcagttggagtcatcatacttcttgaagacactcacttgcttttcaaattaataatatattttcatttttattaaaatattgatactttgaaatatagatactgatggtttgattagtgttttttatgatgcttctcattccagctttaataacattgtctttctcttattttcacctttctcttgacaggcatgctactttattctccatgctcagcaaatgttcagttcagtttattttgagaaataatgttccatgttcagttattaatttgaaagtaatcattttttttctgataatcttccacacatttaatttgcaggtcaaatttcagtagcttactaactgagaaagaaaaaaaaatgatagggtttggttcctttattcttataagaaaataattatagagcaacattcacatttgttctggggaaaattaatctatttttagctgtaaattatatgctggagataaatataaaattagcagactagaattgactgctcactgtcagccatgcaggaacattactttgaatcctgcactcaggtgccttggaagttaattgacacatacgttccttaaatcccagaatagttgacaaacagacttacgagctaatttcgtgagagccattaaattatctttctttttttaggtgtggtataatcagaagggttttcattccctaccttcctacttaaatcatctaaacaacct

SEQ ID NO: 126339 - DNA, 531 bp, Homo sapiens
atcaagacacaggaaaaaggaatgcagggatttaggaaagctgtactcacttctcttccaccttagcagcaaaagcaagaaggttctcaaaattctcctgataatagttctgttgcttaagcaataggatgccggggagtgtgggggcctgaggcatgggcattcaagttcttctcaaggtgttttatcttctcagcttgggcacagtgttctcggtgaaaccatgccaggcacaggagcatgctcttcacccgattctgtactcagagccatccaaaaaccattatttcgactaggttcttggagtccgctatgtccaccaccagcagggcctggcgcatccacgccacttctggaattacaacttggtctgggcctaaggtcactcactcaagatctcatccgccagccacgcctccaggtagaacaccaaagggtctctcagttcctgcaccagaaaccaccaaggccggaggccagagttttaaaatctgctacaaagaaacctacatccattctgacatacataaa

SEQ ID NO: 126340 - DNA, 333 bp, Homo sapiens
gagtacaatggcgtgttctcggctcaccgcaacctctggctcctgggttccagcgattcttctgcctcagtatcccaagtagctgagattacaggcatgtgccaccatgctcagctaattttgtatttttagtagagacagtttctccatgttggtcaggctggtctcgaactcctgacctcaggtgatctactcacttcggcccctcaaagtgctgggattacagacgtaagccaccacacccaggcagggccttccttcttaatacctgcacacacagtctctctgagtaataatctgttaaggtgctcatctcccttactaaactaagaa

SEQ ID NO: 126341 - DNA, 376 bp, Homo sapiens
taacactgtctgttcctgtgggggcagagttgacctatccataaattaacaacccttattttgccttgtgttacactttagggagtgaggatttggcctgtaactgtcaaataacagagcccatcctaactgcttctactgtgggtaaaataatgacatactgcctaggtgtgcaggtggatggtgacccatctacacctgttagatgtcactgcatgaactgaccctcacctggttgtgttttgagccacagaagcagtactagaatgttctacttcgtcttcatttccctgaacctgaattttcctcagtgagctaatttttttttttagggtgatatttcaaacaattgtagggtagcttgtttttttgtttt

SEQ ID NO: 126342 - DNA, 141 bp, Homo sapiens
ctcctgattgaaattcttattatcctctcctactcaatagcccccaaggtatgttagccttcttttaattcctcagacatgtaaagcttattcctctttccttaattattttgtactctctcattctactgttcacatagt

SEQ ID NO: 126343 - DNA, 647 bp, Homo sapiens
actccaatcacggctccacccccacagcctaggtggcggtgtgacagttggtaccttcggtccagatcgcagccggccaggcgcccactatttcgggatccccccaccgtagcccctcgatgccccctgacgacaaaacaggtgggaccccccctccccgaggagcgctccccttctctccaggccgcgtaacagcccgccaggctcgcgggcggctctgagaccccgcagggctgcccccgcggggcggggacgtttaggggcaaggcctggaggggaatcggcgcagcccagaactggacagtctctccaggacgccgcttttccgtgacagagggggtctgcgctatcccccagcgacgtgtcaagggcaaaacagcagcagcagcggctgcctctcccaccgtcttaacccgaactcgggcttgtggcgtcctcccgtgggccggatagagtgccctagtccagctaacggattcagcctggagcgttctggtgaatgctgctttcctctttggtgccgcgaagtagaaatcgggataagggttgtcatggccggagggagcgaagagaatccaggcaggtgcttctcagatgtttcttttcaccttcaaacagtacagacttcagcggtacacgcttacgaa

SEQ ID NO: 126344 - DNA, 381 bp, Homo sapiens
tcccattggcagcaccctatgatctactccacttttggccacttatatttttcatttcatcaaccaaaggccagagaatctagggaaagtgaaagaaaatagctgaagtttgaaaaaagctgctaaaaccctgattcctgcctttagttaataaccactgctttggacattaggagcccttccaactttttgcacttaggaagttaccccatccacttaccagacaatatgagaagtgtcttttaaatccagaggctaaccagcaacaacagagctgagcaagatggactgtgctgctctagtctaaaaggtaataggcacacttaggtagctttgtaggaatcaagtccttggaattctgactgatgtgctctcaactgc

SEQ ID NO: 126345 - DNA, 447 bp, Homo sapiens
taaaccacaaggtacagagaggaaatacagcgtagtagaaagagtagtcagttctgaggaacactattacttcaaaatattcatgagaggatagcaggagaaaggcatcatgataacttcctctctcagatattgacattgcacatatttagcacataaatgcctctgagaagttttggagtaaggacaccactatatctcaacatttcccaattttgcttgaccctgaaatcaattatctccaatgatgtcttgaatatgttctactaattatgtgatctggggcaagaaatctaacctctttgagtcatcatttccctataaataaaaaagatcaaactagtttatcagtctcataagatgacgggcaggagcaatgatttagtatttaccatatgcactactggctgtatgttattatcattactacactaagagtaacagtga

SEQ ID NO: 126346 - DNA, 224 bp, Homo sapiens
aatacgtgtgcgcagctgccacatttcagaacagcaatcaaacctcgttaatatcatcttgcttaataccaagtcccatagatcataagctatttttattgtgtatttaacagatttgtgtattgtcttccctgccagaatcttcacagtccaatacagaagactctgccatcacagagccttaagacctgcggccacccaaggttaagtcaggagaaggagga

SEQ ID NO: 126347 - DNA, 192 bp, Homo sapiens
ttgttgctcttgtggtgctgagttggattgcgtaaaggtggggacctccagatcttccacgggaaaggtacgtttttcttgttgatattgtgaagtgtgtatggggttgtactttggcaccttgtagtgagtcagtttccccccattggtgatcattgccatatcactacatttgaggtttcaaaatgttat

SEQ ID NO: 126348 - DNA, 381 bp, Homo sapiens
atgcctaattttttattggtgctcaaacttaaaaggaatttatcatatgaaatatgcaaaaggaaataatgcgaaatgtactggccaatggctgctaatatggctttatggtgaatcatagtagacatgtatgctcgacctccaaataactaaagctgcttctgtccaatatctcagaaagtcatttttattttaaaaatgcagatctagtaacttttctcataacctttaacatccctttttcacagagactgtcttaatgaatttaggccttttttggtgaacacattctttagtcacctcaatctatataaatattaaatagttaactattgaaagcctgaacacttgtattaaaaatattatttcctaatattattt

SEQ ID NO: 126349 - DNA, 184 bp, Homo sapiens
ccatactgctcaaggaatggggtcgaaggccagctagagctgtcccaggaatagtctcttctggaaggatcattatttcaactgtgaactgctggcacgacactaggatgtgcaaccccaccgcgccctccagagcaccaggatttccttcttgctcctggcactgaagttggtactagtagca

SEQ ID NO: 126350 - DNA, 193 bp, Homo sapiens
aggtgccactaatttaattagtgcctacagtagaaaagggcatccgttttctatgaagggacactatatcaaaggcaagttataattacacacacacacatttgagagtctccctctgtcgcccaggctagagtgcagtggcccgagatcatgccactgtactccagcccaggtgacagagccagaccctgtg

SEQ ID NO: 126351 - DNA, 255 bp, Homo sapiens
attttacattttccaaaaacaagtacttttgctcccaactactgtgtttccatggggtatattattagaaccgaataatgatcacagtcttttctgttttgtgtaaagggagcaggtatggtgggaccagcggctgagatgagactgctgtttctctttgaggtggcagtcagtgactgcagagagaaataggaaggaacacaagtgttaacttggctgatttgggtatatttatttattaatggaaatagccct

SEQ ID NO: 126352 - DNA, 250 bp, Homo sapiens
tcttatttgctaccaaaataagggagagatttttatgaaactgtcattttaaataatagtcaatagctgcacacattaagtaaacaaattcagttcaagggaagaacttcatcaccatttggtggttgtaatttagattattctagcgtgtaatactttaattgtataaaacaaagctgatgtcacaaatacaaaagaatttcttgcaaagcaagtaccacaagtaatttctatgctgccactgatggct

SEQ ID NO: 126353 - DNA, 266 bp, Homo sapiens
tcttattggctggaaaggaagaagcattctttcattggttggtgtgtattgccttgtcaaccaataagaggatgccatttatccttttctgactagctgagtgagcagggtacacagaaggattgaatctgccttagttccatccagtagcaaaggacagaactcagagtcctggactcaggatctggaattgactttggctaatccagattgcactgacttgcaaggatgacattttttacctacctattcgcagcttacttcaa

SEQ ID NO: 126354 - DNA, 195 bp, Homo sapiens
ctggccccgcggctccggtctcctctgcgcctcctaccctgtggatgctcagaggcttaaaggcaggctccgggcgcagatcccatgcggcggctgggccatgcaacaaccactaaagacatcactggggcgtcaaaacagcactgaaatcgtaacgaaaggaagataacagtcgttaacagttcccacctgtat

SEQ ID NO: 126355 - DNA, 877 bp, Homo sapiens
gagatgaataaataatgactaggtaacaaatctttttccaagtcaggtggtgtttaattctttgctttaaatgaaaataaaggaaggtctaatttagtcatcagttaatcaccaaaactattttttgatatgtgatctgcaaaattcaactgcttgtaacattatctgctttaaataaattgttattaataaacttctttgtaaaagtacactaaaatatgagtataaaaacgaaaatttttctcttaaaaaagtgtgttaattttgttacatgatgatagcatcaactactataactttaaaaaagtatcatctttattaaaatacaattcacagtatattctttcgaaccatataattcagtgatttttaataaaggtgtgcaatcaccaccactatctacattcagaacatttactccctaaagaaactccatacccaccagcagttattctccaaatctcttccaccaccctcactagggaccacctggcaagcacaaatctgcattttctttatacagatttgcctattcaggacatgtgaaataaatggaatcatataaaatgtagccttttatgactagcttcttttacttaacatgttttccaagttcatccatgttgttgcataaatcagtatttaatgtccttttatttctaaacaacattccattgtatggatataccaattgtgtttcttcatttataaattgatgtaactatctctttgctaatatagggttatatcgatagtcggtactgtcatcccggtaataggggaaggcagaaccgacagaggaacttaggggatatcaagaggggccacaaaaccttttggggggggggccacaacgcttaatatatatatatgttgc

SEQ ID NO: 126356 - DNA, 254 bp, Homo sapiens
tattgcctctacccatcttagttctctggctgaggtcctgtaaattagactggccaaagacaggtttgtagccacagacaaaacccctcagacaccgagttgtagaaggaagggctttattcagctgggagcatcagcagactcacgtctccaaaaaccgagctccccaagtgagcaattcctttccctcttaagggcttacaactctaagggggtccacatgagagtgtcatgatcgattgagcaagcagtgg

SEQ ID NO: 126357 - DNA, 171 bp, Homo sapiens
taacagtaatttgaatgcctttaaaaaaagatagcaatgagagttacaactggccacagttgtgcaaaaattagtggtgaaataaaaagttcaaaagcaatagcagggaagcatgaactaagagaatttatatgagtaagtaaaaatattgttccatgggaaattaatgag

SEQ ID NO: 126358 - DNA, 459 bp, Homo sapiens
acaggggctggtgttcaactttgttcctgagcccccttctctccttgggctaaaatcccctcagggaggaagatcaccgaccaagtggtcctcagtatttacaaaaaacaaagcctcctctcacaactccaggaggcccccgaggctagaatggttcctgtgctctaggagcacaaactgtggacgcacactgacaggcccagcacttaaggctgtgtaggtggcatattgcacatgggctctcgctctaaaggggtgagttggggctgacatctagcccaagctccaatcgccaggccatgcacactggcatgaggacgtatctacccagaagaagggccacctttttaaaatctgcacaaaagaagcttttatgtggattagcaacgttcctacccagagacctgagttcaaattccagctctcacttactctatgaccttgggcaggttccctttt

SEQ ID NO: 126359 - DNA, 240 bp, Homo sapiens
ccacgaggcactcacagctgtcataacatgttactcagaaacaacacagagggtgcgaatgcacatggcagctgcgaagagcaacattaagtatttggaggaaggagagctcacatccagcctgtgtgcgcagggacagaaaaaagctttggggcagatgaaatctacaagctgagattcaaagataggtgagaaaaaaatctcggccgggagcggtggctcacgcctgtaatcccatca

SEQ ID NO: 126360 - DNA, 239 bp, Homo sapiens
cacatctggaggggcgaggagcaggcagtggggagagaggggtcttcctcattgtgctgtctggatccaactcagaggcctcatttggggttattaattgggggagcaggcaggggatctccttcctccagtccagtaggtcctgggccagggtttgtactgaggctgggacaaaccaggagcaaggtagacatgtcccccagtccagccctgtgcagcggccctgggccattcctatt

SEQ ID NO: 126361 - DNA, 501 bp, Homo sapiens
agtatagaataaccgatgacctacgtggccagttaagttttatggcttgacccattcccttgaataaggaaataattctaaatccatataggttattgtaaattataccaaaaatacttagttttaattagtgtaatcttaaatttcaacttctgtcatccaaaaatactctgctcattacttgaggggcattgccatagccatttacggtaaagcattctgttacatgaaatgaagacaactgtacagtttatacgctgtataatgactttggtcaatgacagactgcatatatgatggtggtcccataagatcataatggaactgaaaaattcctgtctaaagacaaaggcatcgtaacatcttagcacaatgcattactcacatgtttgtggtgatgatggtgtaaacaagccgcacagtaggctgcatgtagaagtatgacacatagaattatgtatggtacatgatacttgataataaaataccatgttactggca

SEQ ID NO: 126362 - DNA, 318 bp, Homo sapiens
tctagaggatcccatattctgcacccacagcccaggaggagcgttgagacacacggcagaggtggggagaaaccaggcaggaaacagcatgtgtacctgggtcctctcagccccactgtggcctcctgtgtgttgcttttggtacatttctatgccctgttggaggtaacgggagggatactgaagccatctttgaggtaagagaagaggtttagcctcatgcgtaagactactggagagatggccttgcccaagagtagttggagatgcttctttggagagtgacctccaccttctgcaaggcccttgttagggaca

SEQ ID NO: 126363 - DNA, 447 bp, Homo sapiens
cttcccttagcttctgtagctaaactacagctatccaatccttttaatctcttcagccgcatccttcctcgggctctgaattcattcactcttattgctattctctgcacttccaaatagcctgagcttccctagtaatgaagtggtgggaacacaacgtttggtgccaggtgctgctcagctacaactgtccacagaggaactgttattccgtgcccttctgcacaggcagactcaacctggacttctctttcatcctgccagactgcatggatggcctgaatttaatttgccaaccactgtgcctcctgggcctactttggcatcactgagatctggcatctgcttcccagaacagctctgtgtatggattctctttccccaggtgtattcactgccttcgctttttcaaatgctcacaaagttattattcccagcttgctcaga

SEQ ID NO: 126364 - DNA, 184 bp, Homo sapiens
acaggcacgtgggcagaaataaacacccacgttcccatcagttacatgatttaaaattatgggccgtggagcaaatgttgtggaaatgtttttgaaaatgtgtgataaagtttcagtgactagagcttttagcgtcttgtaacattcacctcaacagttgagcacttactcatgatcagtgaaa

SEQ ID NO: 126365 - DNA, 193 bp, Homo sapiens
attttggagcgtctgcatttcagatttttggattatagaggctcaacctctacgttctctatcggccaacattctctctactgttctcttttgtttccagagattgtgggacaaatatggtcattcactattttgccccagatatgtgctatgatcataaggcaaagaaaacaccaagtctccaaccctgaaa

SEQ ID NO: 126366 - DNA, 673 bp, Homo sapiens
gattctccttgtaaccctctagttctttcttctcttttccttattcctcttctgcctgcttctttaaatgttggtgccctcaaggcttctgtcctagtcatattcttctgcttttgtttcctgagcaatctcatccattattgtggctttaagtattaattaaattctgatgattcctattgctctgtctctaccctcgacctctctcatgagctttcaacacatcttttcagctctctactacttgatgtcttttaggtcacttaaactaaaaaatacccaaaatggaactcattatgtttccccaaaacttgtttcacttctggtactctctttttctatgaatggtgtctttcatcagtttcaagccagaagctgtggagtcctcaattcttcactctcctgtcacttcccacatttacttggtcatcggatcctttgagttctacgtcagaaatgtctcctgagtccagctacttctgtctgtttccacccccattgctttagttcaggctgccaaaatttcttacctgaaccaggaagacagtgtcaacttgttcctttaccataacactctccggactccatctgccatattgctgccagagacacgattctgaaaacagaagctgactctgttatatgcccaaaggtgtatttgcccaccctaccg

SEQ ID NO: 126367 - DNA, 265 bp, Homo sapiens
caagggtgattatttctctaataagcttttaacaagcaccatattgagtgaagtgcatttgaacaagataattatttagcctaacagagtgcaaacaagacgtggcatggcacattgtctgctagcagagaggcatccagaggttctcggagtggctggattatgtctcctggacttctctctcttgagttcaccatgcacttttagagaaagacgctcagaccctctcccagaggctcgcttgagaaaggcaaaactaaaatac

SEQ ID NO: 126368 - DNA, 266 bp, Homo sapiens
taaggacacacgctgagatttgggttacagaagagggtatgttttgggtggtcttcctatggcagtgagtcatgaagaaatacaacttatgttgccatgaaaattccacagggcacacacaaaaggatacaactccctctggggtgctgaaaaggactctagaaaaaaatgactgtctgatttataggaagaaagcaaagggagaaaatgaaaacctatactcagtcattagaaatgtatgcaaagcactgtaatcccagcacttt

SEQ ID NO: 126369 - DNA, 303 bp, Homo sapiens
gaaagtgcgtagagagaatgtgccattgggtctttgaaggaaaagaacgtcctgtccttaatcagtgagctaaataattaagagccaaaggatcggagtcaaagccttgggctgttttgctcagcatagttgtcataccatatttagatgtctacacccacctttatccaggccatttgtatttcttggcaggaacgtgagaacaagcgtcacctggggttgtggtatctgagggttgcaaagtgtcagcgctggaggagctgagtgatcactcatctgaccttccctccaaagcaggagtac

SEQ ID NO: 126370 - DNA, 372 bp, Homo sapiens
ttctctgattctcagtgaggatttcccaagctaccttaaccattcaactctgcaggcattcctgtattccttccccgctttattttttccactgagcatttatctaacatattatatattgtacttatttatcttacttattatctcttcctgccactagaatgtgagctatatgaaggtagagatattagcccggcattttagtattcactactgtatactatttcccagaatagagtgggtgcttaataaatatatggtaaatgaatgaacagatacatgatgagctcctcctcctcagttgttaaaactgaggtcaaaagtgatgcttaaggctaggcacggtgctcatgcctgtaatcccagcacttt

SEQ ID NO: 126371 - DNA, 474 bp, Homo sapiens
atgttacatagtaatatgtcataagtataatattttcttttctttgtagaattagatgctaaacctagaagatgaagttattttcatgaaatcatttctgaactactgattttagacacaactcctcttataagtactcaccattctgaaaataaatgcttagtttgaagttattctgtaagaatatgtcctcatatctaaattaccccaaactttacattttttttaaaagagatggggtctcactctgttgcccaggctggagtgagactctgtctcaaaaaaaaaaaaaaaaccgggagggttcttggtctctagtcaaagcatatctgggtttaaaataagagacatcaactcgagctatatttacctaaaagagaaattcataagaaggatgccaagagcaatgtagtgctctggagactggaaaaccctcaggggacaagaaaccatctgtcttaacttctctctctt

SEQ ID NO: 126372 - DNA, 306 bp, Homo sapiens
ctcctacctttctccctgctgagcacgagggatctgctgggacaccacctgcgtgtatgtgtccagatatgtacgtgcaagctgaccagcgattcccactgatctgccaccaagagcaccaactcgtgctggaggatcaggtgttggctccaagaccccaatgggagcagggtgaagatgaggctggacacccacccaagtggtagaaacctctgcatacttcctaagactggagccaaggcaccctccatccaggtgctatggccgtgacctcatgatgcctgaccccagaaggccaccagaggt

SEQ ID NO: 126373 - DNA, 333 bp, Homo sapiens
acagcaactgttgagagttaacctctcctttccaaaggaggtttgcagaggcaggacagtgagagctgataccaccaattttattcttttctcaggcatttctaacttttatgatttcccccctccttcctttactatctgtctttgtgcctccagggccagtgaaagagcagggcagattctagattgctttcagagtttgccttctctgatgatggattaccatgtcaatttaaacagcataggattaatttgtttcaatgatttctctttaggctgaatgccagccgtttttctatctttctctttgctcttcagaacaacaacaacaac

SEQ ID NO: 126374 - DNA, 403 bp, Homo sapiens
gggagaggggaaagttccaaagacatcagtgaatggcagagagcaaccaagaggtcagctggtaccagggccaaggacaggaagagatgaggggttggacagagagaaaaaaagctctggccaggcgtagtggctcccgcctgtaatcccaacactgggaagccaaagagggaggatcgcctgaatccagaagttcaagaccagcctggacaacaaagcaagatctcaggtctacaaaacataaaaaaatgtagccgagcatggtgatgcacacctgtggtctcagctactcaggaggctgaagcaggaggattgcttaagcccaggagttcaaggctgcaatgagcgctgatctcaccactgcactccagcctaggtgagagggtgagaccctgtctctaaa

SEQ ID NO: 126375 - DNA, 229 bp, Homo sapiens
ttcatggtgcagcctcatgacccttgcctcgtggtgttgcccccatgcgtaacatggctaaaagagattctgcaggtggaattaagatgattgtccgagtgggcttaatctactcacatgtgctctttaaaagcagagtttcctcaggccagcagcaaggaggaagtcagaaagatatgaagctcaggaaagattccacactgttgctagctctgcagatggagggcgt

SEQ ID NO: 126376 - DNA, 736 bp, Homo sapiens
cgcggtggctcacgcctgtaatcccagcactttgggaggcggaggcgagtggatcacttgaggtcaggagttcgagaccagcctgaccaactacggtgataccccgtctctattaaagcatacaaaaaaatttagccgggcatggttgcacacacctgtaatcccagctacttgggagggtgaggcaggagaatcacgtgaaccctggaggcaaaggttgcagtgagccataggtcatgccattgtactgcagcctgggaaacatgagtaaaactccatctcagaaacgaacaaatcaaaaataagaggaagaaactatgagataggagtccaggatatatatattctcagaatcatttcatgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtt

SEQ ID NO: 126377 - DNA, 521 bp, Homo sapiens
ttggaattacctagaaactttcaaaaactattgatgcctgtgtctcaggcatataatttaattggtctgtggtatggcttgggctttggaatgttttaaatatccccaggttattttaagtgtaggcatatggcagaggacacagagtgaacaagcacacagagccatgcttttaaagcatgatggccatagccttattttgagaggtgtaaactttggtaggtggtatttgtacattttggtgtaaagaacacagtaatatagaaaatgagataagaactgctgtaattcacattcctttacaggtattttctagacaccaggatagtatgttgacaattaagattagcatattagaagaaaaaaaattatttttatcttttgtataattcaggcttattggtgggatgtaataattatttttgtgtgtgaactcggcagagaagtatgtaaataattttttaaaaaacaaaggaaaagaaaagtcctgtggcaaaaaatgggaacacctagttttaata

SEQ ID NO: 126378 - DNA, 291 bp, Homo sapiens
ctcatgatccgccctcctcggcctcccaaagtgctgggattgcaggcgtgagccactgcgcccggccgtaagccatgcttttgacatcttgaaccttttacgggagttcttagagggggagtcaagtgcctggcatacagcagatgttcaggaagccattgctattaccggcctctgggtaggttcccctgccagggctggttcagagatgagtcctctgggctttatactcttctggtctcatgaggcagagagacccctggccgctcttgtcaggaggaggccacatgg

SEQ ID NO: 126379 - DNA, 156 bp, Homo sapiens
ggaatatacaggagacctcgttactgcccaccccactacctcctacagacaccaaacagtctgagacagaaagcagtcactcaggaacagacctaatagcagtctctccctgcctgctgaatgcaatacaatgggaacacccggcagagggagggc

SEQ ID NO: 126380 - DNA, 317 bp, Homo sapiens
ctgggattacaggtgcgtgccacctcgactgattaattttttgatatttttgtaaagatgaggtttccctacattgcccgggtctcaaactcttgggcccaaatgacccccctgccttggcctcctgagtagctgggaccacaggggtgagccaccgtgcctggccctatttgtgtaatttgggggtagattgagcagtgggtgggtggttgctgagtggtgtgcaccttctgcagcggggtggggggggcggtggctgcgtccccttctgcagaccgtcctcctctgcattcccagcaacggtgcgtgacacccca

SEQ ID NO: 126381 - DNA, 498 bp, Homo sapiens
gctggaacaaggactcagaccccttcctagcccagagctctacccactctttgctggccttgggtcttgctcctcccagcagatttgggtgttccctccacagtgctccccaagggccttgcacagaccactgtgaaagcatgtaccagaatctgttgtcacaaaatacgcagggttttggagaccagggacctcgtgtcatgtctccggacctacagcttcttctgtaagcctggcccacagaaggcaccaggaaatgttggaaaaaggcaggagaagagggaggggggcagaggaaagagggatggaggagcagcaggggatggcaggggcctccactgtgaggggggtcccccaagacagcctgtcattacagccgagtcagaaggaactgtgacctggttgactgtgagcaggaggtgtctgaatacggttttgtaacaatcatggtaatatagagttcacaaatacactctgctttatccgattcccagtgct

SEQ ID NO: 126382 - DNA, 502 bp, Homo sapiens
ggctggtgggggataaaatgggataatccacagaaagccaccaactaggtgagcaacaaatggtagctgtgattattccctgatctcatgcttattgctgtgtggccttggcaagtgagcggatgcctttaggagatggaggtgataactccagctaccctacaggttgctgtaaaggtgcacatggtcacagaagcaggtccctcatgcttgtgaggctttatggttcccatcactcttcgcatccatggtcacactgtcctcaggcaacccaaggagggaagcagaggactagtatattcccatgttgcagatgtggacactgaggcccagagcagggaagtggctcttccaagaccacacaactaattagcaataagcctcttggtccccatccttgtatcttttcagcccaggggacagatatgggagaaagcctttacaaacccatgtgccccacacatatgcaggtagctgtgtcagcccatctgttccccacagt

SEQ ID NO: 126383 - DNA, 277 bp, Homo sapiens
ggcccagggctccatttccttactgtcttgcctgatccaaggtaagtgtctagaaagaaggatagactccacatcctataggagattctggcagtcttctgtgaatattatttcttgcagctacttttgataaacattacaagtggcccagaattaggatgtaggtccacgaaggcaaaaacttacgttgcatccccactgttgagaacactgcctgacacctggtaggtgctcaatacatatttgtagaatgaatgaattgattctctctggttac

SEQ ID NO: 126384 - DNA, 829 bp, Homo sapiens
atggtatgtcattctatttgttgatgtctacttttgtattcttcagtagtatttaagttgttctttatatagttatagcaatactgagtgtattcttaggtatttcatcttgttgctattataagtgggaaaatttcccccattctgtcttcttgttactggtatatatgagaattcttgatttctttaaattttatgctctggtaccttattgtttgggtcgttttcagtaaattctctttgagtttcccaggtgttatctgcaaataatgatagtttccttcccagtttctatacttttaatttctcttgagtggttgtgttagcgggtactttcagtacataggtaagtactagtgatgatagttcagaatttgaagcattgttccttttaacttccaggcagattcaaaggcattttctttataaatcctttccttcctccaagcttttgggttttgttgtcgtagttcgtttgtttagtcactgatgttcagaaattcacagtgatgttccttggtgtaggttttgagtcataatgatggattaacaggtgaacccctttaatcttggaaacttaacgtccttcagttctgggacatggtcttcattgtttctttaataacttcttgtcctggaattctcatcgtcagatgttagacctttgcaattgattttcaaatattctcttctattttctatctctaattttttttgttctactttctgggcagttatctcaactgcatttttctaaaattaaagttttttttctaattctttgaatttttaaatttctgctatcatatttttattttccaagaacaat

SEQ ID NO: 126385 - DNA, 495 bp, Homo sapiens
catgcccggctaaatttttgtatttttagtagagatggggtttcaccatgttggtcagggtggtcttgaactcctgacctgaggtgatccacccgccttggcctcccaaagtgctggaattacaggtgtgagccacagtgcctggcctttatccatgggttctttattcatggattcaaccaaccatggattaaaaatatttgatgctgggcatggtggctcacaaccgtaattccagaactttgggaggctaaggtgggagtgtggcttgagctcaggagttcgagactagcttaagcaacatagcaagacctcatctctactaaaaataaaaattagctgggtgtggtggtgtgcacctgtagtccaagctacttggaggctgagtcaggagaactgcttgagcctggaagagagaggctgcagtgagctatgaccatgccattgcactccagcccaggcaacagagcgataccctgtctcaaaaaaaaaaaa

SEQ ID NO: 126386 - DNA, 107 bp, Homo sapiens
cccggtccatgctaagtgctctgttggccattatgattcccacatcacacatggagggagtacagtccgggggaaggacttgtctgacgaagcctgacaacacactg

SEQ ID NO: 126387 - DNA, 168 bp, Homo sapiens
gaggctgactgggtgatgagagtcacctctcctggcttccctggaaacgaagctgccactccccatttcttgcttctgctgcaaagaaagctgggcgtcctggggtgctttttgcctttgacctctggtgagacccctaaacctctcagtgaccgggctgtggtggga

SEQ ID NO: 126388 - DNA, 254 bp, Homo sapiens
gctttggtgtgaaaaaattgaaaaatgatccacagaaggttgggaagctggaggtggaaggtacctggacagcaccaaaggttcccttgtgcagacagcaggaagcctagctgtggcactacctatctcttacccaggtttgctttcacacaattcagtctcagtaacaaaagattttaggggagagagtagaggtagacaaagcaggaagaaaaaagaaattcattgaggaaacattttgtaatcaagaatga

SEQ ID NO: 126389 - DNA, 508 bp, Homo sapiens
tgcccggcaaatttttttgtatttttagtagaaacagggtttcaccatatttgctgggctggtctcgaactcctgacctcagtgatccacccccccttggcctcccaaagtgctgggattacaggagtgagctactgcgcctgggccatatttgcttttttactttctcactctgcagatgtatccatataaaacttgttttcctgattcatttggaaaaaagttgtggacatcaggacagtttacccctaaaccttgaagtatgcacaaaccagtacatattcctacatgacacaccaccattattagacccaagaacctcagcactgatgcaattatatcctctagtctatagttcttcttaaatctctctaattgccctatacctgccttttatagattttttaaaaatctaggctctgaagaaacatgttgcaactggttgttatgctaacgttatactagccaaataaaatctggattatccatggttgacagatctttgtta

SEQ ID NO: 126390 - DNA, 380 bp, Homo sapiens
ggggaataggggaatatcaacttaagtctagaatcatttagaaacatacaatattggctgggtgcagtggctcacacctgtaatcccaacactttggagggccaaggcgggtggatcacctgaggtcaggagttcaagaccaacctgaccaacatggtgaaaccccatctctactaaatacaaaaaattagctgggtgtggtggcacgcgcctgtaatcccagctatttgggaggctgaggcaggagaattgcttgaacttggaggcagaggttgcaatgagccgagattgcgccatcgcactatagcctgggcagcaagagcaaaactccatctcaaaaacaaaaaaaagaaacatacagtatgcccatcatataacaa

SEQ ID NO: 126391 - DNA, 591 bp, Homo sapiens
aacggtggctcatgcctgtaatcgcagcacttgggaggctggtggttggaaaattataactatattaaaagaaagacacatggtagaggtgaagatattaaagagagccatcatcctctatggtggaaaatcaataaatgcctataaaaaggaaaattaagatataacaatttagggctgagcacaatggctcatgcttataattcgagcagtttgggaggctgaggcaggtggatcgcttgagtccaggacttcaagaccagcctgggcaacatagggagacctcatctctataaaaaaaaaaaaaaaaattaaaaaaaaaaaaaaaaacaaaacaaaaaaacagttgtggccgcggcccaccgcgcaccgcgaaaaaaaagtttttacaccaccaatcgttgggggggggccgggcccccaagaggggtaatagtgacccacggggccaaacgcggttccccaaggaaaatcgctggcctgaagtaagggtgcgtgtttccacaccaaaaaaaaggccgcggggacaccacgtcgttgtgaacaacccagaggatcagagacacggctaacagagcaacggagcgatat

SEQ ID NO: 126392 - DNA, 352 bp, Homo sapiens
agctgctctgtgcagaggggacaggaggccagacaaaaagatggacaaacacccacgtagattcacacacacacaaacagacacaccacacagaaaaatatgcatggacgccactgagacacgctaacaccacacactcagacacaaacacaccacacacacagactcacacagatacacacagagaaaaatacacatggacgccactgagacacatacactcagagacaggcagtgcgctctgggcaacaggaagcttcctccaaaccagtgaagggcccaggaaagcatgagcggccctgacgtgtatggagggtccaaaggctgcgggaacttgcccgtgagtgacctt

SEQ ID NO: 126393 - DNA, 216 bp, Homo sapiens
ctcttgtggtgagcagtgcactcccgctcgtggccgtggtgtcctctgtccctgcagtgagggctcagcagccgtgcccattgatctacacctgagactgtgcatcaggggagactgtccaggaggccccaggcagagtcacatcaccatcctgatgctgggagtggggctggccctcataattaggtggctcatggtccagggataaagctgctt

SEQ ID NO: 126394 - DNA, 317 bp, Homo sapiens
ccccaggggacggggctggacagtgggtgggaagcagctcacccggcagcctggcctgggagtgcactgggcagggtctgggctgggggagtaggaggctccgtgagcctactgggcagatggctgggagaggcggcccttcaacaggggaccagaggcgacttgtcactggcttttcccagcctgacaagaaagtgcggttgtgaccacaatgttgtacatgtggcccgttccatctggaattctaggaaccacagactctcaaatgtccacactccttctcgagggtgtaattttacatttacaagcacacatga

SEQ ID NO: 126395 - DNA, 515 bp, Homo sapiens
gactatgaccaaaactcttccctcactccaaatgggaaggcggtgacaaaggctttctcaccaccctccagtcccggcttctgcgggggtggggggagtacaaagacccccttctgagctcttggtaaagaagggtaggacgcaagccaggtcctgggggctgacaaatcctgattcatggctcaagtcacacttagctcacacacaaaatgagcgattcagccactccaggctatggggaggaggcttcttcaaatgtgctgtaggtctgttttcaaacagaccaccactgacaggaggtgctgactcagcagcacccctgtgaccactctccttggccaactgtccatgcctttatgtatcctggactgagtcaaacatcattttatccaagttaggggtgagccacaaaaaatgaccagtgggagtcataaatatcttcacatgactctcaccctctacatactgaattatgaaactatggtcagtcagtaggtcgagtcatcacacatcct

SEQ ID NO: 126396 - DNA, 357 bp, Homo sapiens
agagtcttgacttaaagactaagctaaaggaaatactaattattttaccagagtgagtaatttttagataattcagcattagatatatacaaataacttttaatatcaaaagatagaatgtatttcttagtgtctagtagctggatcttagatttttaaaagcatctttgtaattaaaaaaagtattggcgttttcttcttgaaaatgtcttataatttaaaaaaagataaaccagggccaggcatggtagctcactcctgtacttccagcactttgggaggccgaggcaggtggatcacccgaggtcaggagttggagactagcctggccaacatggtgaaaccccacctctactt

SEQ ID NO: 126397 - DNA, 252 bp, Homo sapiens
acaatcaagtgagtgccatccccttaaaatcttcagtgtgagtctaaagaattttcccccaaaggctcccacatctaaaaacagtggccatctcctcttagaattcctagagatgcccagcatggtggctcacacctgtaatcccagctacccaggaggctgaggtggtgggaaagcttgagcccagacattcgaggccagcctgggcaacatagcaaaaccgtatttccgaaaaataaataaggccgggca

SEQ ID NO: 126398 - DNA, 643 bp, Homo sapiens
gataagaacagtacatgtgtgacatgctcatctcaaggcttcacatctgcaggcacgtgatgcccatctgtttcttgttagtgatgttacatgaggccaccagatcaaagggttgtcttatttctccactgtataattactattttatttttcccccttccaactaagaagtgataggtgggaagatatcttaagatcatgcaaatatctgattcctcatcagaatttctctctagatttggaatctattaatgtttcttgccttatccaatctcactatgattgcaaaatgattatttttaaatccctgcattccctccacatttaccagtctgccctcaggaagagccctccctgtcagcaagagccctcccttcttcttatgtctctctctctctcacctatctatctaatgttagtatgaacttatgagttcttaatttttcaatgatttataattaatcatgctagtgctcaaattgtcataggtttggccaggagaagtctcttcaatctgggcacctgtgtctttgtgactcgctcctttttttttttttttttttttttttgagtactttctcactttctgacttaagctgttttaggcacatcttgtatccctcttgcctcaactctggaattg

SEQ ID NO: 126399 - DNA, 292 bp, Homo sapiens
ctaaacctttctcagtgctaaaatcctgatcccatgagctggcattgaagaatggttaagatttggaactctataaacactaaacccttcctctgggaactgctctcctgcccttccagccactactccatccatatggttcccataaaagctgacatctctgcctacagttgatttaagggttggcacctgacctagctgggccaataagaatccttaccctaagaattttgcactggaaatgagaaagagaagacagcttttgtctgggtgatggaaactgaatatatgt

SEQ ID NO: 126400 - DNA, 779 bp, Homo sapiens
  misc_feature (15)..(15): n is a, c, g, or t
  misc_feature (22)..(23): n is a, c, g, or t
gtctgctctagaggntaccctnncaggcttggagcaagactgagctgagggatttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagac

SEQ ID NO: 126401 - DNA, 725 bp, Homo sapiens
tttaccctattgtatcatatttagagcgattaagatactctaaccagggatattgaacagtggagaggcttgcggatcagctagcctaggacgaattaatagagatcggtcgtgactggaagagaccctggccgctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagac

SEQ ID NO: 126402 - DNA, 704 bp, Homo sapiens
  misc_feature (15)..(15): n is a, c, g, or t
  misc_feature (22)..(23): n is a, c, g, or t
gtctgctctagaggntaccctnncaggcttggagcaagactgagctgagggatttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatgggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagac

SEQ ID NO: 126403 - DNA, 217 bp, Homo sapiens
ctgatttctccagagcagcaggaagtccaaatatttatgggaaatttcccaatattccaatcactgtagttgcaacattagacatggcctgcacgctgtcagttctctgtcccaccttaggggccgggtggcaaagagggtctttggtgcaatgctgccaagtctctgtttctgggtctcctgccctgcaccccctccccactgtcctgtctcagca

SEQ ID NO: 126404 - DNA, 565 bp, Homo sapiens
gcaacgtgttgtattacaggtgtgagccactgtacccagcctacaatatgtttttgagtgagatttcatgggttgctttagtgcttatcaggtacatctcaaccaaatcttccttagatttgttactagttttatgccagtcacgcatagaaacattaccactatatggctctactttctcttcctcctttttatgctattattgttatacatattgtatctgttataattattagtataattttgtcttttatagaagggaaaagaaaggagagcaagtatacgtttatagtgttagatgacccttcttatttaccattttttgttctcttcattggttcctatggaatcctgttaccatctggtggtgtttccttagtttggtaaagctttgttcccacccaccactcttctgttactcacagatatatgacatttctatatgttataggtacaatagtacaattacgtacatattttgtgcagttttttaaaatcagctaagaaaacaaatacgcacatatgctgagttttaattagataattacttttactgacacccaga

SEQ ID NO: 126405 - DNA, 166 bp, Homo sapiens
tattttttgtagagctggggtcttgctgtgttgcccaggctggtctcgaactcctggccacaagccaccctcctgcctcagcctcccagagtgctgggattacatccccttcttaccttctctgtcagaggagcccccacagcatgtgagtactgagtcatgcggt

SEQ ID NO: 126406 - DNA, 682 bp, Homo sapiens
atgaagtgtatttaaggaagttaaactatgttgattttaattattaagctgtttctcacatctgccagaatgtaatcttcacatattttgatgttgttggtttacagtcacgtattagtgccaaagtgcaattggccaatcttgtcttcttcagaaaggctctgagagaatttttttctaaagaaaatgcttaattagttcttattgatagtgtacatactctttagctaatcttcttgctgtgaaaatcagcttttagatatacctaaatgagacagtttcgtatatttccacatatccataatattcatgcatgggattagaaaatgtcagagccttgctgttctatattaaagtatattttaattgcccagtaatcaaggaaagttaaattctaattagtatgaacttcgtacctgattcacaggtattttatgataaatctaacttcagtgtttgtctaaaacattttagtatactagaatcacagcatcataggacctgaaagggcaggaaagagtatttagttccactgtcttattttacagatgaagagactggaatccagggctgctaaatgacttatccagggttacacgaaaataacactttcccattgttgacactcatttgtaaggacccttgaagaatgttgagaaaaggcctcttagtaactagtgaa

SEQ ID NO: 126407 - DNA, 761 bp, Homo sapiens
ctacttgacagggaaaaagcccaaacaagacgtagttgtccaattctacatctgttttccttcctagacaggcatgttttagtaaaacagagggaggaaaaacattttattgagacagctaaaaataaacaagtacacgaagagtaaactcctgtgtgtgtgttaaatatcatctacctacattcagtttttaaaatgacgcatccttatatattttacttctttagatgattttgtatgtgacttctttcaaggagaaaaatcgcgtaagcagtttaaattaccgttgcttggctatatttagagttctgttgatgacctttcacattatttaaaaataccacttggaatgtattaaagacatatctcctaaacagcactatttcattaatggttattgatgatgctatatgtttccttttaaagcactcataaataaaactaccaaaaacaatttttggactttccattctattttgtacttcacatttaaagctctctgtgagacttagtagaacttctttgtcagctatttggaacttcagagtagcaggtatgcaccagacattatttttttctccaactttcataaatctaatcatttgatcccatcagaaccaggccagaacatttgtaagtttactttaatcatgaagggtaattatttgaatattaatctgtaaaattaatttgaaaattaatttgccagtctatgcaacttgaaattctcgtagtcttgtaaatagtaaccacagtgaatg

SEQ ID NO: 126408 - DNA, 645 bp, Homo sapiens
gatatataataattagtaaccactggttattttgccgcacacttattctccaaaccactaaccattgcttgggatggaatgcaccaggcctagatatttgccccagatgtcttcccttcagcagtatccaattagagggatttttacaaattaaagcttaattctctataatatatagcaaaatataaattaaggaaggagaaacccgatttccttggttggttccatgggttacggaggtgagggctagtcttcaggtgcacctcttagtttatgcttcagtggctagtggtgactgttctatatcatggtccttggtatttttgctagtctttttggtagcttaaaaacatttcagaggcgaggcatggtggctcatgcctgtaatcccagcactttgggaggccaaggtgggtggatcacctgaggtcaggagtttgagaccaccctggccaacatggcaaaaccccgtctctattaaaaatccaagaattagccaggcatggtggcacgcgcctgtaatctcggctacttgggaggctgagacaggagaatcgcttgaacccgggaggcggaggttgtggtgagctgagatcgcgccactgcactccagcctgggtgacagaggctcaaaaaaaaaaaaaa

SEQ ID NO: 126409 - DNA, 654 bp, Homo sapiens
aataacagggaaggcatttctagaaagaggagagtccataggcttacagtcagggtgacccagccaagggcctgtgtaagcagccagagccgagcctgtgctccccttcacttcccctcttactcagtgtacaacgtggataatcactctctaccaatgcatttcggtttactgggtcagcccacccagccaggctctctcaagactgaccttcttatccactcaataactaagccccaccctcagcttctagggctattcatggcaggagggacttaatggctccaaaccaatgtttctggggtcaattccaagtttcccctgccccgaccactctgctccagtctgaccactcattcgtgactcctgagagctttctcaaacacttagccccttcttggtgaggggatcctgcctcgtattgccattctccttccctgaacccaagccacatcccagcggtgatgcttttacctgctgggcagcatctccaatgttggcagcatctgtgccctgatgcctgcaagtcacctctctgcttttccatctcctagttctctgctaacctgtccacttactgcttccttttcctatcttggaagctcatttctaagatccagtctggaccatggattttcccagccaactacattt

SEQ ID NO: 126410 - DNA, 1099 bp, Homo sapiens
gggaaggaaaagaaaagaaaagaaatcaaagataccaaaaacatgatccatgaaggaaaaggtaaattgggctttattaaaattaaaaacttctgatctgcaaaagacacagttaaggaaacgaagagacaagccacaaactgaaagaacacatttgcaaaacacatgtctgataaaggacttgcatccaaagaatacaaagaactcttcaacctcaacagtaagaaaacaaacacccaactaaaaaatgggcaaatgaatctggaattagacaccagaaaacagacaacccaactaaaaaattggtaaatgaatctggaattaggcaccagaaaacaacccaactaaaaagtgggcaaattaatctggaattaggcaccagaaaaaaaattggcataagatcacccaagaaaatgcagagagcagataagtatatgaaaagatgctcaatgtgacttgtcattaaggaattaatgagatattactacacacttattagaatggccaaaatccaaaacactgacaaatgctggtgaggaggcagggcatgaggaactcacattcgttgctgctaggaatacagaacagtgcatccactttggaaggcactttggcaatttctcacagcgctgaacagtcttaccatatgatccatacaactaaattgaaaacctaagtccacacaatggttgaatcaaacacagaggatttttagggtagtgaaactatgaaaacataaggaatattggacattatgcatttgccaaaatagatagaactttatagttcgaagagtgaaccttgatgtatgcagattttaaaatatcacttaggaagttagcggatcccaaggtggaacgcagactactacaatacaatctaactatattataagtgtgtgaaacatccccactgaagggaataggggaaagaaactgcccaagtaattttgggaatgaggctgttagcgtaaaggcaaacagaactgcatataagcattgtactctaactgacaaagttgttccccagtggggaacaattctgatgttgccatgcatgtatactagaatcaaacaactaattaaatagatggtggatg

SEQ ID NO: 126411 - DNA, 112 bp, Homo sapiens
tcacttttatgtagggactaagccttgagtgcccaaaggcatacagagtgatgcaatgaactttggagactcggaacggggagatggtcaggaaggagtacgattaaaaaaa

SEQ ID NO: 126412 - DNA, 545 bp, Homo sapiens
  misc_feature (19)..(19): n is a, c, g, or t
cgtggtgatctagaggatncctcacgccatgtcacaagccacaggaatctgggcacgctatgagcctctgagtctcacggaccacagagactacaggtcagcatgtgagagcttcatgtaggacccagcacctgctgaacggaggttggatgtgggcatcatcgtggtcgttgagtgtggacaccgagagccttcacacaggatggagggtggatgtggcacctgctgaacggaggttggatgtgggcatcatcgtggtcgttgagtgtggacgccgagaggcttcacacaggacggagggtggatgtggcacctgctgaaccaagggtggatgtgggcatcatcgtggtcgttgagcatggacgccaagagccttcacacaggacagagggtggatgtggcacctgctgaaccgagggtggatgtgggcatcatcgtggtcgttgagcatggatgccgagaggcttcacacatgacggagggtggacgtggcacctactgaaccgagggtggatgtgggcatcattgtggtcgttgagcgtgga

SEQ ID NO: 126413 - DNA, 667 bp, Homo sapiens
gggttgggggtgggggggcatggcaggacaaaaatcaaagctaaaaagggaattctgggagttattcaattccattatctgccctcaggtaagtagcctaaacctgcccagtaaaggaaagccaactcttaagactttcagggaataagaattctgaaaccaacatagctcaacattccacaaaaaataaaaataaaaaacaaaaaaatactgcttcgaggactgttaaaagaaggatgaaactaaataattcaagacttcctacagcaggactccagctcattcacttcattcagaacccaattcaaacagagggtgcgaagttatataatgtcaggctttacattacacaccccactggtatgttcaggctcacaaagatgcaaccaagaactatatgcggttgcaagcacatattacagaaggttttattttaatgttaaggctgatgaatcttgtcctaagcaggtaggacacctcacaagcactgagtctgaagcagtgaagatttttttttctttagtttaacaaactgcttaatcgttcatcaaattaccccatatatcatgaaggccccaaacatagtgaagcttcactagtttttcatttttaagatgtattcaaacatcaagtaatgcacaacttgccaagaatatttgaaaatggt

SEQ ID NO: 126414 - DNA, 743 bp, Homo sapiens
ggcacagaccatgctaagcattagtccatagtctcaaagcacacattctggtagaaaagaaataaatatctatagaaagcaggttaataatggagtcatggagtaatacagaggaaaaagtatctgttagaattttctattcagaaaatagtcaaatgacaaatcatttaagtagaaaggaaagtctatttccacccaccctccccagggggaaaaaaaaaactcttttgaggtagtgtctatagctggcctgaattgtcctacactgtattttgattgatatactgataaagaaaacctcagttgctggtgtaagtgaaaaccactaattatagtgctctcccttctctgtctctaaattggtgataatcaccacacatttatgttaaagtggggcaagataataacatagcaggctgcatctgcgaattttgtgcatgcctcatctccactctgtcctacagaatggagcctaagacctatcaaaatctgggcatgctttggaatgcgaaatgggcaatggatatagagaaaatatattcatattgcaccaccattcctattaatgactcatccatgtagtcaatgatgcaaaatacatgccagacactatgctaagcattggcaacacttttctttttcctcatggagcatccagtttggttggggagatagacattaattatgtgattgaaattataatttctcatttttctctccagcctataaagttaaaactccta

SEQ ID NO: 126415 - DNA, 404 bp, Homo sapiens
tcattttatcagcaacttgtaaggagagtctccagggaataggctgaacctccctcaagccaggccagtggactagtcatgaagagaatggggagggacaaattagcacctgcaccccctttctcaccctccctgtgttcctgcagcacctccctgactctggggtcagctgccacagtgcctggctccactctgtagccagatggctagggctgggaggaggaagagagagaaggggattcgtttgcatccctctacatccttccctctcccccaccagatactcctggcatccaaccccaaacaccactgctgaacaccctctcctccccccagcaccccctccaaacatgacttagaagagtctgaagcagatcttggcagccagtcccctaattctggaa

SEQ ID NO: 126416 - DNA, 587 bp, Homo sapiens
gtatctgttagatctagttggttttatgttgttcaagtctatttccttgttgatatcgtgcgtggtgattctaagcattatttaatatacggtgctaatttctcaataaaacaatttctccctccaattctgtccattgttctttcacggcttattatgtgttcagaaggaataagactttttccctacactcatacaccactcaacacaatagtcactgaagtatgtgggggtttctccacattcacaaccaattctccaggagacaccagttgggtgttttataattcaattataatactatgtatctgctgatttcatgagctcatacaggttaagggctcagccctacaagatcaccccaagtttcgggtgtcaattggtagcagtgggttgtcagttatacttctgaccaatcagctataaatgggggtttgcaggatcatctatctgggtttaatttactaggagggctcacagaactcagggaaacatttatccctttaatatcaaagatattgcaaaggatatagataaacagtgagataaagagatacacagagtgaggtctgaaaaggtcctaagtg

SEQ ID NO: 126417 - DNA, 572 bp, Homo sapiens
tctgcctcctggggctgttatgagggctgaagaaggggcaggcacagaggagacacttactatatgatcattgtcctcctagagtatcatcaccatcaggtggacttcagtggccatcccaggcctccacggatcaaccacaagatcttggagaatgtccttaccctccaagcctcagtttacctttagggtgaccaaccatcctggtttgtccaaaactgagggttttcctggcacagtcccaggcaaactgggatggtgagtcactgatatagtttgactctgtgtccccaccaaatctcaccttgaattttaataatccctaggtgtcaagagcaggaccaagtagagataattgaataatggtggcagtttcccccatgctgttctcatgatagtgagtgagttctcacgagatctgatggttttataagcagcttccccctttgctcagtatcactctccctcctgccgccctgtgaagagctgccttccaccatgattgtaagtttcctgaggcctccccagccacgcagaactgtgagtcaattaaacctcttttctttataaat

SEQ ID NO: 126418 - DNA, 359 bp, Homo sapiens
actatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctgg

SEQ ID NO: 126419 - DNA, 764 bp, Homo sapiens
tgaaatacagaatgtgcttaatatttgcatgttaagaggtcttcattagtaagaaaatcttcagaagctgtaatggacaaaagtataaggaagtattaggaaggaatcgagtttcctgtgagagtaagggtctttgtgacatgcggttgataactctcctccagtcttttattatttcattcctttcatccctttttttctcctggatccctcctatccccttttctcttagagtgcagatgggatgactgtaaagtggaccttttagagtagaccagaataaggagattggatcgagggagatggggaccagaactggtaggttaattatattttgtaacttcccaagctggttctaatgttccagcacagttactggaaaccaaaagaactaaaaacatagatttttttttttttagaagcactccacactctgctgaagttggtaatattataaaagttgtagaattctctgttagtcttccaacctacacctgtcaaatctaccttctttgttttctcttttaaaaattttccttttttttcaccttttttccttctgttcaaacattgtttgcttcaagtgatttttttttataagggaataggaaatataaagtgaatatactcttaagacggatattctttcttttaataaatctctggactgtcgcagttcttatccttttttaaagagaagagtttgctgaagtggttaaagatattttactgaaatttcatcttggtaaaaaaaagacagttaa

SEQ ID NO: 126420 - DNA, 324 bp, Homo sapiens
agatctagaggatcccattaggcgcgttctgcgtcccagaaacacatggagaagcctttgcttctcacctttacagcttccctgagctactccaggtaggcctgactcaggcccctctggtcacgtggtgtgttccacgtgtgcagacccacccaagccactgcacagaacgagccttctctgtgagaccaacacagacttgatgtccaaatggtgcagacgcacccaagccaccacacggaatgagccttcgctgtgagaccaagacagacttggtgtccaaatggtgcagacgcacccaagccaccacacggaatgagcctt

SEQ ID NO: 126421 - DNA, 380 bp, Homo sapiens
gtatggcccaattgttagatttggtagaagacctagttttgatcatcagttctgctgctttctggctgtgcactgtcaggcaattccctgacctctctgggccccagtgtccagtgaatcccaagcctcacaggacattgacgaggatgcggtgagaattctgagattgccagcagacatccccgctgctgcttattagtggtggtgttctacgttaccacttatttttctaaattacaccaaaagctttgagtctttattctggaagtgttactctctgttttagcagtgtttttatagacttaacaacatgaagtgttgcctaagaatgaaatgcaaatcggtacctggtggctctcattgtggctttgcttgtcagc

SEQ ID NO: 126422 - DNA, 367 bp, Homo sapiens
tgtgccattgcccatgcccacctgagggagctgcagtgaggttcttccttaaagagcaggggcagcctgtgaggtcaacagggatagtttggtgacatgggaatgggtttggcctgattagcaaagtttgtgtcgtaaggtgagactcatgtaacatttctggaaaagaagttattgactgttgacatgcttatcaactccactggcccagaggatctctacatccagcttacatcacttactcactgactttggggtttgggtgggtggatggggtggcaattaagcctcctgggaaaaattgggaagctcagtatctcagtaatggttgaggcagcagtgaggctgagcaaaagttaatcagtga

SEQ ID NO: 126423 - DNA, 792 bp, Homo sapiens
ggggcagtcaagtaggctgaggagagagataggaacagtgatgatcatgctggcgattagtactccaggacaccatgctgtttaaaacatgcagaaagctggattatttctggcttgagatcaggtcagggactcaattactcattttgtatagagagacaaatccactgggagttgcagaaaactgcaacttactctcagtaaagtttgccatcacttaaaatgaaagtttttcaaaagtgctccagaaaataagcaagagacagttatttaaaaagtaggaattaggataatatttggagttaacctaaaactctctcctttttgttcccctaagagttgaaaagcactgttttagcagtcaggaaggaaaaatgcattaaaaagtgcttttgtcttaacaatgaaatcactgatatgcttataaaaatctcacttttaaaaaatatataatatgttcagttttttatttataatattttatctgctgatgacttatgtaagaataaaagcatatatttagtacttgtgtttttataaaattaaatttttatttactgctttatgttttaaacatttttatatttgaatgtattaaatagataaattttccaggttaaaaaataagttctgggctgaatgcagtggctcatgcctgtaatcccagcactttgggaggccaaggaaggagaattgcttgaggccaggagttcaagaccaggctgggcaacatagtgagacctcatctttacaaaaaaaatttaaaaaattagccagcatgctggtgtgtgt

SEQ ID NO: 126424 - DNA, 311 bp, Homo sapiens
ataacgtgatacagtaattcactcattttctgcagttaccctcaactctcttttccttctttgcatctacctagcagaaggccaaacaacctagatgaatcaaatctaaacatctccacacccatacctggacacataaatgctcctggataccatcactatacaggcatatctataaatttccggtcacgaaactaagctgggccttctggcaggcttagtgtgattctcccagtctctaataatcatttcagtccaggcacagtggctcacgcctgcaatcccagcactttgggaggccgaggcggacg

SEQ ID NO: 126425 - DNA, 204 bp, Homo sapiens
tcaaggtactctgtggtcaggcccctgctgcccacatcagccccatggggcatccctatcccacttcctgctgtactctagctctttgcaagttcatgctttctctatccagctttggtgcttcacatacactgactgctagcatctctcaggtcccagctggaggtcactttcctgatggccccagttggattaggttccctc

SEQ ID NO: 126426 - DNA, 654 bp, Homo sapiens
gtagacttagccagccatgagaagttgccttttgttgaaggaggtgttttacaaagggaaatagggtgtctcctgggcatcgcattagcaattaaatacatgtatcactgaaatgaaaagaaatgatgaaatgatgaaatgaaatgatgaaatgaaacgaaatgatgaaatgaagaaatgaaataatgagatgaaatgatgatgaaatgaaatgaaatgatgaaatggaatgatgaaatgaaatgatgaagtgatgacatgaaatggtgaaatgaaatgaaatgaaataatgaagtgaaatgaaataatgaagtgaaatgaaatgatgaaatgatgaaatgaaaagatgaaatgatgaggaaatgatatgaaatgatgaaatgatgaaatgaagtgaatgatgaaatgatgaaaaaatgaaattaaatgatgaattgatgaaatgaaacgatgagatgaaaaggtgaaatgaaacgaaataattaaatgaaatgagatgaaaagatgaaatgaaattatgagatgaaatgaaatgatgagatgaagtgaaatgatgaaatgaaatgatgagatgaaatgaaataatgcaatgaaagatgatatgatgagatgaagtgaaatgatgaaatggaatgatgaaatgaaatgatgaaa

SEQ ID NO: 126427 - DNA, 403 bp, Homo sapiens
tttgagcatttgtgggaaaagagaatcaaaagtatgcttccaatagggaatcatggaaagagcacaggctctgagacgtaaatgaccaagttcaaatctcagcttcagctgagcatacttctcttaccataggcttccctaagcctcatttccttatatgtaaaatgatcgccttttagggttattgagatgaaatcacatgttcagcaagtgcctggtatataattctcactcaactaatgctaactcttcctgaatccttcccgaatggcctcacctccctaccctgaccccataactgctagagagctagatattttcatctcttccttgtcatttcttcctccctcactaagacaaagttttgtcttttttgtttgttttgattttgtttggggggcaa

SEQ ID NO: 126428 - DNA, 1182 bp, Homo sapiens
agcgaacccatgaatgtggagtagacctctagtggctgagagagttactgcaacccttaatggtatgaatcttgtttaatgcataactttcacgagcttggctgcactgtattatatattggaagctgaatgtaagtaacatccatcctgacagcagtaacagctgacaacctaaaatcttacagagtcagaagaactacagaatgcattttttaaaaagaccggggctattttgggataaggtaaatccacctgtatacctctttagatcctaaagacatcactgtgtcacaaaaaaatcataattggtgatgttgaaataacaacattaacaatattattattattaacaacaacagcaactaaagggcttttttttttgttctggtgctatattaatcattttacttgcattgacttaattctcacagcacttcaatgagaatggtactgcaattatctctatattacaaggtgaaaacgccagcttagaaaggttaattaacttgcccaaggtcacacgattggaaaattatatgactggaatacaaacccaggccgtgtggctctacctgtgttttagaaatcctctataccacctaataacctccaagccttaggccatgatgaaataaggttcaggaagcccttttactgccacgctgaaattgttaccacttgttggcatttccaacgacattatgacaaccggctgacaaaattgacacacaatggcccattggtcctatgggcaatgaagttcttcgttgcgaatcacgggcatttctccaccgcaattgggccgaaaattacagacacggaacacgaatatatgagattatagtaacccacagaaggaggaagtcagggacgacaagatttacagaaccacttgggcaaaagtcagaaacaaccccgagggagaaaagagacacaccaggaccacaagatccaacggaaagaacaaggagaaataaagagaaaggaaccacaaaaagacacgggcaaaatagcgagcatgaagaagacagcagggggatccagagatagagagacacaaaacaaacgagaagaaaaacagaggcaaagacagccacaaggaggaccaacagagataagcagaccgcgagtgtaaagaaaaaagaagaagacagtagtgggagaacacaagaaaaccaaggg

SEQ ID NO: 126429 - DNA, 271 bp, Homo sapiens
attaccttactgcattgtgaccaaagatagtcttatttctacttttgaggaactgattgacatttttagcaagtcttccaatgtgattaatttctacaaatgttccatgaactgtcagtttataaagcagacaattacacattttacatttttctttctaagaagagaataatgttatttctgtattattggtttcttaagagaaagagacctgtcttgttcattttctaactctaacacctggtattgtatttggtacatagctgttgtt

SEQ ID NO: 126430 - DNA, 806 bp, Homo sapiens
ttatggttctgcaggctgtacaagaagcagatacttatggtgccagtatctgcttctgataagtacctcaggaaactttcaatcatggcagaaggtgaaggaagagcaggtatgtcacatggcaacagaggaagcaagggggggggaggtgccacacttaaacaaccagctcttgagtaaactaatagagcaaaaatgcactcattaccatagggaccacaccaagccattcctgagggataaacccccatgacccaaacacttcccactaggccccacccacctccaacactgcagatcaaatctcaacttgcgatttggagggacacatatccaaactatgtcaaagataatgctgacttcacagaatgaattagtgagtgttctttcctcttcaatgttttgaaaagtctgagatggattggtgttagttcttcttgaaatgttgatagaattcaccagcgaagtcatcaggtccagagatttctttgttgggacattttcgattacaaatgcaatctccctatgagttatgagactatttacattttctatttcttagtagtttagtcttggtaggttttgtgtttctaggatgtgaccatttcatctaggttacccaatttgttggtgtacaattggtttattaatctttttccccaaaaaactagtcaagtgcagtagtaaggataggggaaagagtagaacaagttctatctgtaactgactgtcaacaatcaattaagacaattcactatctccagaccagcctacaattgcttatcgtagtctattataatctcttt

SEQ ID NO: 126431 - DNA, 260 bp, Homo sapiens
gggagggaggcatgagggcttggaaggacagaaagagccagcaggcgggagcatggcagaagagggacaatgacaccaaggacactgctgaggtaggcaggagccagaccacatctggaacttggttcctgaggggctttaggcaaggccatgaagtagcagccgtgcattttcaaaggtgactgtggcggccgggcacagcagtgctgggaaggggcaagttaggaggctcctgtgaagttcaggtgccaagatggtgg

SEQ ID NO: 126432 - DNA, 330 bp, Homo sapiens
aggaggacctaaaggggtccacttgtgtgaccatggtagagccaggaaatcccatcaacctagaaagtaaaaaatgggagttttcctcagtcaccaccttgtgatcatacttctcccaaacaccatgcctttcccttctcctcagctcagctactcctttaacaagtttctatatctgaaccattttcccctgatctcttcattttcaaaggcctttatctttatcctttaaatccaatttgttctgaatgcctgggaaccaaaaaagctttaaggaatgctttctcggccggacacagtggctcacacctgtaatcccagcactttggg

SEQ ID NO: 126433 - DNA, 404 bp, Homo sapiens
tcttgcctcccagtgtgacttgtaatttttaattgaaagctggatatgatgtatttggcaatgggaagtgagggaaatatgtttttagtgtgagggtttatgttaatctttctcagagttgggctgtttaatgttttgctgtggtctgaatgttccttaaaacttgtgtgttgaaacttaattattattgtcatggtattaagaggtggggcctttgggaagtgattaagacatgaaggctccacattcatgagtggattcatgctttttaaaaggactggaggaaagtagtgtaggctatttttttgcccttgtgccttccaccatgtgaagatatagcattagcccctcctgccatgtaaagactcaggaagaaggccctcagctggacatggtggtgcatg

SEQ ID NO: 126434 - DNA, 314 bp, Homo sapiens
ctgcacgcttagaggatcccgtctgagcagctgggaactcagcttagcttgcgtggttttagaagagctcttgactttctttgagagtacgtggcagtagcagatggaagtgctgtcacttttcaggaaactctgaccagtgcattaatttataataggtaaaggagggatagagcctttttggaattaattttaacaactgtatttgcttattttaagaaatacaacatcactgtcttcagtagttgagtaactgccacactaactggaggctgtgggcgccctgtcaaccgccccttcccagcttgctcaga

SEQ ID NO: 126435 - DNA, 315 bp, Homo sapiens
aagaccaactcgtacatcttttatgagaaaactcctaccacttacattagcattttgcagatgctatatctcaatgcttgtcctaatttccagcatcccaccccaaacataggaaatatatctgacaaaacaatcaccatacgttaatgcaacatgctgagcgcaaaggttgcaccctataggatttatttagatgatactcttgtaaaagcaaaactatagggacaaaaaaaacagatgagtagtttccaggggctgcgagctgggaaggatttgacgacaaaaggaaggaagagaatttggaggccgatggat

SEQ ID NO: 126436 - DNA, 435 bp, Homo sapiens
aagtctgactctagagtatcccccctaacaggcggagccaaaataagattagaactaaaatactggacaacaatgacaaaggggaggagatgaaagttaaagtcttgtattgtttgcaggggagtggttagatgctgattaactttagactttgttcatttaactacatgttaaactttcaaggtaacctctacagaaacaggacatataactttcaaacccaaaatgtggagaaaaaaaaaaggtgcttaaagaaattaaacacaaaattagctggacatggtggcatgcacctgtagtcctagctgtacagggggctgaggcaggaggattggctgagcccaggaggctgagctgcaatgagctatgactgtatcactgcactccagcctgggagatagtgggagaccctgtctcagaaagaagagagagaaa

SEQ ID NO: 126437 - DNA, 510 bp, Homo sapiens
agcctttattagtcaaatcagccaagcagtttttcaggctcttagtattcagtgaaaactttatatcctttacggtcctccatcttcaagaaaagtagaacggactaaaggtcttttaaaaacacacctcaccaagctcagccaccaacttaaaaaggactggacaatacttttaccactttcgcatctcagaattcaggcctgtcctcagaatgctacaaggtacaccccatttaagttcctgtatagacgctcctttttattaggccccagtctcattccagacaccagaccaacttagactgtgccccaaaaaacttgtcatccctactatcttctgtctagtcatactcctattcacggttctcaactactcatacctgccctgctcttgtttacactgtttctccaagccatcacagctgatatctcctggtgctatccccaaaccgccactctaaactcttgaagtaaataaatagtctttgctggtgggaagctgaaacccct

SEQ ID NO: 126438 - DNA, 368 bp, Homo sapiens
tatccccagggacaacagtacgccctttcttttctcttgccgcagttttttacagaagctgtattttttatcataaaaggaggggaagctgccattcaaaattgctgttattttcctattctgtttctctggataaaacaagacttctaaactaacaaaggacaataatcagtgcggaggcaacatacgctgaaataaggaaatgctgaaaactaacattcaccacgccacacataaaaagcagctgaaactcaacgtgaaagctaaacctcaagatatgacttcacacagctataacgggaaacataaaagcaacttgggatttcctctatttgaagggatgcatttccgcttactttgtactttcc

SEQ ID NO: 126439 - DNA, 425 bp, Homo sapiens
tgtgttataaaacctataatgcattattatttttgctttaagcaactatctttttaaagctactatttctttaattcacaatgttgtgcaaccatcaccactaactgcagaacatttccatcgtgcaaaaagggaaatcctgtacctgttagcaatcaccttcaatgcagtcatcttttaaagagaataaaatggaaaaaaaattcttatgtttactcccagttaccatttctagcacttttcaatcctttgtgaagatctaaatttccattttaaaccatttgccttctgcctgaataacttcaacacttcttgtgcaggtctgctggcaacaagttccagtaggcctttttttttttttttgggaaacggggtccccccttatcccccaggaaaaggggcgggggggcccattaagggccaag

SEQ ID NO: 126440 - DNA, 370 bp, Homo sapiens
cctgaacaggctgagttcctgagggcagcacatccttgctcattccccaggccctggtacctaggacggcactgggcacgggcttggaatacataggtggatagatgaggcagtggctgggtgaaccagtcttcactcagggacacaccatttcatggggcaccttgggtgtcacccacctgtgctgctgtacttaaagcgcacaagccatgtgaggccacctcattcctgagcagtacggtctggggcctggatttgatgggctccactttctcaccactcccacccgcaacccatctgctctcagtactgcaggagccatgatggtttcaggcattcctgctgatctgcccgaaccattagcgaaggc

SEQ ID NO: 126441 - DNA, 486 bp, Homo sapiens
catcctcccagagccggaacacaggagcctgccccgctccacctcttccaagctgcatggacttgaccaagcacctttacttccccatttcctcctatctaggatggagataataaaacctcctccctgcaaaccaccatctcagaaggctgtagtgagaatcaagcaagacaataatggagaaacttctttgaaaacagtgaggtgccagtcaaatctaagggcttctgagagggcagcagtaaataggtattgcacacggcagctcctgggggcccactgggagccactcaccacgagcatggtgcacgtgcctgtgagcagggcagacagagtggctgcaacacaggcttctttccttcggtattttttataaaggggaatcgggtgaaggaaatgtctttggaatagacaatcttcctaaactcccccaaaataacttcagtggaaacaattgtaacgtccactctgccggcattgtttcag

SEQ ID NO: 126442 - DNA, 395 bp, Homo sapiens
gttttgtaccctagtgatgttagtgatgctttctagtacagaaagtcaatttgttttgactacatacaataaatactacatatctgaaaaaagctaccaagttgggggaaaggggactgtttttcgtcatgtgaataacaacaagcgaactgactactagggtctaaatgtttgtgctctcctcgccccccgattatgttgaaagctaacacccagtgtgatggtgttaggaggtggggcctctgggaggtgatgaggtcatgagggtggacatgtcatgagtgggattagtgcccttacacccgagagagcaaggtgaggacacagcaagaaggggccatcgatgagccgaaaagtggaccctcatgggacaatgaatctgccatcacctttat

SEQ ID NO: 126443 - DNA, 417 bp, Homo sapiens
ttttactgtagttcaggaaatagaaatgtaacatggtcagtggcattggctatcttcctactgacctagagaataactactttcccaagggtgtcatcagatatgaatgtgccaggctaagctaagatcctgtgcctaccaaaactgttatgtggcattaatcatttctgaaagtgtaagtagatctttcagccaggacaagtgccaactgacccaagtgccaataccttttgaaggagtctatgaaaagtattaaaattcaagtggtcactgatgaaactccaaataaagccagcatgaaaagtctttaaaatttaccagtacttcctacaggcaggaaaaagaatgttcaaacctgcaagaaaatgcttttctattttgtttttattttttaaggtacaagtgacaaacgtattc

SEQ ID NO: 126444 - DNA, 392 bp, Homo sapiens
gtagtcccagatacttgggagggtaaggcagaagaatcgcttcaacctgggaggcagaggttgcagtgagccaaaatcacgccactgcactccagcctgggtgacagagcgagactctgtctaaaaaaaaaaaaaaaaaagaagtggcagctctgtctgcttctcacagagttgctagggacaactgctgaggcaggcacctgccctcgggctccccgggtgggctgctatttgcctgtgggctctgcctgcccgcctgtccagtccccagggatctgaactgtgacctcccccttgctcttcttgccctttgcattgcctggcttggcctcattaatgtccccaaatctgtgttcttctctccagctcctctggcaacccctgaccccctt

SEQ ID NO: 126445 - DNA, 167 bp, Homo sapiens
gggctgactcagctcatgaggactgttttccacacccctatgattttatctccaaccaataagcagcaaccactgcttagcccctcccaggcaaattatccatgaaaaccctagcttccaagctttcagggagactgatctgagtaataaactcctatctcctgctt

SEQ ID NO: 126446 - DNA, 470 bp, Homo sapiens
ggcacaactggaatcctgaactctcccttccccaccattctggggattcccttcacttttcccttgtgatcagtgtcctgttttctacatcctatgacttttcatttctaggtatgtttctgtgttggggtgaggcatatccgccaatggctcctgagaaacggcttccttctgaagcatagaagcaacttatatgaacataatctcattttttttctaatttggcttgtaaagagtagagatctatttggagtctaaaccaaagaattgtgatttgaggaaggcctttttttgggaatctaagttaatattctaggatgtcacttgtgggcaacttaatttgataccagcagtctgagttagtggaaagggtagagggcttggcaacagaaaactcatttaaatttcccagttttgacacttgctagccagggaatttgagtcctgtaatctcatgagcctctgtttct

SEQ ID NO: 126447 - DNA, 636 bp, Homo sapiens
gaagtctgtggttagagaaataagtctgaatttcttacttggaaaatttatatcaaagatcatgggaacaggggcaacgacagggccatttaatcctccctaacactttctgtggattcatgaatgtaggagaggcccaaagcttctgctatgattttcttcagtcaaattcctaagcaagctaaagattatagcaatgcagaggaattcataaggataatgagagggggaaaaaagaaaacaaatggaaatagcgcaagcagacattggaaagtaatttgaagtaggagagtttggagctaatagttttactttgcattattgaatttctcccatacatagtaatgacagtgtccatgaatggtgaaaatgtgtgtgtagtatgtgtgtgtgtctgtggtgtgtaggaaggaaacgtacagagagagagaaggagaaaaagagaaaaatagggagggagagagagagagaggaggagagagagacagagagaaagaaaagcaagggaaagactaaagttgagaaagcattagaaagcccaagataacatgtgcacacgtgctcagatactagggctgaaattctcagggccagcttcttgctttatggtgaaagccaaatcagctagagtatttt

SEQ ID NO: 126448 - DNA, 622 bp, Homo sapiens
tatggagggtttttttttttgtaagactattcaggaaagtaaggaagacaggaaaccgtctcaactgctgcacagccagaccccatagagatctggaatgacattcaggatgttacaaacatgcaaacagtgtcagtgtctgtttttattcattacttcatccctgcacctatgcttgtcacacagtgagcgcccaagcattaatttcatgatggatttccgatgctctaccccatctatctgctctttcctgtattcccagcctacattctgtctgcagcatggcttctgtttacttacacagcctttgctgcctcatggtttctgcttacttacctctctttgtatattgtttctttttcatgccatcacgctgtgtggggattgcatgtatctcattcaaatacccaaagagaaaaactgtgattagatagaccactctccaatgtggagccccagctcatagtgaaatgattgggcttctgttgttgccttgaggtcagggacctagccatggtctggttgtctgtggccaactagcagggccatggatgtaaaggatggtcttgcttataagaggaaagcggttatgacaaacacttagaatggtgttcccataatt

SEQ ID NO: 126449 - DNA, 284 bp, Homo sapiens
aagacatccagttttaaatgtatgtaaaaatgtgcttatagaattagtcagtggcaggggatggggtgatgttgctaaatggacactaggcagaagagataaagctatttaatgtgcctgttaactatatgaattctgtaacttgtgtgttgcattgagagtgatggctggcccattgccgtgactcatgcccagtcccaacacctagggaggctgaggtagaaagatcactgaaggccaggagtttgaagccagcctgggacgcttagtgagatctcgtctct

SEQ ID NO: 126450 - DNA, 329 bp, Homo sapiens
ccctagtagctgagattacaggcgcacaccaccacgcctggctaatttttgtatttttagtagagatggggtttcaccatgttggccaggctgctcacaaactgctgacctctcgacctgcccgcctcagcctctcaaagtgttgggattacaggtgtgagccactgcgcccggccatgccagagaactttagacatgcccttagatgtgtgcgtgtgattaatggattttgtttgtttgtttgtttttttagagatagtgtctttctctgttacccaggccagagtgcggtggtgtaatcatggctcaccacagccttaaacctccca

SEQ ID NO: 126451 - DNA, 731 bp, Homo sapiens
gttgcccgagctggagcgcagtggtacaatcgtagctcactgtaacctgcaactcctgggcccaaacaatctttcttcctcagcctgttgggtagctgggaccataggcaggcccagctaatttttaatttttttgtagagacaaggtctcactgtattgcccagcttagtcttgaactcctggcctcaagccatcctcctgcctcagcctcccaaagtgctgggattacagacatgagccactgtgcccagcccctgttttctttttgagtagttttctttttctttcttttgtggctggttcaataagagggtctccttttcctaagcaggcaaaggattttttaaaccagtttggagccctaaggaggagtcccaggggaaaaagagaggcttacattgatctagcccagttctcaaggcatcaaagctttttagtaataaagagatttgtggaggaaagggaaaatgattttttttattgttggaacaaaaaacggtctgcttaaacccaataatttgtctgtgtttaccgcaaccatctctgtggcttacaagaatgagttcatgactgtctgaattccaccaggcagtggtgacaataatttattttttaaccttgtgggaacttcacatgggctgactcccctttgaccccgcacccatcacaagatgattttttcctagaagttgcctctggggctgggcttctggagatgaaccccattctc

SEQ ID NO: 126452 - DNA, 114 bp, Homo sapiens
tgaaacaatcttgtgtctactggaacctgaaagaccttttccttgagagaatagaaaagaacagttccttgctgaagggaaacaaagaaaacagtataactgcttaaatagaaa

SEQ ID NO: 126453 - DNA, 239 bp, Homo sapiens
tgtatacgcgtggagcagtgaggggcctctggtcttcatagcatttgttctctactggtcaggtcccaggggagcattacagcctctgctggcagccactgaaaaccagaaagcaagcagaaaaggatatcgaggtgatgagaggccgtgggactaacagctgaaggtgtttcaggcatcagagaggcagccacacaggagggggatcagcagggctcagtgtgacccagagagatgag

SEQ ID NO: 126454 - DNA, 334 bp, Homo sapiens
gaatagtaaggattgattgtatggattgaattgtgtccctctaaagttcatatattgaagttgtaacctcccagtacctcagaatatgactttatttggagagagggtctttacaaaggtaatcaagtttaaatgaagtcattagagcaggtcgaaatccaatatgactggtgtccttataagaaggggaaatatggaaacagacacacatatagggaagatgatgtgaagagacatagggagaagatggccaactacaagccaaggatagaggcctggaaacagatccttctttcacagccctcagacggaactatctctgctgatgttgatt

SEQ ID NO: 126455 - DNA, 479 bp, Homo sapiens
tattgaaggtggggcctaatgggaggtgtttggatcatgaggacagatccctcttgaataaattaattctgtctcttggaggtgagttcttactcagttcccatgagagctggttgtcacaaagagctggtatctccccatcttcttgcttcctctctctccatgtgatctctgcacatgccagctctccttcaccttctaccatgagtggacacagcctgagggcctcaccagaagctgaatagatgctggcaccaggcttcctgtatagcccgcagaaccatgagctaaacagacctcttttcttaataaattacccagcctcaggtattcctttatagccacacaaaatggactaagacaccctatcactggagtccactcagactaccaggtgagataaatccaggagcttccaggttctttgttcttgattctggcaatgggtccaaataaaagacaatgaaaggatatgctat

SEQ ID NO: 126456 - DNA, 736 bp, Homo sapiens
ggagaaccagcccaagtctcaaaactgagcaacttgggagtcctatgttcgaaggcaggaagcatccatcatgggagaaagatgcaggctgggaggctaggctcgtctctccttttcacatttttctgcctgctttatattcgctggaagctgattagattgtgcccaccagattaaggctggatctgccttcctcagaccactaactcaaatgttaatctcttttggcaacacacacacaggcacacccaggattaatactttgtatcccccaatccaattaagttgacactcggtattaaccatcacaccatctaacagctctttcagcttcccctggctccctccccattttctcttacagatatttcccctactaaatttcttgtatttctaaccctgtcttggtgtctgcttctcagacacagctgtattcttaagacatccctttaagatcatcctgggaatttccttcactttttcttttgggagacctcttatttctggatcccaggtcttcatcattcttggtttacttcctttattggtggactacatcctccacatgggaggtaaattgttgaaaccttgcatgactgaaaactttattttaatctcaccctcaagggatgatttggctaggtatggaattctagtttggaaataatttgctctcagaattttaaacacattctccattgcctcatagttttggcgtaaatgttgagaaatacaa

SEQ ID NO: 126457 - DNA, 454 bp, Homo sapiens
ttaggaaatatcactccttgccaggtgctggtggctcacgcctgtaatcccagcactttgagaggccaaggtgggcagatcacgaggtcaggagatcgagtggctaacatgctgaaatctcgtctctgctaaaaatacaaaaaattagccaggcgtggtgacgggcgcctgtagtgccagctactcaggaggctgaggcaggagaatggtatgaacccgggaggcggagcttgcagcgagccgagatcgcaagactgcactccagcctttatcgcttcttactcctacctaaccaccatacacattacaagtgatgatatgaaaatccaagatacattacttagaataagatatgaatataaatatagtcattcttatgttcaaaaaaatgtatcggggtaatcattttcctggaagaatatacacagccaactgctagtattagtcatctctg

SEQ ID NO: 126458 - DNA, 337 bp, Homo sapiens
aactatgtgatctaacattgtaacagaaggtccagaaagaacagaaaaaatacaggacattacctaataaataaaacaaaaaaaatgccaaagactgaaagacaccaatccccagactgaaaggatctaaagggtacaaagcacagtaaaaaagttacatgtcaaggtatattatattgaagtttcagaatatcacacaaaaaaaggaagtttataaaatattcaaagagggaaaatgttataaacaaacggcaagaaatcaaaatggctttggacttctcaatagcacaggacatggactcatgacttcaaatctctgacggaaatgctctcaggc

SEQ ID NO: 126459 - DNA, 197 bp, Homo sapiens
cacacaaacatcctccaggatagaccacaggctaggacataaaaaatcctcaataaaatttgaaaagaaatacagaagctgggcgcggtggctcatgcctgtaatcccagcacttcggtaggccgaggccagtagatcatgaggtcaggagtttgagaccagcctggccaccttgatgaaaccccatctctactaaa

SEQ ID NO: 126460 - DNA, 234 bp, Homo sapiens
gtgtttagcagtgaacaagtcccagtgcttgcctttcttaatctcagggtgcagaagagttaaaatcagatgccagagtggctcatttctgtaatcccagcactttgggaggctgaggcaggtggatcgcttgaactcctgcttcggcctcccaaagtgctgggattacaggcgtgagccactgagcccaactttttaatcacacagattctagtagctgatgccatgtgtctg

SEQ ID NO: 126461 - DNA, 702 bp, Homo sapiens
ggcagacaaatgttctcaggcctatttttctactttccaaattcctttcctggctcagcaccttgctgcggccttagcccatctttctgcagctagttaacgaatccttgcctacgggtagacagaaaggtggtttttcctgttacatcttccccatccctccctgggaagcttcaatttcagatgtactttcaaatttcaagacccaaagaaataaatgtttaatgtggaatgacagacaatactttgatatttgtggggaagggtcctcgctcagcactcctccagtatcagttctagacagatcttggagaagagaagaaactcagcttgttcaagtggctcatcctataggaaatactttctccggcttatttctctgtgcctccttaaaatcaatctatgatatgccaaatattaacaaggaaaaaattatctccgaagaagacactgacaattttgcctgtgccctcctcagtcagaggcaatgtggggtgtagggagcatcgtagaactgtcagcgagttaagggataaacatgttgagatagattggattaaacagcattgttccaattaatcatgctgaatttagggccaggagacattagattctgctcttgattttgacatttacattctctgtgaccttgagcaggccatttcacgtgtttggttgcagttttttcatatgtaaagggct

SEQ ID NO: 126462 - DNA, 433 bp, Homo sapiens
tgctaagacaatatagttatgttgcttggatacagctatgtcatcaaagcaactgctagttactccttttggcttaagagcacaacaaaactcctcagacaccaagggcactatataccaggaaggcttgtgaacctctgtcctagcgagttattttatgtggtagtttccactctaagatacaaaggtgaaagctgttcaaggtaatgttttatggaaaatgtagcacttttttttttttttttgggtggtgcggagaaggagtctcactctgtcgcccaggctagagtgcagtggcgctatctggcttactgcaacctctgcctttcatgttcaagcaattctcccgcctcagccatcctagtagctgggatcacaggtgtgcaccaccatgcccagctaatttttacatttttagtagagacgggatttc

SEQ ID NO: 126463 - DNA, 197 bp, Homo sapiens
cccaaacagaagctccctgagatcaggatcctcgtcagcagtctgttgtattcccagtgtgtagaacagtgcctggcacatagtcataataaaaatagctaatctttatatatgcttatgatgcattaatatcagataccgttctaagcactttaccctcattaactcattgaatcctctcagcagctctgtgttat

SEQ ID NO: 126464 - DNA, 280 bp, Homo sapiens
cccttaaacccctgccacacctgcccccacaaaatccccatcctggatcgctctaagcaactatttttgcacttctacgtcagcctgccaagcactgcaaaagaaagtcgcacagttgtttaggtaggtgggggccatgacaaaaatcacaatctccagcctcaggtggatgcacggtcagtgctgcccacaagtccttctccaggccctagccagcaacctcccgttcccctgccaagttatctatttcaagctgtcttcacggtcctcaggctcccac

SEQ ID NO: 126465 - DNA, 347 bp, Homo sapiens
tcgatttagaggatcccctgggctggggaagagggctggcctgggagagggctgggctggggaagagggctgggctggggaagagggctggctggggacgaggggagataggttttgctgagtcttcttgctctctttctcttcctgtgtcagatgcttgtttcctctcctcaggaaggacatcagattctatgttcttcagccttggaatctgggacttaaaccagcagccttctgggggccctagggcctttggcttcagactgagggctgcactgttggcttctctggttttgaggttctcagacttggactgagtcatactactgtcctctctccctccccag

SEQ ID NO: 126466 - DNA, 351 bp, Homo sapiens
caaaggacacagtgaggctaaggtgacatccaaagagctatccacccatggctgccagcactcacgaacagcaggggcagctgaaggcaagggagacactctggagtgactccagcccaccagatggaaagcagggcagcctgagtctagacattaaactttctcactttcagacaagtgttgtgttactacagcatagtttttaatgtgagtcacaagataattgtaaaaaacaaaaaccaatgattatctaaatagacacagaaaaagcttttgataaaattcaacacgcctttgcattaaaaactctcaataaactacatattgaaagaacattcttcaaaataataa

SEQ ID NO: 126467 - DNA, 107 bp, Homo sapiens
cccgtaagtgtccattagtgtggaatgatgaagtaggagagtgttaaaaattgcaaatattagggaatttctttctctgtggcttaattacaagaccagcagtgata

SEQ ID NO: 126468 - DNA, 149 bp, Homo sapiens
atatctgagcaagtatcccccagggcttcacgtgactctcacatagccttgtcctcctcctcctctgctgtccgcagccctgggtggagggcctgcagtggggagcttgtcctgcatcagcacctcagaggggcagtattccctcatcc

SEQ ID NO: 126469 - DNA, 816 bp, Homo sapiens
gttactgtaatcaatactataggcaattataacacagtggtacttgtgtatctcaaatgtgaacacagaagaggtactgtcaaaatacagtataaaagacagaaaatggtgcacttgtatagggcacgtctcgtgaatggagcctgcgtactggaagtgtctctgggtgagtcagtgaatgagtaatgagtaaatgtgaaggcctagtacattactgcacattactgtaggctttataaacatggaacacttaggcaacactaaatttattttaaaaaattgagttatggcggctatgatgtcactccgtgataggaatttttccactccattataatcttatgggaccaccatagtataaaatgtcattatgctgcatgtgacagtagtctgttcctgttttttgtttgtttgtttgtttgttttgttttttttgttttttttgacagagtctcactcggttgcccaggctggagtgcagtggcacgatcttggctcactgcagcctccgcctcccgggttcaagcgattctcatgcctcaacctcctgagtagctgggattacagacatgtaccaccatgcccagctaatttttgtatttttagtagagacggggttttaccatgttggccaggcaggtgttgaactcctgtcctcaggtgatccgcccacctcagcttcccaaagtgtaggctgtttctttttgttgttgagtagtattccattttaggaagtactgcagtatgttcattcatttgatgggacatttgggttcttctcatttttttggcaatgtgaataaagtcactatgaac

SEQ ID NO: 126470 - DNA, 709 bp, Homo sapiens
gcacacaacgaaggagaggaagaagggaggaaggcacttcacaagcagagctgagccagcagggcagcaaggcagaaagggactgagattgtacctggaagtatcccagtggctggatattcaagatcattatgtccatgccagagaaatcaagttataccaccacttcttggccttttgcctaagatcaagtgtagaaatcaagttaaaccaaaccaagtgaggatttcagttatttctctgaaaagctggaagtagtctctttgaaaaccagtacaagataaggatgccctttctttccactcctattcaacatagtattagaagttctggccaggacaatcaggcaagagaaagaaataaagggtatttaattaggaagagaggaagtctagttgtctctgtttgcagacgacatgattgtatatttagaaagccccatcatctcagcccaaaaacttcttgaactgataagcaacttcatcaaagtctcaggatctaaaatcaatgtgcaagaatcacaaggatttatttacatcaacaataggcaagcagaaagccaaatcataggtgaactcccatttataattgctacagagagaataaagtacctaagaatacagctaaaaagggacatgaaggacctcttcagggagaactacaaaacactggtcaaagatataagagaggacacaaagaaatggaaaaa

SEQ ID NO: 126471 - DNA, 489 bp, Homo sapiens
aagcaaacttggggctataaacagttaacatgtgtccacatggaaagagtctgtatgagaaaaaatccaggcagaggcaaatggaaccaaaaatgaaaaatcaaagcaaagccctggtgacactgaagttctgaaccagccatacctgaatccagtaagattatcacctttagattttccagttgtatcagttatattaagcaacaaattccttttgttgctgtatgcttccgatctaacctgtgaaaggtggataataatactacctaccttgtagcatgtagcaaggactacgttaaataatatgtacaaaacaaagcagagaaacgtatcaggtagctgttgctgcataacaaactattacaccttcaaatttgtgttaaaacaatcattcactgagatcacaattctgcatgttgtctggctgtttgggttgggttctgtttggtggttattcccatctcagctctgctcactcatgcatcttgg

SEQ ID NO: 126472 - DNA, 359 bp, Homo sapiens
aagcaatctgcctgccttggcctcccaaagtgctaggattgcaggcctcagccaccataccctgcccccgataccttcttttgatgacagcagtcaccaattcagaaaggaaagaaggctctgccaagagtgcctgtaacatgagctgagacgataagaagttggggaaaggtgggagacagcaaagagctaatggcaagataggcaactggttttttgtaaatgatgaaataaacataaaaaataacagtcatgttaatacatatataggaaaaaagaatgaggtccaaattatagagattgaatctgtagggtataattaggggaaacttctacttactaagatttccttaaaaagg

SEQ ID NO: 126473 - DNA, 713 bp, Homo sapiens
tatgactagtctaatagcttaaaacacatatatatccaaagtgtgataattcattgcagtaattccttcatgtcattttgatacaagttgccagcccttactctataggattaagaacaatccagaaaaatcagaagagctatgtatctagatagcctctgaccttgacagagggaagacatttatctgatacaatgatcagtgtaataggtagcttgtcctcattgaagctttaagaacactgaattgtacataaaggagagtcgtggtcttaactatgctgcatatgtgagtgtctgtgaaagtgtgtaggctttctttcttagctgtaaaaccacacattagaggacacgatagtgttggctaaaaagccaactgcctaatatttcttttctaatgagatacagtgttgggtttttctttctaatttatgcaaacggaatatgtttttttaatacttcatggagccttaagttctttttttagcaagttgtaatttgaagaatgccaagtgcttgggctccccccattttttgtttttcttgattacccatcccactcataactgttcctcctcttctctttcttttttttctcttcttcctcttcttcctcacgtgcctccctagctgcttccctgattctttccttccccttcccctctttttctccctttccttactcctttcctgccttcctgccttgtatgcctt

SEQ ID NO: 126474 - DNA, 278 bp, Homo sapiens
aattttactgacttaacaagaaaaagataaaagagggatgggcaaaaaggagatgaaaattctgattcttatccatcttccttggtagaacacttactttgctgaagaaatgtgatataacaccaactcagctggttttagcagcaacaaaataaaggaaaaataatcaaaatacaaacaaaagccaaacccaaggtttgcctttggaatatgaaagcatatatgcaaacaatatttcatgtggaggttttggccttaaaatgaatcacatgaaggtg

SEQ ID NO: 126475 - DNA, 745 bp, Homo sapiens
gattaatgcccttgacgtgaactctacaagtaatcaaggttcaaaccttgtgatttctagtttttaggataatagcatccaccaggagaattcacatgaactctgtttcctaatgaccagtctgtcctaccatcacttcccctgaccagaggccaaactgtttttcacagattagactcaaccatagggaacaagctggaaactcaatatagtcttcttattaccaataatatcatcctcatcataaaggacagaacctttctgtctgtttggcctacttacctagcacaacaaaatagtttagatttttaaaattttcattttgctgaagtattctcatcagaatcattatttcattattttccataggaaatttttttcatgcaaaccaacaacttgcaattttccatgtaacatttttaattcttatttatttatcgttttttgttcataccaaccaattatactgtctgcaattggaaatttacttttttttttcgagacagagactctgtcgcccaggctggagtgcagtggcgcgctctctgctcactgcaatcctgcctcagcctcaaaagtagctggaatcacaggcgcacgccaacacccctggctaatttttgtatttttagtagagacagggtttcaccatgttggccaggctggtggtgaactcctgacctcaggtgatccacccacctcagtctcccaaagtgctgggattacaggcatgaaccaccatgcc

SEQ ID NO: 126476 - DNA, 658 bp, Homo sapiens
cgccacacacccctgcactgtgtttcctcaacaaccaagcctgggaacattcccaaaagggtccaggaagcagctcactcagcagacgtttggtgatttcagaaaacaaaagggtcggcaggtcacgtccatcagctccctgaagagtcctccaggatcacgcctgctgcgtggcttggcacaacctgcatcacgacaacacggactttccatctttactgtccttttgatcacttctgcagggggatagctcaacttacaaaccacgtaaatattttcctttcggcaccaaactttcccctggggagctggaagcccagctggggtctttttgtctctggcctccgggtccagggctgacctgggataggagcatttgtaccagcctcccggagttgcagtgagaggtaccggcaggtttcagggacaggaggctgttaggactgccacccaccacatctggtgtgagggaccacaggatggaagaaggcagatatgcggagttctgaggcaggttatgtgggcccttggagttgctgaaccaaagtacacctgcaatcataaagccaattaagatgtttgttaaagaggctgggcatggggccgggcacggtggttcacgcctataatcccagcactttaggaggccgaggtgggt

SEQ ID NO: 126477 - DNA, 331 bp, Homo sapiens
actgcaccctagaccttggaaaatcttatggcttacactaaaactaatcagccacttttaaacagaaagacgtttaaagaaatcactagaataggctgggcacggtggatcacacctgtaatcccagcactttgggaggcagaggtgggtggatcacctgaggtcaggagttcgagaccagcctggccaacatggcgaaaccccgtctctaccaaaaatacaaaaaattagccagacttggtggcgggcacctgtaatcccagctactcaggaggctgaggcaggagaatcagatggagtgccagtctcaaggttactgatagattagaga

SEQ ID NO: 126478 - DNA, 773 bp, Homo sapiens
cattgttctagtctctcaggcaagaaattcagacactctgaactcttttctcacttcctctctatacctgctgtgtcagcaaggcctgcctcagcctccaaactcccagtgctgtgcacagctatgcttgatctctggattctctgctcttcaacctgtcatggccttccaaacctgaaaatgctccctgtgactctatgccaggctttaagtcccttcacaaacttggtatgcccttttctcatccttattcctggaagcccctcaaaatcttcccagactcaacacatctctgctatggattttacctctaaacattccctgcatttctaaatgatactttatgaattacaacttaaggatgggaagtgtgactccaaggtaactggactaattctttggtgttaggttctggttattggtgtagccacctctctcattaaatcatgaactttactttcctgtcaatgtgccccgcacctgacagtgccttccttgtccgtcgtagaattccaaaactgtcctaggagttgggcgtcaccaccaatgtgctttgtgattcttccagatgtgttagttctgttagccagctagataaaaatatttttgaagcaaaaccatacacttctattccctcctgctcccttggctgctcaggaaatactttttgagtgcctgaccactcagagtataaataatttatgtgtttttttatattttgtctttgctaatgcacatgcaaaatgtttgtattttataggtgcttatatata

SEQ ID NO: 126479 - DNA, 224 bp, Homo sapiens
catcatcctctcaatgaggtcttccctgaccaccttattttaaaattccaagtcccccatctatagcccccttatcctgatctactttcctgtttttccagagaaccccctgcctttgaacacacaaaacatttacttcctgggtttactgcttgtcagctgtgtccactcctcccactcctacccttagggtaagaatctttgattgactcattgatatgtct

SEQ ID NO: 126480 - DNA, 367 bp, Homo sapiens
ccggggtcgactactaccactaaattcgcggccgcgtcgacagatttaatgaaattaaatctcaatgttgagttgacagcgttttcatattctatgtgctaaaatgggaagtattcctgctaccaaccaaagtaaaatgcatgtctccaggaaaaacacctgtgcaatcattttatttgctttttccagcaaggcttattaacagacaagccttggttattcaaatttgggaacctgacagacatttttctcaaaagcgtatgaaatgagcttgttgctttaaagaaaatatacaagaacacaggatggggttgaatattttcttcatgtcgaccggccgcctatttaatagtaataggccgccagc

SEQ ID NO: 126481 - DNA, 496 bp, Homo sapiens
ccggggtcgactactaccactaaattcgcggccgcgtcgacagatttaatgaaattaaatctcaatgttgagttgacagcgttttcatattctatgtgctaaaatgggaagtattcctgctaccaaccaaagtaaaatgcatgtctccaggaaaaacacctgtgcaatcattttatttgctttttccagcaaggcttattaacagacaagccttggttattcaaatttgggaacctgacagacatttttctcaaaagcgtatgaaatgagcttgttgctttaaagaaaatatacaagaacacaggatggggttgaatattttcttcatatatttcaacaaaaataacatatcacaacagactgaaggcagacacatatatgataatctgtcttcaattaagccagacattaaagaaattttcaaaaatgtccaacaatgtcattcttctcattagttttaaaaagtacccctttttgttgctgttgttgttgagac

SEQ ID NO: 126482 - DNA, 231 bp, Homo sapiens
ttttccatcttcaataacaacttattgaggcacctactgtgtggcaggtactataccaggcacaactgggtatgttctaacaatcatctggtaggagagatgtaaatatgtgctacatgaataactgctacattagaaaacgggtgacaatcaactaaggaagacaaaatgctacagaaattcaaagaacatacatcaatgaaggcatcataataaaatcttatttggagg

SEQ ID NO: 126483 - DNA, 313 bp, Homo sapiens
aagtctctcctttctaccccactccacaatgagcctttctttctcagattgtgcagctcacaaatctgctccacatggatccttccagcagggatgcagcattgtctatcattttctcattgtctcacatatctacgtcatctctcctaactagactaagagctgttaaaggcaagcaccaattcttccactttctgagcagcccccacagtagccgaagaggaacaggacacagaaggaatttaagcatttactgatttgttgcactaaagcagaatcactgtgtaagctatatcctcatgaaagaatggta

SEQ ID NO: 126484 - DNA, 155 bp, Homo sapiens
gggattacaggcatgagccaactgcgcccggccatgtattggcttattctgccaatgtttgtgtcttgccttagtaaagtatgctcctcgagagttagaatagtgctttttacatctttatatacatacctacagtgtccacagcactgtgctcg

SEQ ID NO: 126485 - DNA, 712 bp, Homo sapiens
tctttggaggagcttacttaatatttcctaaaggagaggttaagtaggttgtctttggtgcgttagttatgcagagagaagagaaatgtaactctcctgactccagggccccaaatgcaaacactggcctagttgttcccaaactttcttcttgatgtggatgacttgaatggtttattttcacttgatgagccacacccccaggccactttagtattcatggcagaccccaacactaagtccctttgttgtctttgttttttgcatttttttgttaactagaaaagataaaattatgagagacctgattatagactgaggttctgttgctgatggttcccaccacttttttcacatctcagagaaaggcaaaggcctggatgggcaacagaaaacagcaaagcaaacataaacatcacatcacgtctgagcatcagcgtggtgctaccagagtgggaagggatatagtcattatcaaaatataaagatggttctttgccaaaagcattaacattgtcagcattttaaaaagtttgaagcttgctgtagaagcaatggtcttttcttcaaggaaaaaaaatcttttttcttgaagaaaaggaaaatggattaagaattttaaaaatccgcattattgttctgacctagacattaactaagtgaatgacatttaggcaagtagcttaatttgtctgtgtttgcgcatgtgtgc

SEQ ID NO: 126486 - DNA, 798 bp, Homo sapiens
gcgtgcgcggctggaggcggagcgagccggctgcgcgcacggcccaggggctcccgccagaacccgagcccacgcacacaagggtcgcggggctgggaagctcgtcatccaagcccgtcagggagcccccccatcacccgaccgcgaaaggctgagagaagggagggttcgtgccaccaggtcctggtcccccggctagatgtggtgggcgcgcgccccgactactcgtcccacgccccccttcctcttcccgcgcgcccctgaggggtgactgggttggtgggcgggcaggagcgcacctgggtccgtcctctcagggctcgctcgctcgctcgctcgctcaggcacgcgtgcgcagaagggcgggaagggagaggagacacgccggggcccagcgccggccggcctgaccccctcagtctgtctctatgggcgcgcgccgacagcctcgagcaccggacacggggcccggctgagggtgcgcgcgcagaacccccgggaagcgtggggggcgaggcgggtggcgggaaagatgccgcgcgcaagtcaagcccgccatggcgacggggggaacatgtgcgcggcgtacagacaagctaggtctacacctcttcccgttaaccttggcgttacctaccgaggaagcgttgcggaaaccaacagcccacgcattcccgggctaaggaaggggggaaggggcccaccttattgggccaaccggagctacccgacggccttttacaactcaccgcgtgagagactgggcgagtaaactggcacaccagactatgctctacg

SEQ ID NO: 126487 - DNA, 107 bp, Homo sapiens
cgtccggagcagctaggactccaggcatgagacaccacgcctagctaattttttttttttattttgtagagatggggtctcactatgtttcccaggctggtctcaaa

SEQ ID NO: 126488 - DNA, 299 bp, Homo sapiens
caatgtgtaaatgctgattataagtctggggaaaaaatcataagattggtggacagtctctagttcttgaaaagtacagggttgagctgttttgtttctgttgtggtgatagttgtggttattttccattaatacaaaacagtccctggtttggagaacaacttctgtaattcaaagtacattgttatagtccaagtcactgctcagtgaatgtcttggtgtgcaagactattaccttaaacagttttatatctgtgggttgtattcaggtcagttttagctttgggacagaggtcagc

SEQ ID NO: 126489 - DNA, 225 bp, Homo sapiens
aataattgatatgaattttcaacctaattcacataggcttttggcatggaggtgaaactgtacaacaaagtaggtagaagacagagtgagagaagacacttcctggaaaagtttattcatccactgctcatgaaacaaatatttactgaactcttagcatgtgtcaagggcaatgctaagtgcttgatatacatcaggaacaaaacaaaaagatatctgccctgg

SEQ ID NO: 126490 - DNA, 419 bp, Homo sapiens
ttacatttatacagctaggaatgtaaaaaccatctacttcagtaagaaaatggcaaaagtcattattctaagtaactcgggaatggaaaaccaaatattgtatgttctcacttgttagatgggagataagctatgaggatgcaaaggcataagaatgatacaatgcagtgggctcccaaaccccctgccatggactgttatcagtctgtggcctgttagaaatcatccacacagcaggaggtgagcaagtatttccgcttgggctccacttcctgtggagtacaagagtactggagtacaatggcacaatcttggctcactgcaacctctgcctcagcctcccaaatagctgggattacaagcatgcaccaccacgcatggctaatttttgtatttttagtggagatggggtttcacca

SEQ ID NO: 126491 - DNA, 846 bp, Homo sapiens
gggattaaaaaacatcgtggctaactttatagacaccataagcaatttctcagatggtgactgctttggaatatttggacatgggtcactgtagctgcatgctttttatatatgcaaaaagtaacatgaaacccattttgcaagactgcagaatgcactaaagtaataatttatggtgaacaccagcagtcaccaaaactcccactgaatcacattgtaattatatggagaaaacagtatttgtgttctcaaatagaatgttgtatttttatacaagtcaaaagatgttaaaaatgtgccataagaaaagaccacgctgtggattctaaagttttaaaaattatagtaccaagaaattaagatttatatatttttgaattactaaatatctagattgaccatatctatttttgttttaattttccctaaatattctgaaaatcattttatagtttttaacacaccatcatagtttgtgcacggatggccacctttagtgtgtgatttcagtgaagttcccattgaagttatttataagcagtggacctattttacttcttatatttgaacttcttaagaagtttcttgaccaggcatggtggctcatgcctgtaatcccagcactttgggaggctgagacgggcagatcacctgaggtcaggagttcgagaccaacctggccaacatggcgaaacttcgtctctactaaaaatacaaaaattagctgggcgttgtggcaggtgcctgtaatcctagctactcaggagggtgagacaagagaatcacttgaacccagcaggtggaggttccagtgagctgagatcgcaccactgcactccagcctgc

SEQ ID NO: 126492 - DNA, 333 bp, Homo sapiens
ccatgcagctactatgaacaatttctccctctttcttctcttatttaaaacaagtgtaacctggaacactcagataaaagtatagaaatgggacagatgcatgcgctacatgggccaagagttctgtgacattttccacgtttgtgttttaagtgatggactaaaaaagccttccagttattaagtctaattactcttcttgaatgttaatttgccattaaaagacattttttcaaacaacctaaaatttccaccactggtcatgagtaggagaatggacccagacggacgtgcagacagttccttttagcagcggtctctatgacagtcaag

SEQ ID NO: 126493 - DNA, 546 bp, Homo sapiens
actgcaggggttggtggagatgaggccaacaggcgttcagggataccagatcaccctccagagaaggaacagctcactctggctggctctgcctggaacatctgttacttgaaacagttcgtgcacaggatggaaggggtgagggcttgactatgcagccagatttctcctgaattcatgctactccaaaaagaccgtgttgtgggttagaacttgatgctggccatgttccaaaaatagccagacccaagttcagtaagggcacgaatttctcagaacaaaagctgccccatctgtgcttgccttgcaggctgctcttcttacacatcacagaattcaattcaaatcatcacagtgacccagctactgggaaggctgaggcagaaggattgcctgagcccaggagttcaaggccagcctgggcaacatagcgagactccatctcttaaaaaaacaaaaaacacacctgtaatcccagcactttgggaggccgaggtgggtggatcacctgaggccaggagtttgagaccagcctggccaacatgg

SEQ ID NO: 126494 - DNA, 382 bp, Homo sapiens
tgcagttttgattgcatttccctaagtgactaatgttgttgaacaccttttgatatgcttattagccatctgtatgtgttctttggagaaatacttattcaacttctttgcctagtttcaaattgaggtgtttgtttttttgttgttgaattgttgagtttcagatacatgatttgaaaatattttctcctgtcctgttggttatcttttcactctcttttaacaacgtcctttgatgcacacaaattgtagttttaaagaattctactgtatctgtgttttctttcattgccttagctcttggtgtcatgtttaaggcagaacttccagtactgtgttaaacagaagtggagaaaatggtcatcattgtcttattcctgat

SEQ ID NO: 126495 - DNA, 529 bp, Homo sapiens
tatcaaaggtcatctatcatgtcatcctcaactttctggaatctgtgctaaaagaaacccctatggaattgaggctcttgcctgcgtcctgcctgcactgccttaggttgaggcatgtgctaagcagattctggagatggtgaaaaccctaacaactttccagcacctctaactgcttctgcctccgctaatctggtcctgggcagtggggggcaatgggggaaggggatgaggtgtcagaggcccggacaagttcgtaaacccccagacacctgccagagcttaaacttgcgtcagagtctgtctccaccaaaatgaaagaaaccaagagtgccacacccaaatcacagtagccggagtgaaaaatatagctctgacacaggccgttggctctggggaaaattctgccgatgaaccatactgagactcaacgttgtttatcttctatagttgcagtcttttttttttttttttttttttttttcccctttggggcccggccgcccggttcggggggccttttttctca

SEQ ID NO: 126496 - DNA, 360 bp, Homo sapiens
agggcccctccccagctgctcccgggggcgggcaggcgggtaggtgtggatggtgcagagcccgaaccagcgaaggtccaccctgtcccctgcctggccaggcccaggtgctccaggggcgtcaagaaaacagaaccagtgtctgtcccatctggttgcccctggcctgaggaggagcccccagcctgttggccacccacctgggaactgggtactgaggctggagaccctgggctgccgtagcagcggttgggccggaaccttcagacgcccggagcgaggcccactcacgagcatcgtgaggagaggcagatgtcccggccgcatccccacagggaaaggctgtccaggggcccagcc

SEQ ID NO: 126497 - DNA, 179 bp, Homo sapiens
gagacagggtctcaccatgttgcccaagctcatcttgaactcctgagcttgagcaatcctcctgcctttgtctcccaaaatgctggggatataggtttgacccaccatgcctaacccatccttcttattgatctttgtagccacagataattatttcaaaacaattaagtgatactctt

SEQ ID NO: 126498 - DNA, 330 bp, Homo sapiens
gcagcagcgggtgctgctgggaacgcctgccggcgcctccacacgcagagatacgcggcgccgacacgggaggcttcgtcctgccggcgcctccacacccagagatacgcggcgccgacacgggaggcttcgtcctgccggcgcctccacacgcagagatacgcggcgcggacacgggaggcttcgtcctgccggcgcctccacacgtagagatacgcggcgccgacacgggaggcttcgtcctgccggcgcctccacacgcagagatacgcggcgcggacacgggaggcttcgtcctgccggcgcctccacacccagagatacgcggcg

SEQ ID NO: 126499 - DNA, 470 bp, Homo sapiens
gggcgggtggggacccttccagtcaagctgggggcgcagacaggggccttctccagggctcccctgtttacccacagagggatgggcttcctggatcctgtcccagcattacccagtaaaaagaatcaagccacctaggatgtaggtcacccaggggtcaaagtggttctgggctgggtcacctcctgtataaggctttgcatagtgggaggcctgggggctgagaggccactagcaaggaaagacaagcatacaaaagccaggctccctctgaccgcttagagggagaacaatgaagccagggacggctctgctgggtgctgggttctgagacacagagctcttcttcaggcagggtctgctgattcagcagggctgagcaaggatcctatgactcggagatgtcacccatgcgggcgtaggcgctcagagggagggtgaggtggacaaggaggccccagccacgtgtc

SEQ ID NO: 126500 - DNA, 597 bp, Homo sapiens
tagctgggactacaggcgcccactaccacacccagctaatttttgtatttttagtagagacagggtttcaccatattggccaggctggtctcaaactcctgaccttgtgatccgcccacctcggcctcccaaagtgttgggatcacaggtgtgagccaccaagcccggcctcttttgaaaattttaactgatgtacatagaaattgctggcaagaaatttggaactgtgtattcacttggagtctgcttaatttttatgtatctacacagcaaaggaaaatggcttgtcggctataagttttgttcctcatgaactgaacattttactcctcctgaactaaacagaaaggcatgactggtggtactttgagtatgctgtaatttttttaattttttttttttaattattttttttaaaggcagggtctcattttgtcacccaggctggagtgcagtggtgcaatcatagctcactatggccttgcacatctgggctcaggcaatccttctgcttcagcctcctagtagctgggcgtggtggcgggtgtctgtggtcccagctactcgggaggctgaggcaggaaaagacttcatctc

SEQ ID NO: 126501 - DNA, 369 bp, Homo sapiens
tcctacccacccccttactctcccctctctgttggccgctgtctggctccatcccatttctgtgggtacgacttctggggtttcttgtcctgtctgctcctgtcgcaggtccgtaagtcacacccctgatggtgagaccctcctgctaaccttcatgatttccttgtgactcacttgcccattcagtggcttctgaacttggggctggccgtctcctctggaccttgtttgtgtggtgttggggaggccgttggaagagaagccaagaggaagggactgagggcaagtggggggtgcaattgctgagggctaggtctctcctgttctgagtgtcttgtgtgcggaggccttgaagggctacatgctggg

SEQ ID NO: 126502 - DNA, 319 bp, Homo sapiens
agagggtagagtcaagatagtagtatcagtactcagtactgtatgaccttaaacaaatatttaaccactctggatctcgatgtgtaaagtgagcataataatggtacattctgcataaggtcattttgaaaactatatgagttaggctggatgcagtgactcacgcctgtaatctcagcactttgggaggccgaggagggtggctcacctaaggtccggagtttgagaccaacctggccaacatggtgaaaccccgtctctactaaaactacataaattagctaggtgtggtggcagatgcctgtaatcccagctactc

SEQ ID NO: 126503 - DNA, 226 bp, Homo sapiens
ttcaaatgcaccactcacatgcttgccaaggggcctttgctctgcccagaactctttttctccagatatccatatggttcatttcttcccttcctgaaagtctcaactgacatacacatcaccctattaaagaggcctttaagatgcatattccccctttgaaagagtcccctcttctctacccttgtcaccccctttgtttcttctttcaagctgctggtacttc

SEQ ID NO: 126504 - DNA, 488 bp, Homo sapiens
tatgtagcctaggtgtgtagtaagctatttcagctaggtttgtgtaagtacactctgtgatgctcacaatgatgaaattgcctaatgacacatttctcagaattatccctgtcgttcagtgatacatgactatcgttgcttaataaatgggaggaatggtcgttgttataaagcctgactttcccctgagggtcattcattcacctccacttctcccctagagtctttaagggaacttgccagtggagatctgccatgatttggggttattctccactcagtttagaatgacattgcaagattaatgttggagtcagatgttatggccaggaagattgtgtatttggtttgtgaagctaaactgtggttcaggaattggaaaaggaactatcctttgagttcaaagtgtactcagctaaagatacttggtatgtgaggtacagaagccatgcctgcattttccactgtcctggcctacatagtaggta

SEQ ID NO: 126505 - DNA, 294 bp, Homo sapiens
accaccacctccagcatcttgcttccacctactattgaagtacttattatgtgttaggcattgtactactagcttaactatattatccctttttaccatcaccacaaccccatttacaaatgaggaaactggggatgacagaaatgaggtagtttgtccaaactcatatggctagtgtgcagcctggctgcaaacccaagcattctggctccagagccttcactcttatcaattgccatgctattaccaactgtcttgctttaaaaaagaaaaacaaacaaaccgctttgggcg

SEQ ID NO: 126506 - DNA, 308 bp, Homo sapiens
ctatgcttgtattgagtggaacatgttcctttatttcctgcaaccaaagcattacagataaaccacattattaacaaattagctagctgaggccactgctctccaagccaccataagcagtttcaactgcaccaaatcaaaccatgaagaaattcaatcttgcccccacatgaaataaaaagagcacttttatgatatccacagttatctgttaattcagtaaacattcatgaacatgccactgtgagtgtaaactagttagacaggagggatcaggaggttggaccaaaatggggtttacgcagggg

SEQ ID NO: 126507 - DNA, 375 bp, Homo sapiens
catgcagctggagaccctggggaggagctgatgttctagtttgagggtcatgcagctggagaccctgagggggagctgatgttccagtttgagggccgtgcagctggagaccctcgggggagctgatgttcctgtttgagggctgggaagctgatgatctggtttgagggccgtgcagctggagaccctcaggggagctgatgttccagtttgagggtcatgcagctggagaccctgggaggagccgatattccagtttgagggccgtgcagctggagaccctgggaggagctgatgttctagtttgagggtcatgcagctggagaccctagggagagctgatgttcccgtttgaggattggggatctgatgttc

SEQ ID NO: 126508 - DNA, 376 bp, Homo sapiens
ccttcagtcttgtatcttagtttatggaactgcctactcaacacctctaccctgatgtctaacgagcacctcaaataacatgtttcagtgagtgatgccaccattcacccagtcgctcaagctccaaatacagtaggcatccttgtttcctccatcaaacccactgtcaagccaccagcaaatattttggctcttctttcaaattctatctcaatctgaccacttcttatcacctccactgccacaaccctagttcaggctattatctacttacctggactactgagatagcctcataattgctttgttttcgtagtccattcaccataaagcagtcagttatctttttaaaaacacagatcatatagtttcactc

SEQ ID NO: 126509 - DNA, 242 bp, Homo sapiens
aggcatcaatgtgagaaaaggaatggcttgcgtagagaaccacaaacagtttgggactgctaggaatataacaataagtgatgagttgtaaggctggaaatacagtcagaggccatgtcgtggtggaccttgtatgcataagtatcctaaaatcaattcagtaggtgttttttttttatttttatttaatcactggaaggtgtctatcagacatggttgaagtaacatttttaaaatgtggt

SEQ ID NO: 126510 - DNA, 698 bp, Homo sapiens
gcgactctagaggacccagcgggaaacaacacttaaaactcaacaacaagaaaccaaacaatccaattaaaaactggtcaaagaacttaaatttgtcaaaaaacaaaacaaaacaaaaacccacaagggccagtaagcacataaaaagatactcaacatctttaatcatttggaaaacacaaatcaaaagcacaatgagacaacaactcatcccattaggatgggtactataaaaaacaaaaacaaaacaagttttgaagacacatgtggagaaattggaacccttgtgcactgtcagtgggaatacaaaatggtgcagctgctatggaaaacagtaaggcagttcctcaaaaaattagaaatagaatcaccaaatgagccaacaattccactttgtggtatatatttcaaagaactgaaaacagggtctctaacagatatttgcttacctgtgttcatagcagtattattcacagtagccaaaatgtagaagcaacttaagtatccattaacagacgaatgaataaacacaatatggttctgtgaatgtatgggaaaaacaaattcagttcctcctatactgtcacaatacaaaatacttctgtgacctcagatcttgttagttgtccaccccaacaccatgcaagcaatcaattctgcagcaaacaccagctggttgctaccaaattcaattcaat

SEQ ID NO: 126511 - DNA, 526 bp, Homo sapiens
tgtgaaatgggatgttgctctgcatttagcctagaatcacataattttagaatgggaaaagaacaaaagatatggtaggactatatttttcaaatcaagaccaaatcacgtggtttaaaagaggatttcaggccaggtgcggtggctcacacttgtaatcctagcactttgggaggccaaggtgggcagatcaagagttcagaatcagcttggccaacatggtgaaaccccatctctactaaaaatacaaaaatagccaggcatggtggtgggtgcctgtaatcccagctactcggaggctgaggcagaagtggcttgaacccaggagtcggaggttgcagtaaggtgagatcgcaccacttcactccagcctgggcgacaagagtgaagctctttctcaaaaaaataaaagaatagggcaggcgcggtggctcaggcctgtaatcccaacactttgggaggctgaggcgggtggatcacgaggtcaggaaatagagaccatcctggccaacatggtgaaaccctt

SEQ ID NO: 126512 - DNA, 166 bp, Homo sapiens
taaaatgtataaaaggtttaatttaggcagatacagcttagtaactgtacaagttctgaagtctgactacttagatttcaatcctagctctgccacttggtagctttgtgacctccgtgagtaagtgcctgaacggagctgtgcttcagttccttaactgtaagat

SEQ ID NO: 126513 - DNA, 205 bp, Homo sapiens
gagggtatgtggggggactccagaagtaaaggagaaagcaaaagatgatagccaagctacatagtgatggctgaagattgtcttttgtgttttgttttgtttccattttccattgacaatatctgctctgctaggatataaacccccatctgtgttatcaaatgtgcagtgaagactgttacacataaagtccccatgagggttt

SEQ ID NO: 126514 - DNA, 484 bp, Homo sapiens
agattatttatttactttaagagttaagagtggcggtttggggatagcaccaggagatatcagctgtgatggcttggagaaacagtgtaaactggcagtgtaaacaagagcagggcatgtatgagtagttgagaacgctgaataagagtatgactagacagaagatagtagggatgacaggtttttgggggcacagtctaagttggtctggtgtctggaaggagactggggcctaataaaaaggagcgtctatacaggagcttaaatgggctgtaccttgtagcattctgaggacaggcctgaattctgagaagcgaaagtggtaaaagtattgtccagtcctttttgagttggtggctgagcttcgtgaggtgtgtttttaatagaccattagtctgtcactggatactaagagcctgaaaaaaggcttggctgatttgactaataaaggctcgtctgttatcagactgtattgaggtgggaa

SEQ ID NO: 126515 - DNA, 595 bp, Homo sapiens
tctaaaaccactaactctcacgcatgtgcgtgcgcgtgcacgcacgcgcgcgcgcgcacacacacacacacacacacacacacacacacacacacacaaaatatccctcatagacaacactttataattcaggcaaaggaagaccaaaaggagaacttaatacttcttatttattccattcaacagtaaagtgccttaaaaaggccatgcaattatattgttatgtgataattattaattctgctatgagcttccactgagcccagatcccatcaagcacctctaattttgcctacaagtccttctgtaccacctgatgggtgctgggaaaagagctgcccttctcaactcctggcatttggctttgatgggtttccactgcatatgccttcctttttcatcagccaccattttctaacatctttatgcataaaaaagacaaacttattgggaggaaatatcacaatcccccaaaatgcaattttcttcctttccatctccaataaagcatgtagtggaaaagttattagacatttttcctagtggattgtttgtcaataatattaacaaagccagtgtgttgaatacctgtata

SEQ ID NO: 126516 - DNA, 296 bp, Homo sapiens
atactttattttaaaaatttcactcttagtacaaagactctctcacagtgcaccaggtgttaaaattatgcaaaatggggcatttgtccagtaggcatcctacttgggggatgccaagtaggctccccttctgtattttggtatatctcggggagcaatttggacctgatgacaactccaaatctgggtgactcatgatgggaagggcagaggttaaaggaaaacaagtttaagtgtacataaccccttttttggattaagaagctaagcaccacaacttctcacaatttcttccc

SEQ ID NO: 126517 - DNA, 618 bp, Homo sapiens
atgaatattgtatcacccacatcaatctttataaccctgtatttcataatctatatttttaacattttacacttgtattaaccatatgtattattacgtggtttatacatgtatatataacataaacatattgaatatgtagcccatctctccaactggtatcatatcctatacaaagaaatattccttgacccactgagttggtccttgcgctccagttttaggtactcctaatgtactttttcttcagctttacatttattttgaggttattttgttcctgtttatgttgtgaatatttgattattttctgtctctgccattacattgtaaattcagtaatgtgtttttacctaatattgtattcccatagcctgacacagtcatcacccaatatgatcttgtttaataatgaatgaattcataaaccagacatcacagaggctagaagacaaattagaaaaaatacttacaggaagaacacaactcataaaccatatttgctttgacaccaccagcatctgtggagatttaagtgggagtcactatgatgagaagattgctttgagtcgagtccagcaaaaggagctacttcaataattaaggggtactacttgg

SEQ ID NO: 126518 - DNA, 387 bp, Homo sapiens
tgaagcctgattataggaagcaaagactctggtctgctgatgtgaaggctcacctgttagctggttgcatttatggttaaaatggaatgaatttgaattctggctatacagcagtctctgtgagcttgggttagtatgagtttacctgtgagataaagttccagagcagagtgacttgtgacttgtgttgggtccatactaagtggcagacagtggaccagaatttataccacaaatccaggttggctctgagaagacactgccactaaggactgatctaaactcagttccctttcaagttcaccaattgtatgactcacatgacattgaatgaggccgggagtgtgatactagctggactcaccttcaagaacccaaaagacccca

SEQ ID NO: 126519 - DNA, 147 bp, Homo sapiens
tgcggggattacaggcgtgagccaccgcacccggccagcagcatgcatttctgagatccaggtgaagtggccgtcctgggacacgtcgctgagggcagattctgaacccaggtttcccagcttcaacactccatcttttcccactgc

SEQ ID NO: 126520 - DNA, 361 bp, Homo sapiens
gggttactgcccatgtcgggctcccccccatgtatagctctgtttctgatttctgtggaaccctgtcacatgaggacagggttccacagaaatcagaaacaggagcttcactggggatggcgttgatgtcacttggaagaaaagggtccctgtgaaaagccctttgaaaaaggagattggtatcccagggatgcctgccacccccagaatctgatggaaataacgaccagcaattgtagtaataaactatccgcacatgttagtccattttcacatggctctgaagagctacctgagacagggtgatttaggaagaaaagaggtttaatcgagccacagttctgcaggctgcataggaagc

SEQ ID NO: 126521 - DNA, 220 bp, Homo sapiens
acaagacaataattatttttgtttaggtatggttgacagagctttcactttttactttataaacctgtgctctgattcaatgttaagagtgcctgttcagaaaaatgcattaaaataacaaaagaaactcaattatatatgtcattccatttagacattcagtcatgtgccacataccaatgttttggtcagcaacagactacatatacgacagtggtcc

SEQ ID NO: 126522 - DNA, 979 bp, Homo sapiens
gaatgatctcagtcagaaactcagaatgaatcatatgaattaaacattggacaatgtccaatgctcagcatgtgtttttggtttatactaagagcatattatgccaccaaatacagatatttactattatacttcgtgtaggaggtatattgagacattgttctagactaccacagttccatatttgtgaaaagttatattgcacttttttttttttggaaagtgtgcccaggctggagtgcaagggcatgatctcggctcactccagcctccaaaccccaggtctcaagggattctcctgcctcggcctccctagtagcggggattacaggggggcaccaccacatcgggctaatggtcggtatcttaagtaaaagatgggggttccgccatgttggcgccaggctgggtctcgaactccggatctcaggggctccacccgcctaaagcctcccaaagggtcgggggatcacaggcgtgatccaccaggcccagccttatatttcactcttggggaatggcatctaacggtaatcttaaactacactaaacttaacttaaggtaaccctttggtcaaatggctcagagaaggttccaacttgggtcatagggactcaaacacttcaggctcttggctctacacactagacttctaaagcaaccaaccataggttaacaacgcaggggctcctgtaccaaagagggtaactcttttcctagaaactcgggcgacacccatttaaactatccaggtattaagccataatggcggggggcgtcaaccacgagtggcgtctcccaaggtttaatacagattttgcataagattgtaataaaggcccgttaacactgaaattccctttcactggagattccacatcggtgggcgggaacttccaaggattgtcccggagtgtttcacacggccacagctttatggtgccggccccaaactcattgcgaggcggggcagaatca

SEQ ID NO: 126523 - DNA, 221 bp, Homo sapiens
caggccaggtaatctgtaatcccagcactttgggaggctaaggtggtggtggttacacaaagctacacttgataaagttgcatagcactacacacacaaacacacacacacacaaatgagtgcatgtaaagtgaaaaatctgagtaggctctgtgggttgtctctgtttcttggttttgatagtatactgtatttacgtaggatatcaacacttggggaga

SEQ ID NO: 126524 - DNA, 416 bp, Homo sapiens
aggtctgttgatccaggtgtaggagatgcttcagcatcagatatggctcctacagttacatatcttgccggtgggaaaataaatacgtccaaacctctatgaaggtccatttgccaatatccataataaaaacacatatactctcggccgggtgcaggggctcacacctgtaatcccagtactttgggaggctggggcaggtggattgttggaggccaggagttcaagaccagcctggccaacatgacaaaaccttgtctctactaaaatacaaaagttagctgggcatggtggcacatgcctgtaatctcagctactcaggaggctgaggcaggagaaccacttgagcccaagaggcagaggttgcagtgagccgagattgtgccattgcactccagcctgggagactatgtttc

SEQ ID NO: 126525 - DNA, 105 bp, Homo sapiens
tccttagtgctggcataacaaaagactaaatatatataatttccccattaaaaacactcaagagcaaggacatgggaaaagattttcaagggaaaggaccagctc

SEQ ID NO: 126526 - DNA, 406 bp, Homo sapiens
tgatcaatatcccaagttactcatcatgtcatggttggtaaaagcttctcagaatgggtagttttgatatgggccttccttaacagatgataggacttcaaggcaggtacaaacaccataaccagaagcaagaatactaatattggccgagtgcagtggcttactcctgtaatcttagcactttaggaggctgaggcaggcagatcacctgagctcaggagtttgagaccagcttggtcaacatggcaaaaccccatgcctacaaaaatacaaaaaaattagctgggttcagctactcgggaggctgaggcaggggaatggcctaaacctgggaggcagggcttgcggtgagccgagatctcgccactgcactccagcctaggcgacagagcgagactccttctca

SEQ ID NO: 126527 - DNA, 442 bp, Homo sapiens
gggccgggagcctctggaccagctcagggtgtcgggcccggttggggcagacaactggccgcagtccacacccacatggtggctgagccctcggacacttgtgggcctgtgggtgatctttctaatttttaaatttctttttgagattgagtcatgctatgttgcccaggctggccttaaatccctgggctccagcgatcctcctgcctcggcccccagagtagctggaactgcaggtgtgagccaccgcacctggctggggatgctcatggtagtttctcctcacaggggcactgtgacagggcccaggagtcaccaggcctgcccctgcagccactccccacagatgcagcggggagggatggtctgggggcttgtgtctggtaactccagcacctgatggtcacccagcccacaccagtgctgtgtgacctggcacctg

SEQ ID NO: 126528 - DNA, 705 bp, Homo sapiens
gggatccctgtctttttttccccataggtgtttagttctggctattttttgctctcaatgggaatctcaatcttaggtatattgtatcacccagcctatgatatgtagacacaattggtggaacggtaaaagcatgtttgaggtaggaagactcaagaagggattaatttgtttccaaatgataaattaatgaaaggtgccaaccaactggttggacaaacaacgaattcttacttttcaacgttttcactattttgcaatccttcagtttcagaaaagattcaattattttcccatttaccaaacttggattttatacaaggattaaagcaaaaggtttttgcctagttaacttttgttaaatacagattttattctgaactttaaaaattttaattagagacaattttattagtaatattctattttttaaaaatcttaaacattaaatattatttacctaatatttacttttaaggatttttatttgatttttgtaattaatttttgcagctaatataattcacatttttgtgaacataaaatagcaacgtattactttggacagcatttaatcggaaattggtacttcaaatggcatttgggaaattttattaattcttcttaaattttaagatttatgttttaagatttatatccttagaatgggtttgtgatgaaaacaggaatcatttgcttgactag

SEQ ID NO: 126529 - DNA, 445 bp, Homo sapiens
aaaacagtttttcactttagaatccagagagcactgatttcatttagttgtcacatctctttagtctgtaacagcactgatcagttgtcttctagagtggccttgtctgactggacttgtctgactggaagtatgtttcctcatgactcggcttcatcaggctaaatggtttgggcaagacacatgttggtttgtcccattcgtggtgatgctgagtgtgggcacttggttaagtggcctctcccagatttctccgcaagggtctcaaaggtgtcttgttccctttgtaaagaagaaatgatctccaggatagaccatgtgactattctgaactcaggtgatctgcccgcctcagcctcccaatttgttttggtttttatggtccaggatccacccaggatcactatctcatttcattgtcagattttaaaatctgcaacagttc

SEQ ID NO: 126530 - DNA, 470 bp, Homo sapiens
  misc_feature (230)..(230): n is a, c, g, or t
atgtctatcgattacacagtcagcccagtcagagctacccgggcacgagcaccaggtggttcattcatttgaccatataccagcgctacctgcagtaatcatacataatcgtaaaacctgacaaaggagtagagaagccacatactgaaggttcccaaatcggagaaacgaccacagatcctttctcagaaggtgtcagcgtttttgtgtgcaagtttcttttccctatnagaggttgcagtccaaaaacaaaaagaagggtttgtcatagagatttgcaggagaaaaaaaacttggccaggctggacctattcttattttcagtgaagtcaaacagtaaattgatttatattctgtgatcttttccatggcccagggcatctaaaatttacagagagatggccaggcatggtggtcatgcctgtaatcccagtactttgggaaaccgaggcaggtggattgcttgagcc

SEQ ID NO: 126531 - DNA, 230 bp, Homo sapiens
tcaaactatgcaccacagctgtacttatcactccacagagaattcacactcccttctctaaggagtccagagtgagacagaggctcgtatctgtcatcccagaacttggattgcttgagccaggagttcaagaccagcctgggcaacatagtgagacccccatctctaacaaaaatttaaaaattatctgggcgtggtgacacgcgcctgtagtcccagctactcaggag

SEQ ID NO: 126532 - DNA, 560 bp, Homo sapiens
gagggtggccacgggcccagaggaagcatatagagctgaagttgggtctagcaatgcaggaagggcttcctaaaaggagtgatgtgagaagagtttgcaagagtcagtcggatgaagcagggaggggcatctgagtcaggcacaagtaggctgtgtgaattcacgatggattgaaacagcaaggctcatgaaggttcaagggcatagtgcatgcaagggggctcctgcgacatggccaggagttgggacagcagtgctgcaagccttgcaagagagttgacagcaagacggatgggtattcaagtgatccagtaagaaatgaggagggctgacctatgcgaggggaagtgttgaaggatagaggggtagcaaataagagagaaattaagttcaggagtagagaggtggttggcagtccattggctacagaagttgataacgagggagcaatgaggatccctccgtggatgctggctggggtcgccaggtaatttggtacaatcctccacattagagattacagtaggaaaacaaacaggcttgggaggagaggtgttatg

SEQ ID NO: 126533 - DNA, 494 bp, Homo sapiens
taagtataattgaaaatttgagttttctcaaattttctcaaatttctgtgaatgcacatatattacttttaaaataaaaattaatataaaaacaattaaaatggcatattaattcatagttaaactttatcctgcactaaataggatgttgtatgttgacttagaagacagatatgttcagccattctataaattaatttataaattaacatacattttcatgaagttagaaatttatgcttacttcatgtattgttcaaggccctgaaactattataaaacattcaatgcatacaccagtttgcttgacttgaacatctttctcttccctacttgtatcctaagctttcctgtctatagacttagctcatgttcttctcattttaatctagaaggttctagcctttttcaccttcactgtctctatcataatatttatttatttatttatttatttagagacagagtctcacactgtcgcccaggctggagtg

SEQ ID NO: 126534 - DNA, 662 bp, Homo sapiens
atgacaactaagtgaaatgtggaatctaggattagaacctgggccagaaaaggggatattacttggataattggcttaattttaagaaggtccatggattatttaatagtattattgttaattttctggttttgatgattatgttaatgattatacatgatgtgaacatttgggaaaactgagtgaagcacacactaggactctactattttttgaaagtttgaaattgttggccgggcgcggtggctcacgcctgtaatcccagcactttgggaggccgaggcaggcggatcacgaggtcaggagatcaagaccatcctggctaacacggtgaaaccctgtctctactgaaaatataaaaaattagccgggcgtggtggcgggcacctgtaatcccagctacttgggaggctgaggcaggagaatggcgtgaacccgggaggcggagcttgcagtgagcagagatcgcgccactgcactccagcctgggcaaaagagcgagactctgtctcaaaaaaaaaaaaaaaggcatagtgtgccgtagtatatacaatagctgatctcaataaatagctaaataagctgaatccaaggtttacaaaatccctattttataaacggttaatcccctttgggaagccctttttgaaattccggaactg

SEQ ID NO: 126535 - DNA, 186 bp, Homo sapiens
tctctaaaataaataaaataaaagagttgcaatattgaaacaaagattgtagaaaccaaaggcatacatctgagcctgaaggctgttacttacctaccagctgtgtgatgcaattaagatctctggacctttgtttccttatgtgtaaattgaaggcaataaagcaaattttacaaagatattgcg

SEQ ID NO: 126536 - DNA, 283 bp, Homo sapiens
gctggtctggaactcccgacctcaggtgatccacccgccttgacctcccaaagtgctgggattacaggcgtgagccaccacgctcggccagttatatcttaaatattgtgacttgttgaataatttggcccctatgggtggcaagttattttgttgtaatacatgcttggtagttcatagggtggttgaaactggttggttggttaaaatttcatgttaaggatggtccatgcaggactcccatataggggaaaagaagtaactaataatcttcattgagcac

SEQ ID NO: 126537 - DNA, 754 bp, Homo sapiens
  misc_feature (1)..(1): n is a, c, g, or t
  misc_feature (5)..(5): n is a, c, g, or t
  misc_feature (7)..(7): n is a, c, g, or t
  misc_feature (11)..(11): n is a, c, g, or t
  misc_feature (14)..(15): n is a, c, g, or t
ngcananttcnagnnaaaaatatcagtcggggagtaggactgaatgaaatgaaattattttaaagttttacagtgtaaaattcagtctaacaatagctgagagattgatttcagaaatactaaaacttactacaaagctgctgcaattaaaaaacaaaaaaagtgataattagcacagtaatgaaacagtggaaccagaatagagagtctagcaaaagatctcagtatatttcagacttagtaatttgttaaagttagtacagatattttatctgaaaccttagggccagaagcctcagaattaatttttcagcttcagaaaaccaatatgcaaggctgggggcagtggctcacacctgcaatcccagcactttgggaggcttaggtgggattgcttgagcccaggagttcctgaccatagtgagatctcgtctctacaaaaaataaaaaattagccaagcatggtggtgagtgcctatagtcccagctactcaagaggctagcatgggaagatcacttgagcccaggagtttgaggctgcagtgagccgtgatcacacaatggcagtgcagcctgggcaacagagtgagactcctatctctaaaataaaataaaaagaaagacaatatggtattagcactaacctctccaacaggatctggggaaagcgccttgtagttgagtcacaaataattcttcacatgacttacatataaatgaaaaatgtaatgtcagttcacatttagccaccaaa

SEQ ID NO: 126538 - DNA, 340 bp, Homo sapiens
aaacgttccacacccaggatctcgagcattctccaactacagtcctgtctctttgtcctctcttactggatattccacttgccctctgtcctctgcccatgtttgaagcactttgttctcatgtgcctctctacttagccaggatcccaagatcagacttatcaataatgccctagatcaaacttcaggtaatgtttggcatcacctggaaagtttgttaaacagattcctgggctccaccttgaaattctcatctactaggtctgaggtaggggcccaagaatttgcatttcttacaagctcccaggtagagctgacgccacaagtaggcacatcacac

SEQ ID NO: 126539 - DNA, 309 bp, Homo sapiens
aagagttaaaagggtttaaaaggtcttgcttaaaccatcctccaaactatgtccctattttctttaaaatcacctgagcaggatatcccacagtcactcttgtttacatgctccacagcctgaagtttcaggtttaagacattgcaaaacaaccttttagagctggaagagatcttgttagctggaaggctcctaggctggttgagcaggaggagagctctgggggtgtcaggggcaggttggggacaggagacgttcttaagagcagaagtagtaccagtagcgtgcatgctgcctcagtttttcttg

SEQ ID NO: 126540 - DNA, 561 bp, Homo sapiens
ttcatataatagtaccagagtatttgctgtggggggatactattattaccattatttgacaggtaaggaaatggggacacagagagtcacacaacaaggatgggttactagctagttctactctacagccaagctctaaaacacttgctctgaatcatgtgccatcttgcttcccccaaagactctccccaacacagtccaagggcccagaatccaaggccctctgggttatgcagcacgatctctgcatttccaccaaagcctgtcttggtctatgcaatcttttttcttcccattcaggccagatttttggtctactattcgtttaagtttccctagagcacagcatatagtagcaggtgtcagtggatgtctgttgaattgaatcactggatgtcagaagggtttctggatcctctctcacaggaacaaagtggccactcactgtgacttgaacattagagtcagtccaggacttgctgcactggcctccaaacccactcctaacccctagaccctttttgtaaattaagttatatttaatatgcgcccagggagctt

SEQ ID NO: 126541 - DNA, 411 bp, Homo sapiens
gaaacaatagtaagatcagggactatgtatgatgcctatatgtgccaggcactgttgtaatcattttatacacactaacttattcaatgaacacatagacacaaacccacacacctttgagctatatcccattgtgatcatcctgaggtacacagaaagtgctttgttcttgtcacagagctaggaagcagcagaggcaagagttgaaactagccagtctgtagagactcgcatatttcatgccaagatgtttggacaagagaggaactgaagcatgctaataacgtgattaatatccctagattctgactaagtttgtggaagttatttataaggaggaaagctggagaaccaaggcaacaggtcttcttggggtcagatgcagtagctcaagatagcagaaagaggtca

SEQ ID NO: 126542 - DNA, 269 bp, Homo sapiens
taagcacccaaagtgattactaagcattcattaaagtttgtattacttttcagatacaccattcttactcatttattttttggattaagcatagagccagttgcttgagatggagaatatcttggtgggtaaacccagtagcctggcactaaacttcccatttgtcaggaccctgcaaaagccatctcaaaaatgctcagttgatgaatcatagccctgggtcagaattctttatgccacaccctactgttttacattgtccttagtaa

SEQ ID NO: 126543 - DNA, 292 bp, Homo sapiens
gaagatttaccatgtgcaagatattgtgctgagtgcatggaacttctaattaacaatatatgtatgacaatggcaattgtggagagagccatccaacccatcttagtgtgtcagagtggtttcccaaaggaagttatacctacactgagatctggagcagttacctcggtgaacagggtggaaggtggtgctggtgcataggagaataatccaggaagagagatgaatagagaaaaactggtggttgaaagaactgagaacagtttgatacagttaaagtataatgttgggg

SEQ ID NO: 126544 - DNA, 692 bp, Homo sapiens
atttttcctcatggaaaatgagttaataggtgaagaataaatgtcatagtgcatactgatgtgactgagggacaacgacagatatttaaaaagccagcttgtgagtgttgtgtaattatctaacaagccagaactcgtgtgaaacatttttacagtctgtttctatttttggcaggatctttttcacccatgctttccagttttgggtctgggaagcagcttttacttcatataaatggttttatggaaattaattttgagattggtttattattttaagtcattttattcacttatataatttgaaggcactaaattaaacagtcattcgttatccatctttctgatggataaaagcaaatgtcaagatgagagtgctgtattgtagaaattcctcaggatatgtttattggatcagttattttattaacatttagaatttaaattcttaaaaatttttactttattttttaaacttaatttatgttcagctagcttaatttgacagtttttatgttctagtaactttaatcttgttttaatatttgtttgggagaaaacatacttatctttagagacatcatttagtgttatcttccaaaatttgcagctgtttagaaccagatacttgagggaagctactatggtatgatgaatgccttccttgttaggtcatgtgtgacaaaggcaaa

SEQ ID NO: 126545 - DNA, 427 bp, Homo sapiens
ctgtctggctgcagtggctcatgcctgtattctcagcactttgggaggccagtgcaggtggatcacttgaggtcaggagttcaagaccagcctggccaatatggtgaaatcctgtctctactaaaaatacaaaaattagctgggtgtggtggtgcatgcctgtagtctcagctactcgggaggctgaggtgggagaatcacttgaacccgggaggcagaggtttcagtgagccaagatcgtgccactgcactccagcctgagcaacagagtgactccatctcaaatgcaaaacaaaacagaaagaatacatgctgacgaaaaaaatctaagacaataaaattgtattactaggctgttaacatgatattttgtttcccgttaaatgtgtgacatgcaaaagtatttattaaatgaaaatatttttta

SEQ ID NO: 126546 - DNA, 815 bp, Homo sapiens
attagcaaaacacagactttacagatctcattactatatttagagaataaatcttagagtaaaatgactttgtttcttggcttgaaccaaattatgtggagtttttataattagaaaactttattgaagagcttcagaaataatttaagtatcaatattcaatcttcaaaaactcttccagtacagtctatgacagctgcacagtaatacatattgtcttagattttcttaatattcacatctgccttctgttctttgaaattctttttgtgtttatgtttaaaaatagatatacaattcaaatatgttctaggtgaggactggttatttaaataacatatatatgctttacttacacctctctcggggttccactgaagtatatattcttctaggtatttgggggactgtgtcattaaggctaatggtggtttaatctaagaggaaaaaaatacatgcataccaaggaatatttttcagtttcttggcagaacacaatagagaggaaaagtgatttgactttttagctccaattgctttcaatttcttaggtaaggtcaatgttgtaaaatctgctgagactttttttatagaacctgagtgaataaaatgcagaggtaaatcactactttctatttaaagcaaactagctttttacaaagcttatgaccatttttaaagaaaaagaaaggaggccaggtgcagtggcacacgcctataaacccagtgccctgggactacaggcgtgtgccaccgtgcctggccggttcttctttcttctgccaggcagtccaccctaggtgggcaggcttcct

SEQ ID NO: 126547 - DNA, 762 bp, Homo sapiens
attagcaaaacacagactttacagatctcattactatatttagagaataaatcttagagtaaaatgactttgtttcttggcttgaaccaaattatgtggagtttttataattagaaaactttattgaagagcttcagaaataatttaagtatcaatattcaatcttcaaaaactcttccagtacagtctatgacagctgcacagtaatacatattgtcttagattttcttaatattcacatctgccttctgttctttgaaattctttttgtgtttatgtttaaaaatagatatacaattcaaatatgttctaggtgaggactggttatttaaataacatatatatgctttacttacacctctctcggggttccactgaagtatatattcttctaggtatttgggggactgtgtcattaaggctaatgtttcttggcagaacacaatagagaggaaaagtgatttgactttttagctccaattgctttcaatttcttaggtaaggtcaatgttgtaaaatctgctgagactttttttatagaacctgagtgaataaaatgcagaggtaaatcactactttctatttaaagcaaactagctttttacaaagcttatgaccatttttaaagaaaaagaaaggaggccaggtgcagtggcacacgcctataaacccagtgccctgggactacaggcgtgtgccaccgtgcctggccggttcttctttcttctgccaggcagtccaccctaggtgggcaggcttcct

SEQ ID NO: 126548 - DNA, 455 bp, Homo sapiens
cacaatagagaggaaaagtgatttgactttttagctccaattgctttcaatttcttaggtaaggtcaatgttgtaaaatctgctgagactttttttatagaacctgagtgaataaaatgcagaggtaaatcactactttctatttaaagcaaactagctttttacaaagcttatgaccatttttaaagaaaaagaaaggaggccaggtgcagtggcacacgcctataaacccagtgctttgggaggccgaggcgggaggctcatgtgagtccaggagtttgagtccagcccgagcaacatagtgagacccaggtgtgatggctcatgcctgtaatcccacctactcgggatgctgatgtgggaggatcacttgagcccaggaggttgaggctgcagtgagttgtgattgtgccactgtactccagcctggaaaacagacaagaccctgtctcaaa

SEQ ID NO: 126549 - DNA, 349 bp, Homo sapiens
agtgaatgttccatgtacagcaagaaaacggaaatcttcagggagaaaagtccatcttccctcctcctcttaaaatgttctcttcacctgttctctcttcttacacctcagaagagatgccacccaccctagctgcaaataaagatactctgataccacaaaatcctgcctcttctacagctcctcccactcctgacaccttgtgcagaatccatacacacacacaggttcttctcctacttaaaaaataagcttggccagacacggtggctcatgcctgtaatcccagtactttgggaggctgaggtgggcagatcatgaggtcaagagattgagaccatcctggcca

SEQ ID NO: 126550 - DNA, 260 bp, Homo sapiens
ttccaggcaagagtgcgcaatgctagtgtctggagcctgattcttggctgctggaatctacttgacttgtgactggatcacacacgcccagaataactaagtttcagagatggattaaatccaaatgaagcctttgcttggcctgctcaaggactctcattgaccttgaagaattctttctatgtcaaagcaaagaggaccctctgtgtcagctttaggaatcattttctgatgagtgctccttctgtgggtgtccattt

SEQ ID NO: 126551 - DNA, 175 bp, Homo sapiens
ggaaggcagtggtgggcaccatagcacatgaaaactgcagggagactacagacctgtggatgtgtaggaggaagaggttatgcacagaggaataccatacaagatctaaggccttcagaagaagcttgggtgagattctgggaaattaagacatttacaggcagccagaggaaac

SEQ ID NO: 126552 - DNA, 799 bp, Homo sapiens
ctctagggaagacttccatgcctttctcttaacttgcagtgttacctgcaatccgtggcattccttggatcatgtcagtctctgggatccatgatcacatttgcattctccctgtgtgtctatgtcccaatttctctcttcttatagggcatcaatcattttagatcaagggcccaccctactgcactatgacctcatcttaacttgcttgcatctgcaaagaccctatttccaaattcgatcacattcacagcttctggatagacatgaatttccaggtgtgttgggggaaggtgacactattcaactcaatacagtgtgaaacagaaagtgactaaaatagcaggtcagtatccagtctgttatctgagtgtcattgtaactgaaaatagtattggcttgatatttgtaaagacttgattccaatcatgtatggattaataaagtgtggcagagggatgtgagggttctcagagaaagagggaaaaaatgtcctgggcataaaaccagaagccacagttcacttactattcatgtctccatggcatttcaaatctttaaacattcttaacactttaaatatagcaaacacaaatccaaatatataacttatttttagtcagcagtaatgattatttttttgaataattacctcatacacaggtacacattgatcacatttttcccaccacttaaatttccaaattttattagcattgtatgtcttgttgcttctacaaattaaactcttttattcttttagcggtcaacaaaacagagtgtaataaaattcaaatga

SEQ ID NO: 126553 - DNA, 389 bp, Homo sapiens
cccaagttgatgtgtggatccctaatccccagtgcagcggtgctgggaagtggggccttggggagatggttagttcctgaggcaaagccctcatgaacgggatcaatgtccttagagaagacatctcaggggcttgttctgccatgtgaaaacccagaaacaaggcaccatctatgaagcagaaagagccctggccagatgtcacatctgctggcactttgatattggacttccagctcccagaactgtgagccatacacttttgttgtttataagttattgagtccaaggtatcttgttatagcagtctacgtggcttaagacagtgtccttcttagaatgggtatttacccacttgcagaggtgcaaacagtgctgacttggtggtg

SEQ ID NO: 126554 - DNA, 2124 bp, Homo sapiens
cactctacctctgcatccaaatcaaggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaacgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccattttttttgctactgatgatgatgacaacctccagagagatgccatcattaaactaagtgctctgcccaaatatggctgcattgagaacacaggaacaggtgatcgttttggccctgaaactgccagtgacctggaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacagaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggacttgctctcttttcaaactaactattttgcttgggaagtaaagatggtgccacattaaatgctattttgaggtg

SEQ ID NO: 126555 - DNA, 437 bp, Homo sapiens
cactctacctctgcatccaaatcaaggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtagctacacacctacacactctgtcactgacctgcttggaggattttttgctctacaatcagttgttatgtgtctcagacgagagcaaagcgtctttgtgatacagactatgaggagct

SEQ ID NO: 126556 - DNA, 352 bp, Homo sapiens
ccggacctctcctacggtatctagctgactgcacggcagggctcatttggagaagcaatgggagatcagagcagagagtcgatgatggccaaattatgaaaactggaatgccagactatatttgcacttgtagaaggatacttacggctttttaacagaaaaattatggtggttaactttggagcacttaagcgttgttgcctggacatttggtgggtccccatctcctgactcaccaatgtttccctgtcacactgatccccactttgagcagctacttttcagaaaggttgcagttggaaagaaagcagtattcatggggcacaactccttccttcataggcagagggaa

SEQ ID NO: 126557 - DNA, 207 bp, Homo sapiens
attgtttacttaaagatggcatttgatttccttaaacttgggagatacatactagcaaatgcctgtagtcaaaggtggttcctgggtaattcaagggtgccaattagagtatactttaagccacgtgtaattatgtccaggctttatatatacttagagcataaaaataaactttcattctctcatatttaagtccattttatatag

SEQ ID NO: 126558 - DNA, 467 bp, Homo sapiens
tggattgtgttgccatccttcaagataagaaatacaagcaagaaagcaggctataggagaagatagtgagtttcatgacagatgtgttgaattgtaggcattttaatttttgaagtaggtaaggataaggacatgcttaagaatttatgtcatacaattttataatgttaagtcattaaattttcttcttcctgctggatatctctaaatgggagggccttgtcagttcctcatcttctctccaaagccagatttttcttctgtgttcccagttttagttattggcatcaaccaatagtcaggaacttaggacagcaatcttgaagtcattttcaatgttctgtttccctcaccttatgtgtccggtcagttgccaagtgccatcaattctaagtctgcaatatctcttttacctctgctcatttctcttgtcgttgtgtctgctctatatcatgctctcatcattt

SEQ ID NO: 126559 - DNA, 674 bp, Homo sapiens
ggtttaattgactcacagttctgcattgctgggaaggcctcaggaaacttacaatcatgatggaaggcaaaggagaagcaggcaccttctgctttgccttctaagggtggcaggacagagtgagtgcaagcgggggaaatgccagatgcttacaaaaccataagatttcatgagactcacttgatatcatgagaacagcataggggagactgtccccatgatcctattacctccacctggtcccgcccttgacatatggggattatggggattacatttcaaggtgagatttgggtggggacacagagccaaaccatatcgcatggcctcccccattgtcaacatcccccactagcgtggtacatttgttgcaattggtgagcctgcattaacacatcagcatcacccagtccatagtttacattagggttcactcttagtgttgtacaatccatgaatgacatatatccatcactatagtatcatacagagtatttttcactgccctaaaaaccctctgtgctctatttattcataacctgcctaccctacctgcctcccccaacccttggcaaccacagttctctttactttttccatagttttgccttttctagaatgtcatatagttgggtacatataatatgtagccttttccttttttctttcttttt

SEQ ID NO: 126560 - DNA, 337 bp, Homo sapiens
agctccgacaaggatagctccaggcttcttttcaaatcctctggagagggaatgtgtgcgagaggaagtcggggggaagagcagagacagaaagatgtaaatcaccgtcacttcataaaacggagttttcttgtaatatgctttggtaatgttgagctgaaaatagattgacaatcaaaatgggcttaatctgatattaaagaattctcttaaaatcccccaaacaattgagatttttttttccctttggtttgttttgcgttagctcttccaagaggctgtggatgtaaagaaatatattgacattaattaaagtgagttttgtgttgcttagtgg

SEQ ID NO: 126561 - DNA, 573 bp, Homo sapiens
taaccaaggagaaggatgttgaaaggatgactgaaagagtgagtctgaacaaggctattttcatttctacatgaccatcttgaaggcatcttatttcagcttggaacaaggtgcatgagcccagcttgtttgttgcatgtgggaagtgtatatttttagttgccttgtagagtggctttccacctcatttatgaaattggctttttatttttatccttttctctttttccctttcaccagagttggaacgtgaagcacagtttctacttgctgacgtagtatttcctcttgatttttagtggggttggggtgttttatgagtactaaggtcacattgaactttggacacctagtcaccttgttgctggctgcagagaagagcttgagaaggagacagaaatcttctcgtcttctcatcatggctttgacaaatgcccagggagactgcaactttcttctcaacttggctgtaacactggagcccttggccacttagaaggcctgagtttttttatattttccaccaagctgctgattctaaactgtggtggggtttctttcatggccagaatg

SEQ ID NO: 126562 - DNA, 303 bp, Homo sapiens
cctcagtcgccttaagggccacacagagctgcattacgtggatggagaggactgctttcactcctcagtgttcgtgctgggaagtccactcatgctgtctctgctacttagcatctctactgggtttctaatcggtttctcaacttcatgtatcggaaactgagctcgaaaagtttctccctcagtttttcctctctctgaaaatggcaacttgaactaatccttgattactttctctcctcttcctctctctcctcttcccctcctctcctctctcctctctctctctctctctctctcttc

SEQ ID NO: 126563 - DNA, 885 bp, Homo sapiens
atccttatatggcagaagggcaaaaaggcaaaaggggagaaatggctcccttgcatctcttgatgttattattttagcaaggacagagccctcctgacttattcacttcctaaaaggagccatctctttagtaatgttgcattgggattatgtgtcaacatatgaaattgggggaggcatattcagaccatagcacatttttcaatggaaatataatgttgaggaaacccagagaaggcaacattttcttgctcaaggagatgagaaagagggtaaaaaaggagataaaatttgacctatgtcctgactgtggtaatagaaaagttcatcttggctaaaaggagcagcatgatataaaatttgaaacctcatggtgtgttggagactgatgatgagtggctatgcctagagttgacagtatcggatttgaagagtgtaaggagtgatgtggatcatcagactggaaacagaatgtgagggtccagatcaatccattgggaccttatcctataggacatacagggaagccatttaaagttttaaagtgagaaggtgacatgtttagacatgtgctcctgaaagtacctagaggaaaaaaatctttggctgcatattgagccagaaatacaaagggaaatacagtatgttagcctcctcctctaagcccttctcagttcaacccactggacaagaaatgtatgtttctaaagaaagattgatgaagacatttaaagtctcttgaaagattttaataaagtgcttggcatgtagctggtactcaacaaatatttgttgaatacagggtgcctgttaagatctgatattaggtgaagagtaagtatgtccattcatttttcagttgcctatacatccatccattcatcc

SEQ ID NO: 126564 - DNA, 410 bp, Homo sapiens
aagatgctcaacatcattagtcaccagggaaatgcaaatcaaaactacaaagaagtaccatttcacactcaaggatggctataaaatttttttaacgggaaataattgttggagaggatgtggagaaactggaaccttcatatatttttggtggtaatgtaaaatggttcagcaactatggaaaataggtggccgtttccttaaaaagttaaacacataattatcatgtgacccaacaatttcacttctaggtatacatccaaaagaactgaaaacagtacatattaatgtacaaatatgttcacattagcaccattcatagtagccaaaaagtataaaacagctgggcgcggtggctcaccgcctgtaatcccagcactctggagcctgaggcaggtggatcgcttgag

SEQ ID NO: 126565 - DNA, 308 bp, Homo sapiens
ccaaactctgagcctttccaactagaacacggaaaaggaaagaaatgcaagataaggcactttgctgtgtcactccttagaaagtcagagaaaattaaataagtacaaccaaatggatttattgcttgggtgacgatcttcaagtgacagggaaaaagaataagaaaataaaaatgttagcactgaataaggagcagaacaataaatacttagaagatcaatgtacctggctgagcatgctggctcatgcctataatcccagcattttgggaggccgaggcgggaggattgcctgaggtcaggagttc

SEQ ID NO: 126566 - DNA, 550 bp, Homo sapiens
cgtggtggctcacgcctgtaatcccaacacttgggaagccgaggcgggcagatcacaaagttaggagatcgagaccatcctggctaacatggtgaaaccctgtctctactaaaaatataaaaaattagccgggagtggtagcatgcgcctgtagccccagctactcaggagccagtatgcttggctaattttttaaaaaatttttttgtagagatgggctctcactgtaacccaggctggtctcaaactccggaggccaagccatcctcctgcctcagcctcctaaaatgctaggattacagacatgagctagggtgcctggccttaaatttgttataaaataaaatgaacatgaaaaatccttggccttgccaatgatcacgagaccagcctggacaatgtggtgaaacctcatctctactaaacatacaaaaaaaaaaaaaaaatagccaggcgtggtggcacacacctatatagtcccagctactagggaggctgaggcagaagaatgacttgaacctgggaggcggaggttgcagtgagtcaagat

SEQ ID NO: 126567 - DNA, 286 bp, Homo sapiens
ctcaatataacatctgtttataccaaactgataaaatataattagataatatattgtaagtcgtattctgtctttttcttcaaggtaatatgtttactatcaattatatgcagagtagtgttgtaataagtagaccctggagatggacagtttctgcttttaaggtttaattcaagagaaaggaacatttgataaagacaaaaaaattatggacgaatcagagaagtggagcctgttggcaagaaatgggctttggagaaatgggctttggagaaatgggctttgg

SEQ ID NO: 126568 - DNA, 372 bp, Homo sapiens
gctcacggcaacgtctgtctcccgggttcaagcaattcttgtgcttcagcctcccgagtagctggattacaggcgtgtgccaccatgcccagctaatttgtatatcttttagtagagatggggttttgccatgttggccaggttggtctcaaactcctgacctcagattttatccttttcaaaaacctgagcttgttaattgtctcactaaatgagacttaagtttttatctttgtaaaacaaaacaaaaaacccttgctcaactcaactgggaatccacttgacttctggaggtctggaaacaaagggattgtgcccaagggccactctgggtgttcatgggccacaaaaaaacaaaaacaaaaacaaaac

SEQ ID NO: 126569 - DNA, 321 bp, Homo sapiens
ttcatggtctctgtctccctttccaccaagtgcagaccactcacgtgagctcacaaccaaactgaaggaagagccgaggcaaggtgatgaggttaaaaagtgaggccagggagtcaggagataaggctccctcctcttctggtctcaaccagtctcacagcccttgtacagtgccccggaaaggtatcattcctgggagtaaactgcctgaaaaggtcatggctggctcggggtgctgccggcccttggttgtctgatgcatgtctgcatggcctcagagcacccaatgtcctgtctgcatctctaggaacctgccagtcc

SEQ ID NO: 126570 - DNA, 412 bp, Homo sapiens
attcttcccacagcgagtccttccacctgcctccctcagcctcctaacaagcctccctcctttcagaaatctttcatcctccctttcagaaatctttctaaaacccccatctcagccagaagcagtggcttatgcctataatcccaacactttggaggctgggtgtggtagctcacacctgtaatcccagcacttcaggaggctgaggcaagagaatcacttgagcctacaagttcaagaccagcctgggcaacacagcaagaccctgtctctaccaaaaaaaaaaattagccaagtgtggagtggggacctgtggtcccagctactcaagaggctgaggtgggaggatcacttgagcccaagaggttgaggctgcagtgagttatgaatgcaccactgcacttcagactgg

SEQ ID NO: 126571 - DNA, 2498 bp, Homo sapiens
  misc_feature (1857)..(1857): n is a, c, g, or t
aatttaaatccactttttattctttcacagattttaacaattatacacaacttttaacataaaggtagtgaaatctcaaggataaggaggcaatatatatggcctcttctattcgttattcaggatggaaggaaattttcaaagtacagtgtgtgagattcaacactggaaaaatacatatgaaacttgtttaattggctccacttaggaccagacacagcacaataaatacagaactgcatcatctttttaaaagatcattgtaattttaacacattcttactaaagaaatacatactatcagtgaccgatctgaaactctgtaacaggtgaagggagacttacgatgaatatctgagcataggttcgctagcatcttcacactcatacataaacattcttaaagggaataagaatgatttcaaattcaaaacaacaacaacaacaaaaaaacaaatttggtcaaactttcttcatcataccattcattgctatcacaatcctagtttgctggtaggtttaagaaaggaatagaaagtttttgaaatccttttaatttctaccagtcttagggcctcttgagtaggccactttggaagcaaactgattaaacagcaccatcaagtccgtatctcaacaaaccattgcataatttctgtcaatgttctcaaaggttaaaacaagttgtatagaagaatacctttcctcaatagcaggccactgtaaaaacatgtaatctgcaagaatttaaacaaaactatcctgaattctctactgattgcttctttccttaatagaccaagagataggcattacctaaaaaattaaataataatatactgaggcataaaataaatactttatttatgctatcacaatttgggtatttgaagattgttagccatgttcacacaccctttcctcttcccaaagaggaagcaacggtgccagcactattggtcagaaagagttaatgggaaactgttgctctcagagctgttctgcaatatgcagacacataaattattattttaaacatatacttaaaagacggataaaatgattttttttcatgtgacccagattctgttatcagtagatacaaaattaatttcattcctattaggatggaaactggtatgctgctgtggccatagatattctgagaaacctcttaagccagtgaaccaaaaaccatatgaaagaaagtaatactttctatgattggtcaactggctgttcaaaaattcaacaagcaaacaaacatgcaaacatgtgacatatgtcattattttgtaaaaacataatgccactctggccccaggaatcactacagcccagctggtccttaaaggtgcaaacagcctttaattgctactaaacatcttctctggtattttactgcccatcacacttgccacatgattctcagaagcttaggcttccaagatgtttaaggaaaataaacagggtgtgatgtggatcaagttttcagtgattgttttaagtgtcattttaaaaagaacttcctagtaatgaagtatgtaatagtccttgatattaaattttttctagtgaaataaactatgctttaataagacaatgttgctctaagtttgaccgcctgattttttttttctcttttttagagggtactatttcatatattgtgtgagccccacaaatgtctattttaaaaagagtatagtccctggccaggcgcggtggctcacgcctgtaatcccagcagtttgggaggccgaggtgggcggatcacctgaggtctggagttcgagggaagctctacgtcttgggggccgcatggtgccgagagcgcagaccagacccgccccgccnctccgtgccacgcacgcgctcggctccgcgcttaatgaagcagtatctgactgtgttgcccaggctggtcttgaactcctggtctcaaatgattctcctgctttggcctcctaaagtgctgggattacagcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaat

SEQ ID NO: 126572 - DNA, 2101 bp, Homo sapiens
  misc_feature (1857)..(1857): n is a, c, g, or t
aatttaaatccactttttattctttcacagattttaacaattatacacaacttttaacataaaggtagtgaaatctcaaggataaggaggcaatatatatggcctcttctattcgttattcaggatggaaggaaattttcaaagtacagtgtgtgagattcaacactggaaaaatacatatgaaacttgtttaattggctccacttaggaccagacacagcacaataaatacagaactgcatcatctttttaaaagatcattgtaattttaacacattcttactaaagaaatacatactatcagtgaccgatctgaaactctgtaacaggtgaagggagacttacgatgaatatctgagcataggttcgctagcatcttcacactcatacataaacattcttaaagggaataagaatgatttcaaattcaaaacaacaacaacaacaaaaaaacaaatttggtcaaactttcttcatcataccattcattgctatcacaatcctagtttgctggtaggtttaagaaaggaatagaaagtttttgaaatccttttaatttctaccagtcttagggcctcttgagtaggccactttggaagcaaactgattaaacagcaccatcaagtccgtatctcaacaaaccattgcataatttctgtcaatgttctcaaaggttaaaacaagttgtatagaagaatacctttcctcaatagcaggccactgtaaaaacatgtaatctgcaagaatttaaacaaaactatcctgaattctctactgattgcttctttccttaatagaccaagagataggcattacctaaaaaattaaataataatatactgaggcataaaataaatactttatttatgctatcacaatttgggtatttgaagattgttagccatgttcacacaccctttcctcttcccaaagaggaagcaacggtgccagcactattggtcagaaagagttaatgggaaactgttgctctcagagctgttctgcaatatgcagacacataaattattattttaaacatatacttaaaagacggataaaatgattttttttcatgtgacccagattctgttatcagtagatacaaaattaatttcattcctattaggatggaaactggtatgctgctgtggccatagatattctgagaaacctcttaagccagtgaaccaaaaaccatatgaaagaaagtaatactttctatgattggtcaactggctgttcaaaaattcaacaagcaaacaaacatgcaaacatgtgacatatgtcattattttgtaaaaacataatgccactctggccccaggaatcactacagcccagctggtccttaaaggtgcaaacagcctttaattgctactaaacatcttctctggtattttactgcccatcacacttgccacatgattctcagaagcttaggcttccaagatgtttaaggaaaataaacagggtgtgatgtggatcaagttttcagtgattgttttaagtgtcattttaaaaagaacttcctagtaatgaagtatgtaatagtccttgatattaaattttttctagtgaaataaactatgctttaataagacaatgttgctctaagtttgaccgcctgattttttttttctcttttttagagggtactatttcatatattgtgtgagccccacaaatgtctattttaaaaagagtatagtccctggccaggcgcggtggctcacgcctgtaatcccagcagtttgggaggccgaggtgggcggatcacctgaggtctggagttcgagggaagctctacgtcttgggggccgcatggtgccgagagcgcagaccagacccgccccgccnctccgtgccacgcacgcgctcggctccgcgcttaatgaagcagtatctgactgtgttgcccaggctggtcttgaactcctggtctcaaatgattctcctgctttggcctcctaaagtgctgggattacaggtatgagccactgtacctggcctacattttctttttattcaagtcaggtcaagttatgtttttggtcacttgccaacctttgttaagacagaggaggcagaagaaatggagtca

SEQ ID NO: 126573 - DNA, 4243 bp, Homo sapiens
aggctctcagttcttcagacctgctctatctcacctctcattttgttcatattctccacctcttgtgcttgatgaactcctattcacctatcaggtcacaacttaaatattttttcctccaaatctctggactacataggtccaggcccccatcaaatgctcccatagcacattgggcttcctcatcaacatgctcgttatacttttctagaattgctggcttgtcctccttgttatctccctaatgcagagaccattactcatcattgtagcagatatttatccatatcaggtactcagcaaacatttgtggaatgaatctatatgtgaaactatacttctatggcaagtttgtttggttcagaaggcttgcatttcatgtatattgggagactggccaacatttttatattcttcctcctatgctcaaaccataaataattatgttagcaaacactgaactttgtcttttgaaacataaatagaaacatccttagtaacagtactaacagtaatcatttttcagaaataagaattcacaccagtgatacagaatggcctttgaccattatctcagagaactagcagtcgatagacatgctgaagtgataattccaaaaacttcagtttcattcatccctacttaaatataagagaatcaacttctattttatgtctgtattcccattttctaatatactacttgtcacagaggagatgcccaaccagtgtttttcgtaaagtacctgaatagattaataataatgctagtgaaatatatttagtgctgttctaagcactttacatgaattaactcatttaatcctcaccgcaaccataggaagtagattctattatttatccaattttacagatgaaaaaactgaggctggtcacttgacataaattaccagtgctggccaggactttagagaccatttaatccaatgctcttattttacagaggtgcagctgaagcctaaggaggtgatatgatttcctacacattcatgcaccttcgtgcacatccattaaaacttttattaaatggaacccactatccatactccaattagctaggtgccttttttcccccatttagtaatttacaattaattggaggactttttatagttatatttagaggaaaggagcatgttttactctatatcaactttcttttctgcttaaaagcattttgattctttattttaccagtcattttagttcttttaataggtttaatacacagatcaaacaagacttaaatacatttttaacaatgtaacaatttaaaagaaattgcctaaaacctaggtcttctaacttggagcccagtgctttttttattgctccgctgagtcaaaaggtgaatatataaacatgatttcagatagaatgcagaagctgtatttaattaagttggcttttgtcattaaagaaatcagaaagtttggacaactcaggaatggatttccatcctagatggtatttactactatttctggaattaagtttactgtctatattcaggattttgtgcataagagacgtgaccactgaggttgtgtgtcattcttatctctactccaggggtcagcaaactttctctgttaagggtcagatagtagttttttggcttttcagtctctgtttggctctgctataaacaatacataaatgaatgagcatggctatgttccaataaaacttaattgacactgaactttgaatttcatgtacttttcaaatgtcacaaatgttttccttttgatttttttcagaaagccattaaaaaaatccaaagaccattcttagcttgcaggctgcacaaaaacaggaagcaggcggggtttgcttatggactgtggctttcccacccttgttcttagatagggacacaccaatatatcatgattagttgtaaaggatactgccagtaacatattattactggttagttgtaagaatatcaaagttagtgaataatttgcttttaaaataaattattgttgatttatttttataaataaatggcacagggcatctcatgctcttgcattctaatatattttctggaattgatgcaaaagtggtggcagtaaagtacagagccggctaagcagcagttttgtcttaagtaactgtggtgatcatggacaaccattgcgctgaactgctcttcatggtaaggatttcagtgtttcagagtaattcattaacctagagatgttttaaaaagttgtatcggccgggcgcggtggctcaagcctgtaatcccagcacttcgggaggccgaggtgggcggatcacgagatcaggagatcgagaccatcctggctgacacggtgaaaccccatctctactaaaaatacaaaaaaaattagctgggcgtggtggcgggagcctgtagtcccagctacccaggaggctgaggcaagagaatggcgtgaacccgggaggtggagctttcaatgagccgagattgcccctctgcactccagcctgggtaacagagcaagattccgtctaaaaaataaataaaataaaataaaataaaataaaataaaataaaataaaagttgtatcaaaatctgctgcaccatgggagtgttttacacatgtgatgtggcatctaccttatgtaccataatggaaaaatgtttgagaaccactgcactaggccaaaggctgggatgtgtatactttgctgccgtgtataattgtatgtccttgttctctaaatggaattggttatgtttagtgaacagttaggtggttctccgtgtgtttatatacacagacgatccccgaatttggatggttcaacttaagagttttcaaacttacgatgatatgaaagtgatatacatttgatacattcctacaacttacaatggggttatgtcccataattgttttgacttatgatattttcaacttacaattgatgggtttactgagacataaccctcttgtaacttgaggagcatgtgtatatttgtacatacatgatggtgtgtgtttatacacaaaggcctgaatatacacaccatgagcatttgaaggtctttgtcaaggttgtttctgtttctgatctcttgcctactttaaaacccaagaggtagaacattatgcatattacaggcaaaactatgcttgagtttatagcaatgtagtttgtagaaaggattcctgggatgttttactaagcctttcctcctccattcaacattatatgaattgttaagaacatataaagtaccactgttgaatgtgacttttctatactgttagttaagaaaccaagactagtgttagctgagtaactggcatgttgatgcaacctatacaggttttgtatttaattaggttccttattcagttattcaagtatccagttatttagtttcaaggtagatttctttgtttttatatttaataaaagacttgcatataagttcctcttcatgaaaatagtggctaggctagtgtgattttaagtatgtctggcaactcaaaatgtaatggattcatcaagctatttgggatttttaacataaaacacactgctgcttgattaatgtgttcagttttcccctggatatttgctattaggctgatagccatttggttggattcttctggagagtaattgattctctaaggtaatggggtgctgcagtgggtgtagcattcacccaggtcactagaatcctacctgtttcatcacatagaaggccctggccatggggaagagtgaatgcagcttctccggatgccttatttccacagacatgctgatatgctggaacagtctggctccaggagtattaatatacttttttgagactgtctacaaaatactattttgtaaaaactatgcctttacatagacattgataggttatatttgttttataacaattgtgtacctaatgtttgtgattaattttgagatttatgtatatttataagcctatcttatgtaaatttttactctaagatgtgtggcacattactaataaagacgtggatttctatttatgtaaagtaattgtagcaatattcctagatgctacctaaatgattgttctgtccatttgccatcacaaatacttttatctttggatgattatgttagtcagaatatattaattagatttaaactttaaaataagaattacaacatagtttgaaattcttcctgttgaagtaattaaagttagtttataattcctta

SEQ ID NO: 126574 - DNA, 4189 bp, Homo sapiens
aggctctcagttcttcagacctgctctatctcacctctcattttgttcatattctccacctcttgtgcttgatgaactcctattcacctatcaggtcacaacttaaatattttttcctccaaatctctggactacataggtccaggcccccatcaaatgctcccatagcacattgggcttcctcatcaacatgctcgttatacttttctagaattgctggcttgtcctccttgttatctccctaatgcagagaccattactcatcattgtagcagatatttatccatatcaggtactcagcaaacatttgtggaatgaatctatatgtgaaactatacttctatggcaagtttgtttggttcagaaggcttgcatttcatgtatattgggagactggccaacatttttatattcttcctcctatgctcaaaccataaataattatgttagcaaacactgaactttgtcttttgaaacataaatagaaacatccttagtaacagtactaacagtaatcatttttcagaaataagaattcacaccagtgatacagaatggcctttgaccattatctcagagaactagcagtcgatagacatgctgaagtgataattccaaaaacttcagtttcattcatccctacttaaatataagagaatcaacttctattttatgtctgtattcccattttctaatatactacttgtcacagaggagatgcccaaccagtgtttttcgtaaagtacctgaatagattaataataatgctagtgaaatatatttagtgctgttctaagcactttacatgaattaactcatttaatcctcaccgcaaccataggaagtagattctattatttatccaattttacagatgaaaaaactgaggctggtcacttgacataaattaccagtgctggccaggactttagagaccatttaatccaatgctcttattttacagaggtgcagctgaagcctaaggaggtgatatgatttcctacacattcatgcaccttcgtgcacatccattaaaacttttattaaatggaacccactatccatactccaattagctaggtgccttttttcccccatttagtaatttacaattaattggaggactttttatagttatatttagaggaaaggagcatgttttactctatatcaactttcttttctgcttaaaagcattttgattctttattttaccagtcattttagttcttttaataggtttaatacacagatcaaacaagacttaaatacatttttaacaatgtaacaatttaaaagaaattgcctaaaacctaggtcttctaacttggagcccagtgctttttttattgctccgctgagtcaaaaggtgaatatataaacatgatttcagatagaatgcagaagctgtatttaattaagttggcttttgtcattaaagaaatcagaaagtttggacaactcaggaatggatttccatcctagatggtatttactactatttctggaattaagtttactgtctatattcaggattttgtgcataagagacgtgaccactgaggttgtgtgtcattcttatctctactccaggggtcagcaaactttctctgttaagggtcagatagtagttttttggcttttcagtctctgtttggctctgctataaacaatacataaatgaatgagcatggctatgttccaataaaacttaattgacactgaactttgaatttcatgtacttttcaaatgtcacaaatgttttccttttgatttttttcagaaagccattaaaaaaatccaaagaccattcttagcttgcaggctgcacaaaaacaggaagcaggcggggtttgcttatggactgtggctttcccacccttgttcttagatagggacacaccaatatatcatgattagttgtaaaggatactgccagtaacatattattactggttagttgtaagaatatcaaagttagtgaataatttgcttttaaaataaattattgttgatttatttttataaataaatggcacagggcatctcatgctcttgcattctaatatattttctggaattgatgcaaaagtggtggcagtaaagtacagagccggctaagcagcagttttgtcttaagtaactgtggtgatcatggacaaccattgcgctgaactgctcttcatggtaaggatttcagtgtttcagagtaattcattaacctagagatgttttaaaaagttgtatcggccgggcgcggtggctcaagcctgtaatcccagcacttcgggaggccgaggtgggcggatcacgagatcaggagatcgagaccatcctggctgacacggtgaaaccccatctctactaaaaatacaaaaaaaattagctgggcgtggtggcgggagcctgtagtcccagctacccaggaggctgaggcaagagaatggcgtgaacccgggaggtggagctttcaatgagccgagattgcccctctgcactccagcctgggtaacagagcaagattccgtctaaaaaataaataaaataaaataaaataaaataaaataaaataaaataaaagttgtatcaaaatctgctgcaccatgggagtgttttacacatgtgatgtggcatctaccttatgtaccataatggatgccgtgtataattgtatgtccttgttctctaaatggaattggttatgtttagtgaacagttaggtggttctccgtgtgtttatatacacagacgatccccgaatttggatggttcaacttaagagttttcaaacttacgatgatatgaaagtgatatacatttgatacattcctacaacttacaatggggttatgtcccataattgttttgacttatgatattttcaacttacaattgatgggtttactgagacataaccctcttgtaacttgaggagcatgtgtatatttgtacatacatgatggtgtgtgtttatacacaaaggcctgaatatacacaccatgagcatttgaaggtctttgtcaaggttgtttctgtttctgatctcttgcctactttaaaacccaagaggtagaacattatgcatattacaggcaaaactatgcttgagtttatagcaatgtagtttgtagaaaggattcctgggatgttttactaagcctttcctcctccattcaacattatatgaattgttaagaacatataaagtaccactgttgaatgtgacttttctatactgttagttaagaaaccaagactagtgttagctgagtaactggcatgttgatgcaacctatacaggttttgtatttaattaggttccttattcagttattcaagtatccagttatttagtttcaaggtagatttctttgtttttatatttaataaaagacttgcatataagttcctcttcatgaaaatagtggctaggctagtgtgattttaagtatgtctggcaactcaaaatgtaatggattcatcaagctatttgggatttttaacataaaacacactgctgcttgattaatgtgttcagttttcccctggatatttgctattaggctgatagccatttggttggattcttctggagagtaattgattctctaaggtaatggggtgctgcagtgggtgtagcattcacccaggtcactagaatcctacctgtttcatcacatagaaggccctggccatggggaagagtgaatgcagcttctccggatgccttatttccacagacatgctgatatgctggaacagtctggctccaggagtattaatatacttttttgagactgtctacaaaatactattttgtaaaaactatgcctttacatagacattgataggttatatttgttttataacaattgtgtacctaatgtttgtgattaattttgagatttatgtatatttataagcctatcttatgtaaatttttactctaagatgtgtggcacattactaataaagacgtggatttctatttatgtaaagtaattgtagcaatattcctagatgctacctaaatgattgttctgtccatttgccatcacaaatacttttatctttggatgattatgttagtcagaatatattaattagatttaaactttaaaataagaattacaacatagtttgaaattcttcctgttgaagtaattaaagttagtttataattcctta

SEQ ID NO: 126575 - DNA, 2541 bp, Homo sapiens
aacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 126576 - DNA, 2252 bp, Homo sapiens
aacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagaagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 126577 - DNA, 2597 bp, Homo sapiens
aacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaagggacagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatgtccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgttcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 126578 - DNA, 418 bp, Homo sapiens
cagatgtggtttggagcacagagaagtcaagcaattgtccaaggccacacagaacgggacaaagccaggacttgaatccccacggtttggccccaggtctttgctcttcactactcaatacactgcttgtccactagcagaggggtgtgggaatcgtaatgacaaagcagcctgttgagcacccactccaggcaccatgctgagcactgtgcgtggttaacgtgccggacctccccacaccgagtcgttggccacatgtgggtttgcatctgagtccagcgcttgcatccaagcctcagcgcttgcatccaagcctcagcactggcccactggcaggagcacgcttttggtcctcactccctggagggactcatgccctcaccctgtccagcacgagtttggctccggggactgttgg

SEQ ID NO: 126579 - DNA, 426 bp, Homo sapiens
cagatgtggtttggagcacagagaagtcaagcaattgtccaaggccacacagaacgggacaaagccaggacttgaatccccacggtttggccccaggtctttgctcttcactactcaatacactgcttgtccactagcagaggggtgtgggaatcgtaatgacaaagcagcctgttgagcacccactccaggcaccatgctgagcactgtgcgtggttaacgtgccggacctccccacaccgagtcgttggccacatgtgggtttgcatctgagtccagcgcttgcatccaagcctcagcgcttgcatccaagcctcagcactggcccactggcaggagcacgcttttggtcctcactccctggagggactcatgcccaacccacagcaagctctccaggcacactctaagtgattgttccccgct

SEQ ID NO: 126580 - DNA, 261 bp, Homo sapiens
tttcagagtaagttcttaaactgaggaggcatcgtgagagcgcagttcaagaaagaataacgctccgactcatacccaatggatatgtgtacttttttagaagccagacacaaaagaccacatatattgtgtaattccacttatatgaaatatccagaatagaaaaagccacagaaataaaaaggagatcagtggttgccagcggacaggtggaggggaagatagggagtgattgctagtgtgctagctgaataatctcaa

SEQ ID NO: 126581 - DNA, 625 bp, Homo sapiens
ttgaatcaaatccggctgcccctagaattcattctaattatttttgttttctgaactctcaggagtcgacactttttttttccttttttaaatcactcgttgaacatctttatggccctctgaagcatttctcagatgcagaaaagtttctttgctctttattctttatttcttaagttagtgttaatatttccaaacatagatcattttcttttatgtgctgcagtagataatagaagaagcaagatatatcagaacaagtctttccaaaatgtaagtaaatacctggagagatttgaaatgccttcctagacccaaatacctaaagttgtattcttgttctatggcaattgaaaatacctttttcatatcaaatattaactctgcatcaaaatgacgtgtcttacaagttttgaatgtaacttgtttgcagtcccgtacgtagcctgatgacatgattgtttcttaatcaagtgtcatgttaaagagtgtatgtatatattcccacaaaagctgttactgtaatttcttgcttaaactctcaaagtgtaatttaccccatcaagaaaaatattttgtcagggcacggtggctgtagtcccaaggcaggaggatcacttgagcc

SEQ ID NO: 126582 - DNA, 245 bp, Homo sapiens
gctctttgggcaaggtgggtaagggcgtgggtgagggctccggggtcaacgcgggaaccacactggagtcaggggtggacaaagcaaagtcagggcttgtcaagatgaggtcggggttcgtccgggaggccgggtctggggtgggtggtgaagtgtccggagcgtcagaggtcgcctcggacgtcaaggctgagtggggagtgagctctcgactggagtcagaggtcagcgctgggcctgggggt

SEQ ID NO: 126583 - DNA, 1566 bp, Homo sapiens
cgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcggctacgcgcccacttggcgggccctggctggggatgtgcgagactgggccagtgccattcgcgtcgcagctctggactgcatggaagagaagaaccaggcttcctttgcctgaagctgttttgggaagggtctccacacaggcactgatctcccaagctttggtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaaaatga

SEQ ID NO: 126584 - DNA, 2314 bp, Homo sapiens
ctctttttaacaggggaagacctcggggtaatttctctgtgtcaaaatggcgcatccctggcgaatctcaaagtccgcttcaagcctccttctcccagggtgtttaccgtcacaatagtagctctctggatgttcccatcttgcttccaggatcgtgacaatcgacgggggttgcagactttccacggccagtgttagttcgttcccccacaagcacgtgtacatccttcgcatgcccttcaatttgtgccccatcctgcaggccttgtgttttggtatttggagtacttcgccgcatccccccgtcggctcttggctcccccccccacttggccctgcgtgcaccctccagtccgctcgctccccgtcgcccccggtcccgcccacgccccctgctccaggctgccaagtgttttcttttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagctttggtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaaaatga

SEQ ID NO: 126585 - DNA, 318 bp, Homo sapiens
ggcatattgaggccgtaatttggatcagatcttgctggtctgagcatacgcaacaagagagagaaccctggctgaatttttgcgagtggctccagtagagctgctggtgacccatcttgctctcaggagtgcagtgagacaaaaggaaagagctccagttaatttttataccttgtaattaacagggactactatgttaaactgggagggagcccaagtatttcccaaactggggagtcttgacattccctagaaatgtctttctgttgtacctgctgatggactctcttagacaatgaatcttgtctacctgggtag

SEQ ID NO: 126586 - DNA, 448 bp, Homo sapiens
aaggggtggtgtcccaggctagagctgaagggtcccagagctccccgtcactgccctccaggaaggcactgcctgcctggatggtgaaggcaaggcttaggaggcagcccctctagcagcatctgaccatgcagtacctgccctcactgaagtgctacaggaagccatcagcttggcccagtgctgagcacccaaaagcctgcacccagccccttcctcttttaaagtcaagattccagggaagagggtcaaggacaggaagggggaggatccaaaaatgagacagcaaggccagagttgccttagttggtgcgaaatgcagcaatgaccaagctctgtgcatggtgccaaagagacattccaattccctgcatccgcatagtcagcacagggccagcttggagccatctgcagacatggacccttcaagcaaagcacgccggctgga

SEQ ID NO: 126587 - DNA, 521 bp, Homo sapiens
ctccacggccccatggctaatggctgccatactggacggcaaacactcaacatttccatcatcacagacggtcctactggaccgactcccagcagcacaggccgcacagatcactgtccacctgccgcccactctccctctctgctgagtatatttaggggcagcaacaggtctagcttaaagacgtttccgagctgctggaagccaggcatgatgacatgatcaatatctgggcctgagatgtaagcaccagtgttgtgttgaactccaggaaacctctaagagaaagctgccctgctggggacggagcttctccggcagtcctgcggctccctctcctccacactgtgactcatccatgacagccagcgacggtcagggcacggaggtcatgcccaagcacacacgagtgaaccacagaaggctgtcctggatgctaagcagtcactaattctgccctggcctgctgaccttctatgtggagaagaagtgcacttctggtctctttcatattcttgata

SEQ ID NO: 126588 - DNA, 624 bp, Homo sapiens
ccgtgatgtaacatggaatgtttttcaggggctctttgtaacatcgtccagtgaggagcgggcccctaatgctctcacttcagctgagttcatgcttttgtatgccttattttagttgccgtcagacacaggaaaccaccaggtaatttatctgcctgccagtgggaggactcacgttgactggattcagactctccctttctgtctctgttggtctctctcttttctctcccctccctctgcctctctctcctccctttctttctctctgtgtctctctcacatacacactcacacacactctcacgccctgtctcgtacatatacatatcagcacacacacttacacatagtcactgacacacactaacactcaattcactctcacacagtctcatacacatatgcacacattcttacacagttgctcacacatgctcacacttatacataaactcagtctcatgcactctcacatacacatacacactatcacacacactcttacacagtcgctcacacatgctcacatacgtaacaccctcacacagtctcatacacttacgcactcacatactctcactgtctcatttacgtaccgtcacacacactcttacacacagt

SEQ ID NO: 126589 - DNA, 749 bp, Homo sapiens
ctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctctttaaaaaaaag

SEQ ID NO: 126590 - DNA, 453 bp, Homo sapiens
ctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggatctgtgcctggacagtggcagaacctttccagtgttcttttggttctgatttcatcagtctcaataaagttccgatctctctttaaaaaaaag

SEQ ID NO: 126591 - DNA, 1078 bp, Homo sapiens
ctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctctttaaaaaaaag

SEQ ID NO: 126592 - DNA, 711 bp, Homo sapiens
ggattaattgcattcagtttgagaagcatggtattgaatgttacatgtaaacaaaacaatctatgcaggatcactttgtttcatttttcttttttctcccaacacctgggagtacttgggaatatcttccttttctgtttgtacaaatattagaaagtttccccctgggtcttggttgtctaatctttttctttttaatttagtcttaactgttttcctgatttatttttattttgctcttccctatgctgaagattttagaaaatgtaattagagtgtaataagaagtcttattgttaaaaaaaaatacgctgctttagtacttattaatataataatttggtagggaggaagataatcagacttgaaatgtacagcattaagatattctgaaaacatttttaaaactattcatttcgctaacccccaaaagaatgaaatgaaatgggtctccttttttctcctacatttcactaacactgatcagtttcttaaactgtttaatatcatttttagtgtccttagtgagaagtagcgtcttctgtataatgtaatttaaaaatatttgccaacattaaatgtgtgattatttcatatgatatctttgaggcttaattttaactcttaaaagattgaaacactttctgttgtgcattataagcaggtgtttagtatttcctttttcttcccatcctttagctccacctttag

SEQ ID NO: 126593 - DNA, 339 bp, Homo sapiens
tctctagaggatccggtccgtgatctcccactcggcctcccaaagtgctgagattacaggtgtgagccaccggccacaaaattattactactggtaattaatactactggtaagctagattgtttgagataccgtactctctagaggccttaaataaaaaataaattattgctagtaatatattttacatttttaatttttcttttattgaaaactgtctgtcatgagacagtaggttaagagcacagactcaggtgctaggctacatggtttgaatcttgctcagtcatttatcatttctgtggtcatctctttgtgcctagctcccctctataaaat

SEQ ID NO: 126594 - DNA, 706 bp, Homo sapiens
cttctctgggtgaggtggtacaaactccttggcatactctattcacctttgtggatcctgattgaatgccttgtcttaagtgtaagctccctgacccttactactagccgaaggttttgtctctgcaggtcaattccaaactaacaggcagatgctgttagctatctgcctccagggataaaccccatctttcaagcttgcttcttgcttgatgctttctgctgctttcttgcttttgtttcagctcgagtttgttgttgttttttttttttcctgtttctgtcttgaatgtagagggtatttttatttttattttttctgtttctctcttgagtgtatagtgtagagggggtttctgtcttgagtgtaggcctggagatttcccttatatggtacaaaccagcaatgaattaagaggtctcttttctccaagatctagtgttttgtactaggagaactctaaaaagtatctattccactgtagtgccaaagtacaaatttatttggatttattttttgccatcttattttttaatatatttctttttctatgttgtgcttctttcccacctttatctctcctatcttttgggatcagttgggttttctatttaatcatatattttccctttactgatttggaatgtgaatgttacaagtccttttgattatccttaaacatctaaaaatgctaccctctttccaa

SEQ ID NO: 126595 - DNA, 508 bp, Homo sapiens
gatgctagggtggaaggatggtcttagagagatagcaggggacaggtcagagggaattctggatcatgactttggctttcattctgagtgacatggggagtcgaggggacatgatttgacttaggttttaaggagtcactggctgctctgttgataatagactctgtaggggggcacatgaaaaggcagccagcctggccgcaatacagagtaccaatctgtaaaggaccctaaaaatagcgctgggaatgtaataaacaagacattgttggtactagaacttaccatagggaaagcactgtacacagggagggaaagagcccagggatgtttagttggttaacaaatatatctattgaatgccttcttagaaggataagctagtcagcaaaagggatagacattttgttttgctgagtcagaactccagtttccttcttagaccagagttcttgttgaatcagatcacttggagtgccccgtgtgtcagtcccactgccctcaggag

SEQ ID NO: 126596 - DNA, 560 bp, Homo sapiens
gtaaacactttaaaattatatggggaaatattttggggcaaggtatctgtctaagggcctagaaggctgtcctgtggagccagtccccactgtttcccttgttctttcttttctactttttgagtaacaaattctttcattaaaaaattttagagacctttaattacaaaaataatgtaaccacaccaaatgatgcatatgtataaaaaagtgatagtcccttcctcatcacttctccattcatctacttttcagaacaacttttaacagttccatgtgtgcacattataccttgaaaaaaagatgagtaactttttattacagttatctttttttaaaaactgtatcttggcatgtttgcaagatagaacataaacatctattgttactttaattcttgctttgtagtctgttgtatgattatcataatgtgtttatacatgttcctattgaagaatatttactttccagtttttgcagttaaggtactgtggtggtaagcattgttctacatactcttgcatgtttgcctttttttttttaaatttttttttatattt

SEQ ID NO: 126597 - DNA, 826 bp, Homo sapiens
aagggaaagataacatccaaagttttggaggtagtttaagcatttgtcttaagttttgtgtttgcaaaatactcttcagttgcctctcatttatccttacaagcctagccacacctgcccccagtgaacatctcatatttactgagaaataaaaatttagtacaggtgatttgccttgggtattgttaccagattgtgtttttgcccagtggagaagcagatgcatttaaaactgcacttgacacctgaaaaatcactgtcccagaagctactaagtcctttgtgaaattacaatgaggcggcgggctgaaccactggtggttctcctacccagggctcggcttcccacagacataagtgaatcagatgccagggtgtttcagtttaccgtagggggtgtgtaaaaagacgtaagattatttacttaggcagtgtagtgtggggacatcaccacagaccaatagtaagaaggttggccctgatgctgggctttttctaatagcatagacttgatcacatcattaacctctcttacctgtaaaatgaagacacctgcctttcctatgccacaggtggttgtatcaaatgaggtaatgtttgttaacattttttttgcagcctccgaagtactttggaaacgtactagcaccattctccgaggcccgatgatcgtacagtggctggaaacggcattttcgcatgtgcttttcctgagtctaggttgtcaggtggatccttcttaggctcctcagtttgaacaagctgtcagagtgtatcaaagaataccagataggaggagaagaaaaagtaacagctgaaaaaaaaa

SEQ ID NO: 126598 - DNA, 271 bp, Homo sapiens
gtaaaaaacaaaaaaacaaaaaaccaacaaaacaaaaacagaaacaacaaaaacatattggacgtgttcaggcagatttcccgtttaacatctgcatgtttctcagggacctgaaacctcagcactccttctggatacaaggctggcaggagcctctctgcctccctctccactgcaaaggagacccacgagggcaggggcttggcacatacggtgcctcttatctggtggcccccaagggtctcacagcatcctccctgcgtccctgtct

SEQ ID NO: 126599 - DNA, 428 bp, Homo sapiens
catcctgttcctcatagtcacattactgcacttcctgtctccacttctgcactatttatccctcacaccattgcaacgtcaataaaactgccactccctccactcgctctaaacctgatttttccccttgactctttaattttggttaggggcatagtcatccattctgtctcacaggtgagaaacctgtgagtctccttgggctcctacatctgcatctaattggtcttcaagtaccaccttctcctctctatctcccctgccctgtttagttcatctccaactttctcctggacatatgcaatactctgttattatctggtctttctgcttccaatcctacacatcctctctttcctcaaacccctcctacactggtgacaagattatgtattatgatactcatatcttacaccacacatatgtcc

SEQ ID NO: 126600 - DNA, 163 bp, Homo sapiens
aaagttcaaaattcgaaacacttctgactccaggcattttggataagggatacccaacctatattatgaagtggtagcaagaaaattacattgaaatggaacattttttcagtttatgtatccttttgcgaggtttttatttcaaaatatcacagtccaagcc

SEQ ID NO: 126601 - DNA, 704 bp, Homo sapiens
agccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatg

SEQ ID NO: 126602 - DNA, 453 bp, Homo sapiens
gatagaagatacctgcttgcattatggtattgccaaatgtaatagccatccttaagtttctgagggtgttaatgagatttttatggagcaaagagagctttaaagtatgatgccctcataaactcagctattctacaaataatagctgttaatgcattacattgtaattactctatcaaagtttattcctctgacttgaaattttaatctagttcaaatccttcagcatatgtcctatccatttataatctgctattttttaactggtgaaagatgaactaaaaactacagtggaagaaaggaagtcttcagaagcctcccccactgcgcaaagaagtaaagatcacagtaaggaatgcataaacgctgccccagattctccgtccaaacagcttccagcacaagaacagcacaagaaccgcacgccagcacgagaaccagcacaagaaccac

SEQ ID NO: 126603 - DNA, 4095 bp, Homo sapiens
  misc_feature (2)..(2): n is a, c, g, or t
tnggtgaatatagaaagtttgtaaaaaaagaggtggtacggtcggaattcccgggatgtagcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaattaaaatgccccg

SEQ ID NO: 126604 - DNA, 3867 bp, Homo sapiens
cgccgcattccctgtagccgggtctgggcccggagggcttcccttcccaaagcactggcccgggaaaagcccgcggcgagggctgttgcccaggaagacacggagagccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaattaaaatgccccg

SEQ ID NO: 126605 - DNA, 2898 bp, Homo sapiens
ctaattaagatcttacctcttccggcagaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaattaaaatgccccg

SEQ ID NO: 126606 - DNA, 1322 bp, Homo sapiens
  misc_feature (2)..(2): n is a, c, g, or t
tnggtgaatatagaaagtttgtaaaaaaagaggtggtacggtcggaattcccgggatgtagcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatgtaagtgtgaattgttcctatatttaattaaaatatatcagattggtgtaaaattgaatgctaaggtatctgtgaaatacccagaataggccagtccatagacacagaaagtagactggtggttatcagggcaggaagagacgaatggggagtgcctgctaacaggatacaggctttcttctggaagtgatggacgtgttctagaattagatagtgatgacagttgcacaaccttgtgaatatactacaagccaatgaactgtatactttaaaatagagaattttattgaatatctcattttctaaaatttcaaaaaacgta

SEQ ID NO: 126607 - DNA, 391 bp, Homo sapiens
gacggtatgtcagtcgacatgcttataagcactttgaggaaacgcagcacacgtatgccatgcagcttaccaaccatcgagtctgggactatgctggaggtgaataccactctcttttctaatttggactcattctgtgtggaaactttgccttcacaacgccttcactttccctcccagcttgaaatgtcatcttttgacagctgttgcaaacccaaattctcagtttccctgagggcactatttttctaggaatgtcttgaatcacacattataaagggagttaatacttccattcttgctttctccctcccctctaaaattcaaatgatttgacacttttaaagaaatattgtaaggcatttaaattagatctgaaaaaaaaattttg

SEQ ID NO: 126608 - DNA, 730 bp, Homo sapiens
ctgggattataggcgtgggccaccaggcccggctaattttgtatttttagtagagacagggtttctccatgttggtcaggctggtctcaaactcctcaccttaggcgatccgcccgcctcggcctcccaaagcgctgggattacaggcgtgagccaccacgcccagcccaatgctgacatttccttaaagagttctttcataacaagcgtcagttattatttggttccaggctttgcagaaatgagtgtttactttcagctgcacaagtgatgactagagggaaaaaaaactgctattaagggaaatgttgactgttgctggttgaatatgaaaattgtaccagctttcagcttgttgcacttcagtaccttctgccagttcaggtaaaaactctgttgtagcccaggaaatactgtaaacatggaatattgacttacagagtgtgattagcctaccaatcagcttcagtagatgtgacttttggtggttgctctctctcctaagtataaattttaaaagctgatgagaatgaataaagccatgcatattgaatataaagcagattttcagggtatctgtcttaatttttttccttttccccattggtgtacataggctgatgcggatagtttttatatgacatgcaatggccgccagttcaactcaatagaagatgacgtttgccagctagtgtatgtggaaagagctgaagtgctcaaatctgaagat

SEQ ID NO: 126609 - DNA, 329 bp, Homo sapiens
tacattttggtctttattctctatgtttctagtattcatatttactaacaagccagctggaatctcagcgaatctactgggaaaacaagatagttcggatagagaaggacacagcagaggaagtaagtctgtttggtttgggtgactgcggaaatgacacatggcagggcactctgatggggggtgtggaaggcagagtacagggaaagaggaatcttaccatcttcccttctcaggcaggtaataggtggagaactgttttgccactaaaaagaaactttggatttaaaggcttgactgttttgatattttggggtcttagggggttt

SEQ ID NO: 126610 - DNA, 2177 bp, Homo sapiens
  misc_feature (2)..(2): n is a, c, g, or t
tnggtgaatatagaaagtttgtaaaaaaagaggtggtacggtcggaattcccgggatgtagcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggacgaaggccggccttcgtggccttagagatggatgaggc

SEQ ID NO: 126611 - DNA, 3896 bp, Homo sapiens
  misc_feature (2)..(2): n is a, c, g, or t
tnggtgaatatagaaagtttgtaaaaaaagaggtggtacggtcggaattcccgggatgtagcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagtaagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaattaaaatgccccg

SEQ ID NO: 126612 - DNA, 3013 bp, Homo sapiens
tgctatcagtcagggggtgcctgactcaagtgctggttgggacaggatgggacaggactgcttcatggggtcagggagacaggtaagtttatttgagttatacatagatttaaaaccactgtggttcttcttaaagtcagcttgaccagaataaaggtttttataagtacatttattctgactagattgtaagccccaggaagacagaagcataatgtcatttgtgtcccctggtccagtatatattgagtagagtagaaccagggcgtaaatatacattctgttggttagttttagttttctgtggatcattaaatatcagatttttaaattggatttcagaggctgacaacagtgacttacattttggtctttattctctatgtttctagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaattaaaatgccccg

SEQ ID NO: 126613 - DNA, 1123 bp, Homo sapiens
  misc_feature (2)..(2): n is a, c, g, or t
tnggtgaatatagaaagtttgtaaaaaaagaggtggtacggtcggaattcccgggatgtagcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagtaagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatgtaagtgtgaattgttcctatatttaattaaaatatatcagattggtgtaaaattgaatgctaaggtatctgtgaaatacccagaataggccagtccatagacacagaaagtagactggtggttatcagggcaggaagagacgaatggggagtgcctgctaacaggatacaggctttcttctggaagtgatggacgtgttctagaattagatagtgatgacagttgcacaaccttgtgaatatactacaagccaatgaactgtatactttaaaatagagaattttattgaatatctcattttctaaaatttcaaaaaacgta

SEQ ID NO: 126614 - DNA, 185 bp, Homo sapiens
aggaattcaactgtacttcactgaagggctgtcagctggcttattaggataaattctgggattttatgctgggcatagtgatttcgtgcttattttactgctggaccaaatgggaagcaaaggaagtgtgtcaaagaaggtggagggttagaaggtaccatctaatatttggggaatagaatctc

SEQ ID NO: 126615 - DNA, 184 bp, Homo sapiens
tttgcccaacacattatgcttccttgcctagaatgtggcttccctactgatcggcggggggaagcctagaagccttgtaataagataaacctgatccagatctcagatctactacttacttttgactttaggcaagttactttatttcactgagaatcggtttcctcatttctaaaatgaagat

SEQ ID NO: 126616 - DNA, 328 bp, Homo sapiens
gtttttgaagatgggatcttgctatgttgtccaggctggggtgcagtggccgttcacaggcaccatcatagctcactgcagtctcgaactcacgcctggcctcaagtggtcctcagcctctgaagtagctgggactactacagactaccacatttgactactacaaatccctaccgtgtgccaccacgcctggcttagtagcctgttatttttaatagctgctaaatttgtcattatttgctttcttttctttcttttttttttatggcagggtctcactctgtcacccaggctggagtacagtggtgtgatctcggctcaccacaac

SEQ ID NO: 126617 - DNA, 394 bp, Homo sapiens
ttcccagcagcaaagacaggtgtatgctatagtacaagccactagcccgcctcttagaacctctcatttccgtttccatggtggaaatctatcctcaaggaaataacttctcagtggtgccatctgcatattctactactcctcagggatgatacaggccccctccgttccctagcacatcaagcttgatgatttgcgccacccaggactggcaagattagctcaactcaagatgccttgaagacagatagagtgacaatatctcttgggctaggtagtagaatagcagatggacaactgagaagttatttccttgaggatagatttccaggatggaaaggaaatgagaggttctaagaggcgggctagtggcttgtactatagcatagcctgg

SEQ ID NO: 126618 - DNA, 786 bp, Homo sapiens
catggtggcgcgcacctgtagtccctgctactcaggaggttgacgtgggaaaatcacctgagcccaggagattgaggctgcagtgagctgtgatggtgccactgcactccagcctggatgacacagtaagaacctgtctcaaaaaaattcactgttttggagctcagtagtcccagtttgaggaagaaaaatactaaatacacaaagattaattatctcaataaatatttattgagtacctatatgtgccaggctccattctgggcaatggaaataaaagaagtgaacaaaatagagaaagattcttgccttcatggaacttacgtcctaacaaaaataaataaactagaccatttaatagataaaatagtatactatattatcatagctgctgtgaaaagaaaaacagggaaaaggatgggggatttgatgacgggggcagtttacaattttagagggatggtcagggaagatctcactgtaagtgacatctgagtaaagacctcttagaaagtgagggagcaagccacataaacatccaggggaaaggggcaaaagcattccaggcagaggcaataacaaatgcaaaggcctgagatagagcatgttggatgtgttgttgaaggaggagcaaaaacgtcactaaggctaaaagtagatgcaatgaagggaagagcaggagatgaagtgagagaagtaggtaaagacagatcacataaaaaaataggcctggcatggtggctcatgcctataatccaagcactttaggaggcctaggtgggaggg

SEQ ID NO: 126619 - DNA, 419 bp, Homo sapiens
ggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccagaagtgcgccgggtgcacccaggcgcacttctctcgcagactccgcgacctactgacccggcgactgacaggctccaactacccgggactcagtattagccttc

SEQ ID NO: 126620 - DNA, 393 bp, Homo sapiens
gactattgaagactctcactatgggttttctgtggggtgtttgtttcttggggtgaaagcttccctctccccaggcaggcccagcaaaatctgtaggattcagacagggttctgacagctgaagacaagttgttgaggaaattcctgatggaggatcatggggtgctcaggagggagaatataaggtttcagaggctgagagggaaagaaaaggtgagggggagtcttagaatagtggctcccattgcccaacacccagaaagaagacatgccctgcaatggggagaaggtgagtatgagacattggctgtagcagcgatggcattgcccaggctgccaaggactcagagagtccagccttgcccactgacctatgaggagggaatgatgttc

SEQ ID NO: 126621 - DNA, 1356 bp, Homo sapiens
atttccactctattctattctacttctagaaagtctctcagatctaactcttcccatttatattcatggtcattgccttaccttagattcttatcatcttttgcctggactactgcaacaatctacttactggtctcattctcttcaggctttcttctctctaataataccctccacaccatcaagaattatctttccagcaatcactcccctgcttaacggctggtgacttcagggtaaggtctaaatgcctcagcctgatactacaaccttcacaaactagacttaaccttgtttcacagcttttcccctaccagttcccacacatggaactccctgagctctagtacaaccaaactactttttactctccacacgtaccacagtctttcaaaacctctatctacccatttggatatgctacaccctttgcctaaaattccgtctctgctctctgcctataaaatactaattggcctttcagagtcatctaaaatatcactttttctgcaaaggcttccaaattatcctagagttagtttttccatcttgtttatatccattcatttatcgttgttttactttggagtccctttttagagtctttccaattacattagaaacatcttagaggtatgtctttaacatataatgtaatgaagttttgcctcattattaaacatgagagtctttttcttttaatggatagcaactaatcacactgaactgtagcttcttatttagggatctgttctgctttatgcaatgagccctgtgagagcaagtgaccatctttttaaaaaatttccaatactgttacatagtagataaataagaactgtctgctcagctgatgattaaccaattatctaatgatcaaatgattatcaaagtaagagttgtagatgtaggcacgcaaggcatcatatggctccgagtaccctgcattcctgaaatgctttgtttttctctaggctgacaggcacagcgacacaatagactatatttcctaacagctggcctttgagagagatttgaagaattacaatttagagaggcctttcaattttgtagggtatcattcctcagagaactctgttgtacaaaatattcaatgaagaaactttaatagcaccaacccattatcaaattttatataatattctcttctcaactctagaaaaaagataagctttgataccaatagactcaatagggaataatggcaatttctgtctatataaacctctcttcataattaaatcagtaccaagtaaaaagtgttcaaatcctagctctgtcagctatcactgtcactgtgggttagttgttgctttatcttcctgagcctcagtt

SEQ ID NO: 126622 - DNA, 247 bp, Homo sapiens
aagaacctttgtcactctggctggtaagaatacaaactattcctggccctgtgagaattgttctacccatttctttgcagtgctttcctcgtatagacacactgactagtaagtaatcagctaagactccagaaatctttccagatctcctgaatttttaaaacacttctggcaatcggtcctgcaaattctaaccatcgtaggctctctatatttctcaactctgtctcctcaagtcagggagacc

SEQ ID NO: 126623 - DNA, 513 bp, Homo sapiens
acatctgatgcgacctatgctgctcactgtttctaggttacattctctacccttgcagtgtaaattaatttttgcctggttccatgtttcttgcttaggttatctcttaggtcttctgtctgatttaaatataagccttcttaggactagatagtggtgatggttgcactactttgtcaatataccactgaattgtatgtattcactcttttaagaatgagtttatttttatttttatttttattttgagatagagcctcactctgtcgcccaggctggagtgcagtggcgtgatctcagctcactgcaacctccacctcccgggttcacgccattctcctgcctcagcctcccgagtagctgggactacaggcgcctgccaccacgcccggctaattttttgtatttttagcagagacggggtttcactgtgttagccaggatggtctcgatctcctgaccttgtgatccgcccacctcggcctcccaaagtgctgggtttacaggcgtgag

SEQ ID NO: 126624 - DNA, 752 bp, Homo sapiens
cttgggaaataacttggataggcaggcagtttggcacggctagatgctgctgcaggggatattagaaatacacaaaatagagttgagatgctggcttgtgttggacattgacacaggcagttaaaaatggagctctgagtcagtgaggctgctgttaaggtagagacaaaaggaaatacaccagcacagggctatctgaggctaggagtatgctttcttgagcagaaatcttggatgcaaatgcttttagttcctttagatctgaaaggactccatactgaggggttttttctttgttgtgacagttataattctacagttatagctccatgtacaaatcacgtacaaacccaacttctatgttatattgataccattcctctgtttaccaatcacatataagttaattggtattgtagaaaaatgtaactgtattgacagtatatgtttggagttcagaagtgaggtcaggctagagatacggattcttaagagatctgaaacaaaagtgacagttgaaacaccctagagtagataagatttttaatttatttagcattcaaatatttgtgagctctaggcgtgggagatacactgttttgctaaacatacatggtctctaccatttaggtacagcatggtgagagggggagccattaaaaaataaccatacataggccaggcacagtggctcacgcctgtaatcccagcactttgggaggccgaggcgggtggatcacgaggtcaggaga

SEQ ID NO: 126625 - DNA, 773 bp, Homo sapiens
ggaaattatatatgtagctagaaggatagcagtgaaaaggaatgctacactcctcactcagcagaacagccaggtcaaagcctcagacccatgcagggcagctatgaggccagcacgcagctggtgcctcacacttgtaactcccgccaagaaaactgaggcatgctcatctcttcacctccagcaactgagacaaaccctgacacacaataggtaccagtaaaacctctgaatgattgaaagcatgactaggggccaggcttggtggctcacgcctgtaatcccaatgctttgagaggctgaggcaggtggatcacctgaggtcaggagttcgagaccagcctggccaacatggtgaaaccccatctctactaaaaatacaaaaattagccaggcgtggtggtgcatgcctgtaatcccagctacctgggaggctaaggcaggagaatcacttgaacccgggaggcaaagtttgcagtgagccaagattgcaccactgcactccagcccgggcaacagagcaagactccatctcaggggaaaaatacaataaaaaataaaaaaagaaatcctgactacagggcagtagttaatgtgaatgtggtagctgttatgatggcagaatctgacaaaagaccatgggtggagtggctgagctgttcatgtgcacagccaggctgcttgcctgccggtccagctcagaggggtgacttctaccattcagcattcctggtcctggggccccagggtctaccctcgctattttgtatctc

SEQ ID NO: 126626 - DNA, 422 bp, Homo sapiens
tgttttccacagggctaggcaatttctttttcttgtaacccattaacattctatgtattttggggaatactgactgagagattcacaagtacacacagacattcatgcaagtaaatatgtatactttaaattagtattttcatgtatacataaacacatataatccaggtaaagcaaaaatatctttgcagcaagggattccgtgtaagagattaagtgttgtaagagttgattctgttttcgtggtctggtaacaggaagtctcttctgcacatgccttctatgaacctctttgaaccacttaaagtctataaggaaaacatttggttgtatatgatttacacacaagggaatgagaggaaaccccaaaacttctatcctatcacaaagctaaatcatttttcccccaacactaccctaac

SEQ ID NO: 126627 - DNA, 99 bp, Homo sapiens
tctgtttcagccgtttatttactggaggcagatcagagatgcacctcgcaaaaatgacaccatgaaagtcgagttagaaccgggaagagcttattcagt

SEQ ID NO: 126628 - DNA, 392 bp, Homo sapiens
cttttggggtctttgctcctaacaggcccaccacagtcgaatgatcagcatgaacacgagtgtggaaagggaaggactgaactgtgtatccccacagaggacccaacaacaaggaggaggaatcacttcccttgtggcattcctgccaagaacacaaaccagaatgtaatcatgaggaaacaccaggcacccaaattaagggacgttctaaaaaataattgacctgtaattttcaagtgttgaggtcaaagacaaacaatgaagaactcttccagattaagcagactacagacaattaatggcatcgcctaattctgaactgggaccttttgctctaaacttggacattacaaagcaccttcagaacagatgtgaaacagaggtttgaggac

SEQ ID NO: 126629 - DNA, 380 bp, Homo sapiens
ggtaccaacacgatatgctttatttgacaatagacccagatacagtggtgctgacagaatccactagcaaagtgctctgtagtaatttgcttgttcactggagcttgctcaatgctttttcacaaatcattaggtatttcatttctagatggtattttacctaagcagcatttttcattgacacttaatccaaatcatcttaaattgtgtcacaataaatttatattgtactggtagccataaaagtctgagaattagttgagtacaacagtcaacaagtgaatactgcctatggatcattatgatggagaagttgcctgaaagcagaacaacaggacataggcacatttcaggtagagacataagttagatacacacac

SEQ ID NO: 126630 - DNA, 250 bp, Homo sapiens
ctcaagatccacaggtaaagaaggaagtctctggcattagtttgaatcccagctgagccacttgtgggctgtgtgaccaaggggaaattcttagtctcatgaatgcctcagttttctcatctgtaaaatggaggtagtaatgttgtgtatgttcaatgaaaagatgctacacagttttggctcaagaacatctcacgttctctaaggagaggcaggcaagtgcaaattctacacaggccttgacaagtgc

SEQ ID NO: 126631 - DNA, 225 bp, Homo sapiens
gaattatgagatgataaatttgtgttgttttcagccactcaattggtggtaacttgttagagaagcaatagaaaactcatatgttggctgggcacagtggctcgctcctgtaattccagcactttgggaggccagggtgggctgatcccttgagctcaggagtttgaaaccagcctgggcaacatagagaaaccctgattctacaaaaaatacaaaaattagctg

SEQ ID NO: 126632 - DNA, 585 bp, Homo sapiens
ggatgtggggacagggagtatatgggaactcgctgtactttttgctcaattttactgtgaacctaaaactactctaaaaaataaagtctattgaagaagaagaaaaagaagaagcagagaaatctcaaataagtaacctaaacttacaccttaagaatttgttttccttaggtctttcatgttagtaaagaaatttttttaaaaagcaaacaaaaccaaaagcaagcagggggaaagaaataataaagactagagtagagataaatgaaacagagaatagaaaacaatacagaaaaccaatgaaactaaaagttagttctttaaaaataccaacaaaatttgacaccttttagctagactaactaaaatgtaagaagattcagattactaaaatcagaaataaaagatggggtatcacaattgaacttacagaaataaaaggattataagtgaatattatgaaatattgtaagccaacaaattagataacccagatgaaatgagccaacttccagaaagacacgaatacctaaactgacttaataagaaatacaaaatcttaatagacttataacaaatagagat

SEQ ID NO: 126633 - DNA, 317 bp, Homo sapiens
ggaattttcgtagtatgtaagctagagagaatagtataaacctaatgattttatcatccagcttcaacatttatcaatattatgccaatcttcttttaactgattttgttctggagtatttaaaacctatcccagacatcctattacttcacccatcaatatttcagtagaaacatttatttttctcacatcctactgtttcttttttacctggaataagatttacatataatgcacagaactttttttttttttaattatactttaagccctgggacacatgtgcagtacacgcaggtttgttacatatatacggg

SEQ ID NO: 126634 - DNA, 404 bp, Homo sapiens
tactgcctggggttttgactgaaatacccagtgtagagagttcctctctctaagaagtgtattgaggcttgaactttgatattaaaattagtgttaatgatactcttttatctagggaggcaacatattcagttttttcattcaaatgcataagtgtctttggtatcatgaatttctctgtagaaatattacatagtatacaaatatgtctagaaatgtcttttttatgttaaacagatgttcaccaatacctttatttttcattaggccaattttaaatattattgttattctaagcaaattcaaatttcttgatatttgggtgatatttaatcaaggtactagcaaatttcgtcatctattttgtgtcctggaaaataaaggataaaatactataaaagtta

SEQ ID NO: 126635 - DNA, 463 bp, Homo sapiens
tgcccagcagtggagttctctgagtaagaagagggggagggtggcacatactaacacagaatggatgcttgtatgcagaccaggctgtaaattacatagcaatgacagctttgatgttgcatctgaaaaggtgtaataaccccttctagcaggtctctctcatggtggaggggaaagtggtttgtgctttattttaatcagcgaggcccttccctgctggtaacttgaggtcattccatctcatctcagaaggtcgtcttgtccttgggttgccataatctcctttggttataaagaggacctggagccatgcaagggtgggatgttgacttgccatctcagtagcacatttaatcctacaggactctggcttcccctatgcaagcattagaataagagttcaggtgagtgtgacctgcgttacaaagggcagtcttcaccatgaaccgtaggaagggcaggt

SEQ ID NO: 126636 - DNA, 785 bp, Homo sapiens
tgctgagggttttagtcataaagcgatgctggattttgtctaatgctttttctgcatttattggatcatgtgatttttgtttttaattctgtttatgtggtatatcacatttattgacttacgtatgttaaaccatccctgtgtccctggtatgaaacccacttgatcatggtggattatctttttgatatgctgttggatttggttcactagtatttttttgaggatttgtgcatcagggatattggtctgtagctttcttgttttgttatgtccttccctggttttggtattagggttatactggcttcgtagaatgatttacgcaggattccctctttttctatcttttgcaatagtgtcagtaggattggtaccaattcttctttgaatgtctgatggagttcagctgtgaatccatctggtcctggactgttttttgttggcaattttttttattaccatttcaatctcactgcttgttattggtctattcagatattctgtatcttcctggtttaatctaggaggattgtatatttccaggaatttatccatttcctctaggttttctagtttatgcatgtaaaggtgttcatggtaactttaaatcttttgtatttctgtggtatcagtagtagtagctctcgtttcgtttctatttgagcttatttggatcttctctcttcttttcttggttaatcttgctaatggtctatcaattttatttatcttttgaaagaaccagcttttggtttcattcactcactcattcattcattcat

SEQ ID NO: 126637 - DNA, 424 bp, Homo sapiens
ctgccagtcatcatcctttgagttcctgtccctccctacatgttgagggagggacctggtgggagatgattagattatgggggcagtttcccccatgctgttctcatgatagtgagtgagttctcatgagatttgatggttttaaaaattgtgctttctccttcgctctctctcctgctaccatgtaagacatgccttgcctcccctttgccttccaccatgattgtaagtttcctgaggtcttccagctatgtagaactgtcagttaattaaatctccttactttataaattacccagtctcaaggagtatctttatagcagttatagcagtgtgagaatggactaacaaaaataaccacctccagattggaaatatatgaaaagttgagagtcaagaaactatagtccagtctagaccacag

SEQ ID NO: 126638 - DNA, 309 bp, Homo sapiens
ttgggtgctctagaggatcctgatcacgtgcattgtgcagcacgaggggttgcggagccctcaccctgagatgggagcatcttcccagcccaccatccccatcgtggcatcgttgctggcctggctgtcgtgtctgtctgggggatctctgagttttctcaaggcctgagcaggactgggacatttcaaacagacgagtaggaagtgagtgctcctggcttggaactcagagcactttgtggcctctggactaggctgggcacaaggcacagcatccagttccctgggcttaacatcgtggcatgtgtt

SEQ ID NO: 126639 - DNA, 246 bp, Homo sapiens
cttctatcagggagtaattaagacacaaagaaaaatccagatagtctcaactacaagtacatttcccatttacaaaacttcaagtaatagctggatttgtttttacttttagcactctaaggctttttagaaaaaaaaaaaaaaaagccttttgactgaagaactatcttcccttcagtagggtttaacaatttaaatgaattcaatttccttttcttttttttttttatttctgggacagaatct

SEQ ID NO: 126640 - DNA, 380 bp, Homo sapiens
tcccccttcccagccctccctcccacctccaccccagctcccagacgcccaggcgcacttggtgcaggtgtgtctcaaagtggtcaggagaggggacaatatacaggggttggcctcagtactggaaaatgccatttgcaccccctaacaccactactagtgggaaaaaccagtggggccacaggctgccccgaagtgaatgtgctgggcggatcacagccccaccacgtgtcatgtagacacccagggctacaggagagtcaaccatatttgggcatgacgtgctggccaacccagggcctccatctctcactggtctttagcagataaattaattattactagaattgaacaggagggacagatacctgccttcctag

SEQ ID NO: 126641 - DNA, 682 bp, Homo sapiens
tgcctttctgggggtactttacagaaataaggtagctcgatgtttaaatttctgcctttgagaacccagaaacttcttactgggcatgttagcaggcccatacctgctaaaatgagtgatccctacctgctctgtactgaaccaatatggtataggagaaaggttgtgggttttggcatcggaagttctgggttcaagatctgcctctgccccttacaagctgtgtagccttgagtgagtcaactaatttggcctcagttttactggctgtgaaatgctataactgtatccattttagagggtttttgaagttttaaaaattaaaatttacttaagtgtaaagaacaacacaaatattaattattaatgagaatgaccctggcttttctccctatttatcaaatagaccatcctccatataaatgacaggagaaccaggattattattgaaagagatgagggaaggggaaaagtaagaggcagggtagataattaataaagacacaggtgtgaattcaagcatccattgcctcacagttagtggcacactgcggctagtgacaaactgttctgactcccagctcctgctgcggcctcttatttccccagagatgctttctgtttactcataaagatcacatcctgagctaatgaatatcctggcccttaaatatggccagga

SEQ ID NO: 126642 - DNA, 1012 bp, Homo sapiens
ataaatgagtttatcgaagccaaaaatcaattatatttctatatactaacaattgataactaacaattaaaatttaaaaatacatctaccatttacaaacaactttctctaaaaatgaaattttttatttaggtataaatcaataagacttgtgcaggatgtgtatgctgaatactgtaaaacattaatgaaagaaatcaaagacctaaataaatggagagatatactgagttcatggattagaaaactcaacctaataatgatgtcagttctctccaaattggcctacagatttaacacaattccaattcaatctctgcaggattttgtttatagctataaacaagccaactctaaaatttatatgggaagataaatgaactaaatgaaccaaaataatttttaaaagaagaataaagttggagaaatcatgctacctaattttaagatttactataaaactacaataatcaagacagtgcaatgttcgcaaaaaaattaaatcaatgaaacagaatagactgtccaaaattagacccacagacatattgccaacagttttcaacaaagatgccacaacagtttaatggagaaaggatagtcaacaaatggtgctttgacaattggacatccatatgcaaaacaagcacatgtttaaaaccttgttgatttttcaatatgcaaataaaattacacaatagttacaagcccaggaataataataggatacaatagtaataatagtatacaatgccatgtatacaataataatagtatccaatcccatgtcatcattcattgttgtaattacatagagactgtgaagctaattcttaaaaataattttaaatgaatactttaaaacttctaaggtcaagaaagctaatttggtcagagtgttaaagaaaaaaaaagtctcaatctatggtatcatttttggagtaagaaaatgttccaggtatgttatttgcagatggagaaactaaggcccagagaggttacataacttgcc

SEQ ID NO: 126643 - DNA, 417 bp, Homo sapiens
aggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggacgacagagcgagactctgtctcaaaaaaaaaaaggttaaatggctttacaagacactttccccaaattttagaccaatacggtttcttaaaaaccttcatttagggtttggtggtggtggtggttggttggttttggagatggagtttggctctgtgttgcccaggctggggtgcaggggcgtgatcttggcttcccggggcttcaagcaattctcctgcctcagcctcccgagtagctgg

SEQ ID NO: 126644 - DNA, 715 bp, Homo sapiens
atgtatattgttttctttttcattggatttattcgtgtattaactttgttttctccttaattgttttacatgtaaagacacaagatatattttgttttttttgttttgtttagagacaggatcttgttcagttgcccaggctggagtgcagtgatgcattcgtagctcaatgcaacctcaaactcctgggctcaagtgatcctcccacctcagccttttgagtagttgggattacaggcatgtgccaccaagcccagcaatttccatttttataccttacattatttctggttatatacttccattgagaattgaagggtaaattaatttagaaactgatttttatcagttactgagaatagtttgatttcactgatagtaaatttcattaaataaaatgtgatgctttatcttgagtttttatacaagtaatactttttaaaataaaaattatctccccaaatacaaaaatatatagaataaaaaataacatcagtccctttataataatttaatttttaattgtttgcccttgtactgttttgccactgtaatatatccttggaaaaaaagttttttagggaacgagaagtggtagaaatgaaggttttcctaccttaaagaaaagcctcactcttaaaccaagaatggtttagcctcagttttggtgagcttttcagttgtattcttgatatataattttttggtgaataga

SEQ ID NO: 126645 - DNA, 399 bp, Homo sapiens
ggttcctcttctgactctctagttgtttctttgtctctacttatttctctctctctctctcttctctctttttttcttagactttttaaaggttcatcaaatgtatcttttcaaaaaattaacttttcattttgttgatcttttgtattctgtatgttttcatttcaatgtcatttatttctgctctgttctttattaatttcttcagctaattttacatttgcgatttgctcatgcttttgtagttctttaagatgtattgttagcttgttcaagttttaaaaaaaaatatttaggatcatatagctatacatttttctcttagtacttcttgcgctgtatcccatagatgttggtatgttgatccatgttcatctgtttcaagaaattttaaaattt

SEQ ID NO: 126646 - DNA, 231 bp, Homo sapiens
atctcctttggtatttaaaagcttcttaaggaatgtgagtgtgcttatcatagtgcttagcaagactctaagagtactcaaaagaactaatttagagttttctgtgtactatttcacaatacccagtcatcagatgtaagctgagtaaaatcagtatcttaattgtatctcccacagttcggtgctttcagtgtggaatttctacaaatcatcattgaacaaatgaactac

SEQ ID NO: 126647 - DNA, 247 bp, Homo sapiens
aatctgtaagccattttcaattgtatatttcaattttatgtatgtgtgtgtatatacatatctattaaccatatataatttttttcttcagatatttctgcaaaataaaaaagctcaatggattatagaatgacagctactttcaaaagaaacttatctcattttcaaggcgctacatacttcacacatgacacacttcaaagccggtcaacaatcattatcagatattgactcagcgtgcacacac

SEQ ID NO: 126648 - DNA, 633 bp, Homo sapiens
gcttagatccccaatctcagctggagagagacacctaataccagaacagaaaactacagtttcaaacccaactctgacctgacccaattcaatttctaattagatcaaagcaatcagcccctcaccacagttaagacaaaagaaaagagaaagcactcatgggtaagggaaaggatactatctacttcagtctctacttttcctttacacacaatctccagtgtacaataaaaatttacaaaaccagataggaagactcaatattgtcaaaaggtcagttcttcctgatttaatctacagattcaatgcaatcctaataaagatcccagcaagctattttgtagatattgacaaactagttataaagtttgtattgagagggaaaagacttagaatagccaacacaaaattgaagaacaacaaagttggaggactgacactacccaatttcaaaacttactataaggctagttatcaagacagtgtggttgatatggtttggctgtgtccccacccaaatctcatcttgaattatagtttccataatccccacgtgtcatgggagcaacccagtgggaggtaattgactcatgggggtagttacccccatgctgctgttcttgtgacagtgag

SEQ ID NO: 126649 - DNA, 156 bp, Homo sapiens
ccttagatatagactcccacagtccctagatatagactcccacggtcccgagatacagacccccacggtcctgagatacagatccccacggtcctgagatatggacccccacggtccctagatatagaccccacggtccttagatatagactccca

SEQ ID NO: 126650 - DNA, 332 bp, Homo sapiens
gaaggagtcctgcattaggagtcagaagacttagatttgttgtcttggttctagtatttacctgttagagaatcatgggtttgtgtctctggggaaaaggccgaagtaaccctgagacccagtttcctttctaaaatgtgtgtgatgacacctgatttactaatttataagctagttgtgagaaccaactgtaatagctttgtgtatgtgacaatacgtgtgaaagccctttgtaaacttttgggcagcatatagatactacttatgatatgacatgcccagataaatgggtgtttgataggttaagttgctcccttttcttacatgactct

SEQ ID NO: 126651 - DNA, 529 bp, Homo sapiens
atttgttaagaaattattgttctggcagtagtattcacatgtatatatcctgcactccatattttgggggaatgctttattagttgatcaaatacttaagtatcaatttggggccaggcatggcactgtgttagggttatgccaaaggtaataaaattcctgccatcttaaggcattcttagtcaagtgagggagattggtaagtaaatgagcaattagaaagcagtgctaaaatatggaaatatattgattgcgctagggatcagaaatgaaagaaagcctaatttgggggatgtctaggaaagttttgcaaaggagatgttaactgtattgagtcttgaatgagttagcagttaagggttgactgtgagagggcagtccagacagctattagtatggttaaagattagtcttattttccatatatcagaggaaataagacatgtacacgattagttttggtgcaagatataaagtgataaatgctgcatgaagtaaaagtaagttgttgtgtgagttcaaagtagaa

SEQ ID NO: 126652 - DNA, 285 bp, Homo sapiens
tgtcctagtgaatggcagctgagaagtgatcttcaagggggtgtctgaaaaatgttttactcactaataggcttagaggaggaaatcctgctctctctggacattgtcttttctgactctgatagttggaactgctgcagccaactaatgatcacaaggagacacggactcagactgaggttagctcagtggaaagatagaactcaccagagcctttgataatgccggtaagcttcagaattaacccattctagagctgctttacatgtggacttatgttgatat

SEQ ID NO: 126653 - DNA, 299 bp, Homo sapiens
tagcgatctagaggtccctcagccatgtcacaaccaaatgctattacataaagttaacaatacttaaatgctgatatgaagtaaatcttaatgtcccatgataaaaggaggctgggcgcagtggctcacgcctgtaatcccagcactttgggaggccgagatgagtaatggcttttgacagtaatagagggtctcaacctgatttttcttaagtttgcataaggcttaggagaggataaaataaggcaggatctagagattggtgaggagaaacggaagtcctcattcttgacagctct

SEQ ID NO: 126654 - DNA, 510 bp, Homo sapiens
  misc_feature (16)..(16): n is a, c, g, or t
acaggacgcacagtcntctcaagatgatatacagatggcaatatgctataaaaagagttcattgctgggcgcggtggctcatgcctgtaatcccagctacttgggaggctgaggcacgagaattgcttgaacccaagagggagaggttgcagtgagccaagatcatgccactgcactccagcctgggcgacagagcaagacttgtctcaaaaacaaacaaacaaaaaacaacaaaaaaattaccattaaaaatgagagagttttcattggcaaagttaaaaagaaaggtgaaagaaaaacctactcttcttgatttgtgtttgttcacttatggagaatttattttgtcataatgtctgaatcataattaaatatgttcttgggtctagcagttcttctatttcttgtattagaagtaaacttggaacatcttaaacactgataatgaagactaatttgaaataaaaagttactagcctttcatacaatgaaatatgttgccgttaaaaa

SEQ ID NO: 126655 - DNA, 598 bp, Homo sapiens
agccactctttgcttcttgtttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttgtattgaattcaaatttagaagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaa

SEQ ID NO: 126656 - DNA, 726 bp, Homo sapiens
caaaagagagtttttattagaaggcagttttcatccctctatcaagaatttaaatcacttatttcatttcttttccctagaggaaatggagaagaaatgaaaaatgtaataaaaatttgctttagaatccataaaatcaaaccaggtcctgacctgactataatatattttatgtttctgaaataaaaaaagaagtttatatccagaaaagcaaagcatgatcctagaaatgtaatttaataaagatcctaggcagtgaaatttgttgaaatttgtggccaaaaagtagataaattattctccatttacaataaagatgtgctacatactatatgactctgtttatataacattctgtaaatgaaaaaattatagaaatgaagaacagataagtgtttgcagggactggagaaggagagggaagctgtgaccaggaaggaaagcaggagggagttccactttggtgagagaacagttctgtatcatgattgtgctgccatgacagctataggaatatatatatacatgtattaagcatgtcatagaattatctaccaagacaagaaaaaaaaaaaaaaaaaaaaaaacaatttttggggcggttggggcccttggaaaaggtttttaaaacactttttttgggggggggggccccattgggttaggtggaacctggggcaattaggtggttccagggagaaccggggccggaaaaaaggggctgga

SEQ ID NO: 126657 - DNA, 559 bp, Homo sapiens
ttgagatagagtcttgctgtgttgcaggctggagtgcagtggcaccaactcggctctctgcaacctctgcctcccaggttcaagcgattctcctgcctcagcctcttgagtagtgggattacaggcataagccaccatgcccagcctgttgttacttgttatacctctttctgcagaggatttgaggcagattccaaaaatacttaacatataaaagattaaaagttgagagaattatagcaaagggaataattaagaaaataaaactattatagaatgaactataataaaactattatagaatgatcctgtataaaatatagcatctaaagcaggcatatgggcttatagttttaaaagatgagtcacaaacttgtctcaggatttcttagtagccaagcaaggagggcaacatgatcagttataagattcatattgtttggcctttgaaaacaaactaggtgttcaggaaatttctcccttgtatattataaaccagagatgtgtgatataatggaatatatccttacacaattgctccaatatcaaaacgataaaa

SEQ ID NO: 126658 - DNA, 352 bp, Homo sapiens
atggtcttgtgctgggacaaacttattcctctaacacccagccaagagtgcagtggagtgatcatagctcactacagccttgaactcctgggcacaaaccatccacctgtctcagcctcccaaagtactgggatttacaggtgtcagccaccacgcctgacccttttttctactctaaactctggatgaccacctcattgagcttttaaaaaaaaattgttgtcagagttaatgatgtctgttcatgggaagagacagtgtctggctcaggagataggcagagtctcattctacctggagctgctgctgtttctgattcaaggtacccagcatgcagtatgcattatgctaa

SEQ ID NO: 126659 - DNA, 433 bp, Homo sapiens
aggggtgtgagacaggtatggtggggagggcgaatcatttgcatgcaggaagatgagagtgagctgtgtgcctggaggaaggctccaaattggatgagggcagggagagcaaggactgggatggggtggggaaggttggcctgttacaggtttgaccaagtgccagtcagagggagaaaattcccttatcagtccaaggagaccctgcatagaccagaggaggggtatttgaagtcagaaggtggtgggagggggtcattcccaggaggggtgccccacactagccagagcggggaggcgtcccacactaatcagagggggatggtccccacactaaccagagggggaggtgccccacatgaatcagaggggggtggtccccacactaatcagagcggggaggtgccccacagtaatcagagggggatggtcc

SEQ ID NO: 126660 - DNA, 377 bp, Homo sapiens
aatagcagaatcagaatcagaatcctcagattttatcatcctgaggctcttggcatctaatagcaacatgcactgaagtccatgttatagtaagagctgaaaatcatcctcccactataacaggaacaaaagtgtggggaaagaggaagagagaaagcaatacttttcctgggatgaaagcctctacagcacaaggcctgattagtaaatggaaattctggatagtctctgaatagaatccttttccacctttcaaataatttacagcttaatgtccgctaaatttagtaacttctcccatttgtccatggcaaggagattcttggctggctttccatggtcattacagaccttctcatagatccctgaaatatgat

SEQ ID NO: 126661 - DNA, 476 bp, Homo sapiens
ggcccacctctgacgagtcaccacaatacatccaatccatcagcaaatcaggctagctctggcacaaaatcaatccagattacaaccacatctaaccacccaggtcaaaatcacaagcatctctcacctggattattacctccattcctaactaatctctccatctctagccctttctctatttattctgttctcaagagacagccatctgggtcttgctaaaatgttttgtcagacatgtcagtcttctgctcaaaaccctgcaaagtctcccatctcactcagagaaaaagctgagtccttacatcagcctgcagggccctatacaatgtactgggtcactgtatctcccactgctcactttcttgctcactcttctctggcccacagtcttctctattgttcctcaaacatatctggcctcttctcatatcaggagtctgtacttgctgttccctctgcctagaactctcatc

SEQ ID NO: 126662 - DNA, 624 bp, Homo sapiens
aagtgatctttccactggttgtcttagcagtttgggtttagttcctatttttatttggccatgactgatagagctgagtgaaggaagtataatacagccaacctcaaagactccatcatgaatacacttgtcaagtgagataaattttgcagaagtcttgctcactcccttacttggatgactcctgccagttcctttagtacttcgctgtgttatcctctctagaaaactcttcttgatatctcctccccaaagaatgtgctgtgggatgggatccccaggatacagattctgagatgaaactgtacatgaaggggttttattggaggaagtgctcttaggagcaacacctgcaaaacactgaagaaaaccaacagggcagagaaagaagttgaactgcagtgcagttgcgaaagcagtctccactaactcctggggctatgaaactgagatggcgcttcagagattccgaaatcagcagccgattgtgggctgctcccagggagggtgcataaacttaggtgagacagcttccttctgtagagcgcagaggaacacagctgtcagctgtcagcaagcaccacttccagcagctgcagcaagagtacctctctgctgaagggg

SEQ ID NO: 126663 - DNA, 660 bp, Homo sapiens
gagacagggtttagccatgttgcccaggctggtctcaaactcttaaattcaaatgatccacccacctagttttcccaaagtgctttaattacatgtgtgaggcaccgtggctggccaggtcaaatatttttcattgacgtttttcatattgctttttaaagtcatgttaaaatattcttaataatttttctaagtggaattaatcttgattataattttagttttttataaagggcgggttttgaaacaagtactgcatttttcttttcgggtttataaacatttgctgtggactttgtgcagttaactattttcattcctgaaacacatttcgaaatcaggaattgaagactaaatgtcttttcactgaagcttgagcagattttagaaaggggagttcttttttttttttttttttttggtagaaatgggggtcttgttatgttgcccaggctggcctccaacttctgggcttaaactgtcctcctgctttagcctctggtctggagagttctttatggcctctttgagaacttttactttacacatgattctatctagctttcttttctgatgtacatattggcagcaagtagaaaagcaatgttttcagaggcagatatattaacagcaatgagaaataacagtagcgtgatagaa

SEQ ID NO: 126664 - DNA, 548 bp, Homo sapiens
ttatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctgggaaaacacagatattcacagcaccactgtttttttttttttttttgagataataaattccatgagaaatctggggttcgaatatttggttaactttggctcctaatggaacaccactccaggccttctgtctgtctcccctttaccccgaaaatactaacacaaaaattttaagacaacaagtaaccatatataggtgtttgaatgattttctcatttttatctaatttcatttcataagtcccgagtaatttacctaccataggctactatactgataatataaatgaaaccgaacatttt

SEQ ID NO: 126665 - DNA, 772 bp, Homo sapiens
agcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgcactccagcctgggtaatagagccagactccatctcaaaacaaaacaaaacaaaaaaacccaccaaaaaccaagtactacaaactaaagggaagcaattaaggaaatgtatctttaagtatgtttactgcagccctgcttgtagcattggaaaattataaacataaacctcctccaagggggactgggccaatgaattatgacatatacactcaataaatatttatcatgcagatgttatgaaagtgagacccatctgtgttaacatggaacctgtccaagatgtactaaaggtgcaaaaccatggagagcttaattattccattttaggacaaacacaaaaatacatgtatatattcatgaaaaatttttaaatgtcgagaaatatgcaccgaactgttaaggggactcaactcacatatattacattcttataatgtttaattattattttttacaaagggtatattactattgtaggcttaacaatacattaaatattttaaaaataaaagagtcttctataaaaatacatatactgaatcatcgagcaaaacccagcactaatgtttgttgatc

SEQ ID NO: 126666 - DNA, 497 bp, Homo sapiens
gtgcttgttgtacttacacttttccggatatttgaaaatttgcattaaatttctttttttcttttaagggcagtaaaagtgactgcaaagcaaagcaaaccctccatgccttcctgctgccactaggaggaaatcctacattgcttggctgccccttctgggcccagtgtcccactgcagcccctttcctctctgcagatgatgagtccctgtcacgtggcttgtcactcccctggatgtgcagggcatctgctttgctctcactttccctgctgcaggcctccatgaggctctcaatctccccaagcttcaagactcacttcatcccccaggaggataccctctatctcacattcatctctctctcccacctccttgcagtcccagccagtcatttctcactttctcacagcctgtcagaagcaggccatctgctgacatgcatccatcctctggccctcaccatgaccctgataccctttcacctggtccctcag

SEQ ID NO: 126667 - DNA, 334 bp, Homo sapiens
tacagacctgcttttccacagctcaccacctactggggaaagcagacaattaactgataacatcactaaagtgtgacctgtgtcatctggaggggacacagagcaaactcaggtagacagctgggaggtggctgcaggggtccaggtgcatggggcggtgcctgagcatgaggaggcggcagtggggatcaggagggaacgggctgagcgtcctcaggaggcaggtgtcaagaggcacactgactgactggcctaggcaggctgagaggcaggcggattaaggatgtttcccaggtttctgcttgggcagccaggaagaagacagctgctcccc

SEQ ID NO: 126668 - DNA, 453 bp, Homo sapiens
cctctcaaagtgctgggattataggcgtgagctgccgtgcccatcctactagctctgccacttctatcctggttcggtattccatcttctcttgcccaggtttttgtaatagtctgctacctggtctcgctatctccactattgacactgaagaatttattctaatcacaacatctgacataatcctttgaaaatataaatctgatcatgcacaaaatccactgatgtgtttcgctcagaagaaaagctagagtccccacaaggctccagtcaagcctgctcctaggtacttgtttgactttcatctcctcctgttctcatttctcacagctacttaggccttttggccattcctcaaatttgccaggcactttgtacagctgttccatggtattcatgagggggttggttccagagcctcttaaagatacccaaatccgcagatgctcaagt

SEQ ID NO: 126669 - DNA, 625 bp, Homo sapiens
attcagctactagacatttataatggatatagtaatatcagtccagttactacaaggtcacaaaatcccatttcatcagactaatgattcacattatctttaaagatcatttatttatttagttttatacttacttttagaatgttttgacttaactcggtatgaaaagtgcctaaaacctacttcaagaccacggttaattttatactcttttaaggtgaaatataaattcccacttaccattgcaagaacgcatactaaaaataaacccacggtcgggcacagtggctcatgcctgtaatcccaacactttgggaggccaatgcaggcagatcatttgaggtcagaagttcgagaccagcctggccaacatggtgaaaccctgtctgtctctactaaaaatacaaaaattagccaggcatggcggcaggtgcctgtaatcccagctactcaggaggctgagacaggagaatcgcttgaacccgggaggcggaggttgcagtgagctgacatcacaccactgcactccagtctggctgacagatgatgagactccatctcaaaaaaaaaaaaaaagtatacccaaacttctagttagttcccagaccccacagtgaagatgtgc

SEQ ID NO: 126670 - DNA, 627 bp, Homo sapiens
gcaagctccgcctcctgggttcacaccattgtcttgcctcagcctcctgggtagctagggctacaggcgtatgccaccacgcctggctaattttttgtatttttagtagagatggggtttcaccatgttggccaggatggtctcgatctcctgacctcgtgatctgcctgcctcggcctcccaaagtgctgggattacaggtgtgagccaccgtgcctggcccctttttttcctatcttaaaaccacttactggctctgttacctgcatgatgtctaagtcaagaactgtgaaagatctggggttttctacttgcaggctaacaagtagccttccacagttgcatggatactggcagaaaccatgaggctcatgggtcagaaacgaatgacttcattattcacagcacagcaagcagcaagaatatctgtatgtttgtatcagttcctcctttacactgcatccaaaagaggtgatgcatatgggccatatggatatctgcacatctggtaggttgcattacaggacaggaatcccactcttggttaactcagatcttttatcttgggcagtaagcttgcctgccctttgcccctgagggaggtagatgaattgtgtagcttctgaa

SEQ ID NO: 126671 - DNA, 905 bp, Homo sapiens
gtttcccttccttggtaccaactatagttattttgttccagttagactgtagttagggcgataggtcattaggagagcctgagaagaatgggcagcagtctttgaagagttagtcaccccaacaatatactattgcttttaaaagagctgaggtggccgggcgcggtggctcacgactataatctcagcagtttgggaggccgaggcgggtggatcacgaggttaggagttcgagaccagcctgaccaacatggtgaaaccccatctctactaaaaatacaaaaaaaaaaaaaaaaaaaaaattttgggggggttgggctggaaaagtttttaaaacccatttggtgtgggggccgcgagggccccaagaatgggttaggtggaaacacgtgggtacaaacggttgtccacaggacaaaccacgggccaatgacaaaggtcgcggggctttcctcaccaataaaaaaaacgcccgggggggaaaccggcgcgttcatggaaccaactcccaaagggggagcgtgaagcgcatacacggggatctaccacacggggagttccaggcgagcggaattaaattaccccgcggagtatgggacaaaaaatcacagagaaaaaaagaagaggagaaaaaaaacaaaaaaagaaagaagagaaacgaagacgaagaaaacagaagaggagcagaggaagaggaaacaagccaggagaaggaagaaagagaggcacaaggataaaacagaacaacgtaaagacaaaagagagaaaggaaactcagacgaagacatcgagaagacgaggggaagaagagagaaaaagatgagagacagagcacgaggaggaggaagagaaagaaaagagaaaaaaaagagagagaagagagacaaaaaggaccacagaggaga

SEQ ID NO: 126672 - DNA, 602 bp, Homo sapiens
ccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctc

SEQ ID NO: 126673 - DNA, 212 bp, Homo sapiens
cagccactcagggccccgtgctgtgataaggctgacaacacagagctaagtcagaattttttgcaaccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctc

SEQ ID NO: 126674 - DNA, 392 bp, Homo sapiens
cttgctgaaaataaatgccagtagaaacatctcgtactttggatagcttgaaaatttgaatcacaggccttttctcctctgtttactcaatatcaattgtttaaggaaagctagataacttaccttttcttgcccttcctccatgcagccaagggtgaatatttaagttttatttctatggatcattcttcattaactgtgctagaggccatcatttagaaggggagacatttccaggttcttaaagctgagtgtatttatatactatgtagtctacatttgtcataatatttccagagttattaaaaggtacaggaatcttttgtagatgttttctaatgtttctgaatgcagacctttattcactacctccatcttaggtgatggctttc

SEQ ID NO: 126675 - DNA, 1067 bp, Homo sapiens
tctgtaatcccagcactttgggaagcggaggcaggcagatcatttgaggtcaggaattcaagaccagcctggcctacatggtgaaatcctgtcttcattaaaaataccaaaaaatgcaccgggcgcggtgactcatgcctgtaatcacagcactatgggaggccgatgtaggtgaatcacctgaggtcaggagttcaagaccagcctgaccaatatggagaaaccctgtctctactaaaaatactaaaatttgctgggcgtggtggtgcatgcctgtaatcccagctgcttgggaggctgaggcatgagaattgcttgaagccgggaggcagaggttgcagtaagctgaggttgcgccactgcgctccagcctgggcgacagagtgagaccctgtctcaaaaaaaaataaataaataaaaaagtctttctcaaattatattctgatgatcagagaatgatctttctcaatttacagcctgatgatcactaatctcagtgagatagttcatttataaaatttagtggtttaatttcttatctttgacagtcatcttaaacagtaacatgttaaaggcttagagaagtgtctggcaaataaactgttttcacatttttacaacttaatatttcttaaatttattccatagaataaaactttaggaaatagcaacctatataagagtgcattcctctaacccctatgcacattagattggcagtaaattatatttgaatcacaggccttttctcctctgtttactcaatatcaattgtttaaggaaagctagataacttaccttttcttgcccttcctccatgcagccaagggtgaatatttaagttttatttctatggatcattcttcattaactgtgctagaggccatcatttagaaggggagacatttccaggttcttaaagctgagtgtatttatatactatgtagtctacatttgtcataatatttccagagttattaaaaggtacaggaatcttttgtagatgttttctaatgtttctgaatgcagacctttattcactacctccatcttaggtgatggctttc

SEQ ID NO: 126676 - DNA, 1134 bp, Homo sapiens
  misc_feature (45)..(45): n is a, c, g, or t
ttgctgttacatgtaggtatagtgtcccctcagagggcactgcanatctggaagagtgagtgaattgatatgttgatgggaatagtactggctttaagaggatgtaaccggggtttttaaaattcttgcaattcagcaaggcatggtggggcacgcttgtagtcccagttaagtccagaggctgaggcaggagaatcacttgaacctgggaggcgtaggtaacagtgagctgaattcactccagcctgggcaacaagagtgaaactctgtctaaaaagagaaagcaaataaaaataaataaataaaaattcaaaaatcagccaagcgtggtggtgcatgcctgtaatcccagctgcttgggaggctgaggcatgagaattgcttgaagccgggaggcagaggttgcagtaagctgaggttgcgccactgcgctccagcctgggcgacagagtgagaccctgtctcaaaaaaaaataaataaataaaaaagtctttctcaaattatattctgatgatcagagaatgatctttctcaatttacagcctgatgatcactaatctcagtgagatagttcatttataaaatttagtggtttaatttcttatctttgacagtcatcttaaacagtaacatgttaaaggcttagagaagtgtctggcaaataaactgttttcacatttttacaacttaatatttcttaaatttattccatagaataaaactttaggaaatagcaacctatataagagtgcattcctctaacccctatgcacattagattggcagtaaattatatttgaatcacaggccttttctcctctgtttactcaatatcaattgtttaaggaaagctagataacttaccttttcttgcccttcctccatgcagccaagggtgaatatttaagttttatttctatggatcattcttcattaactgtgctagaggccatcatttagaaggggagacatttccaggttcttaaagctgagtgtatttatatactatgtagtctacatttgtcataatatttccagagttattaaaaggtacaggaatcttttgtagatgttttctaatgtttctgaatgcagacctttattcactacctccatcttaggtgatggctttc

SEQ ID NO: 126677 - DNA, 1078 bp, Homo sapiens
ccgagatcgcagccactgcattccagcttgggcaacggagcaagactccatctccaaaaaaaaaaaaaacaaaaaacttagctgggcgtggtggcatgtacctgtaatcccagctacttgggaggctgaggcaggagaatcacttgaacctgggaggcgtaggtaacagtgagctgaattcactccagcctgggcaacaagagtgaaactctgtctaaaaagagaaagcaaataaaaataaataaataaaaattcaaaaatcagccaagcgtggtggtgcatgcctgtaatcccagctgcttgggaggctgaggcatgagaattgcttgaagccgggaggcagaggttgcagtaagctgaggttgcgccactgcgctccagcctgggcgacagagtgagaccctgtctcaaaaaaaaataaataaataaaaaagtctttctcaaattatattctgatgatcagagaatgatctttctcaatttacagcctgatgatcactaatctcagtgagatagttcatttataaaatttagtggtttaatttcttatctttgacagtcatcttaaacagtaacatgttaaaggcttagagaagtgtctggcaaataaactgttttcacatttttacaacttaatatttcttaaatttattccatagaataaaactttaggaaatagcaacctatataagagtgcattcctctaacccctatgcacattagattggcagtaaattatatttgaatcacaggccttttctcctctgtttactcaatatcaattgtttaaggaaagctagataacttaccttttcttgcccttcctccatgcagccaagggtgaatatttaagttttatttctatggatcattcttcattaactgtgctagaggccatcatttagaaggggagacatttccaggttcttaaagctgagtgtatttatatactatgtagtctacatttgtcataatatttccagagttattaaaaggtacaggaatcttttgtagatgttttctaatgtttctgaatgcagacctttattcactacctccatcttaggtgatggctttc

SEQ ID NO: 126678 - DNA, 473 bp, Homo sapiens
cagtagaatgtaatatttgttgggacagggactttcctttgttcaatcctagtttgtgggcctgtctccctgtgagtttttgccatagcagtccagccacacatgccagagcccaggaaatggatgatgaactttagtacattccagtttgagccttgtgaatattcaggtgagtggttccctatgatggtatgatttccttcagtttttccataatttttttttttttgagatggagttttgctctttgttgcccaggctagagtgcaatggcgtgatctcggctcactgcaacctctgcctcccaggttcaagcaattctcctgcctcagcctcccgagtagctaggattacaggtgtgcaccaccacgcctggctaattttgtattttcgtagagacgggttttctccatgtttgtcaggctagtctccaactcctgacctcaggtgatccgccctcttcagcctcccaa

SEQ ID NO: 126679 - DNA, 370 bp, Homo sapiens
tgccccctcgtcctgtatgcaataaatatcagtgcgcccagccattcggggccactaccggtctccgcctcttgatggtattggtcccccaggcccagctgttttctctttatctctttgtcttgtgtctttatttcttacaatctctcgtctccgcacatggggagaacacctgctaagccccgtagggctggacactacactcccccaacaccctgacattagatcaaggtgatgactctgtagggccctccccagcctctgtggtcaacatattagaagcttataggcctccctgaccccaggcactggtcccttatagtagcagctgttctagggatcagacccgaaacaaatgcaccgagctcac

SEQ ID NO: 126680 - DNA, 428 bp, Homo sapiens
accttcaccaccactactacctattttgaggctgccaccaccacactataacatattcctccccgctctaaggctctgaatttggacctcccacatgacaggactctaaataatgactaatccattaagtttctgctccatttccaaaatattcattcaaatttgaaatgcctggggcctcttgtgtagccatggctgggctaatttctgcatttgcattttaaacaccctgaatcaggattacacctgaagactttcaaataagtgcttagatggcacaataaagatattcaggttaaaaaaaaatctaatgagtctgttgttcctttgcaaggcctagtgataggaacctcttcttggaaatatttgttaagccattctcacttgtagtcactcttggtaccaaatctgttgaccgaaaaaaaaaa

SEQ ID NO: 126681 - DNA, 522 bp, Homo sapiens
tatgggcacaggattgggagtgggacaggccatgggtggttttggaaaaggcaacatttgagtgggaaaacaggtatgtatgttctcactttgggctgtggtttcaggcttgaggttggggcccttgccggggacctgccttcttctgcccagaattcccctgcctcctatctctattatttgtattatctatcaatcacaaagtatttaatgagttcttaccaggagccaggactgctttggaaagaaagtagaatgaggcatagaaatcatttcaagatatcttgctatgtaattgctcagaaaaaactaacatgcatgaactcgtcacaatgaaatgataaactgtacggttttgaaaacagctaccatataagttcatagatagaggaaagcagaatgagctggagagtccgagaagactgaagggaagggcagcagagtggcagagagaacagggtgtggggcaggcagctggctttgtgtcccagcggagtgacttcacaactgtgtcccttagtg

SEQ ID NO: 126682 - DNA, 2554 bp, Homo sapiens
  misc_feature (930)..(930): n is a, c, g, or t
  misc_feature (1489)..(1489): n is a, c, g, or t
  misc_feature (2060)..(2060): n is a, c, g, or t
agttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactgggtaagcactttcaattttttttttttaactaaaagccattttaaaattgaatctgttgaggggcttgactaaaatcttttaagtaatttgtgtaatggaatactgtcagtggattttttcgtctcatttctgcacgtgctcctttgttctcagaacagaagctttttatacacatcccataacgcagctggagagagttatgaagtcagttattataaggaacacaaaggttgctttccattctttgcctttagataattaatttttttgttttcttaaaatggagtatttaaagaaggaagaaattcacaagaaataaactgttggagaatttagaaaagtttgaagtttttaccaccttttctatctctagttttgtgtggccaaacacttgtgccgcctggggcggtgggggtagaggcaagcatagacagagaggaactaagccagacatggacaaaggcacgagccaaaaccagacagtcctggccgttcgataggccagcagtgggtgagacaggtcagccagctgcaggggcgggagcgggggggcgggtagggacatggatgtgtgaggtgctcatgcgtgcgatcgtgacnagattctgaaactgccagccattttcccagctccgctttgtgcaatctaaaggaatgcatcccctctgaagcagtcttgccagagcctagtgagggagagaagtatggtaaataccacaacatatggaatcagaaaataccgggaactggagtgggcaagggggaatgcagagggtgtggaaattttttagtgatctggaatgtgttgagtgacaggaagtgccccaagcttctcccccaccaactcttctcagtcgcgcctgcttttgtctaactcttgtaatctacacactactgcttacaaagctgtctgagtttaagacaaaaagaaacctaaaagtctccttacttcatagtacctgtgatatggaaggaatgtaaaagcatgaccctttaagcctatggacattttttcaggtatacaggagaaagataaaataattttccacagaaaaatgagaattatgaattatatagttcaggttccaaatctaatttttaaaagaattctgattctgctacactttacaaatgcttaggttggttcctaatttgaagnagacttgttttatttggttaatgcattgcatttgaacttgtttctattttctttgcataaatttggactttgggagaaaaatgcaaagtaataagtagaatgcacttgggggaaaaaaggaggatttttcccttcatgggttggaaagtattttaaagggttgttttcttgaaaaaacaagctctctcttactttctgcatctatgctataaagataactatgctataataaatgtaaggtagaaaactttaaagagaaaataacagtgttctaagtgaaaagctacttagcattttcccaaacttacacattatcaacagaaacactaaaaattaagagaaaagcagccaactaattaaatagctagccttattttgggggtatgggatagaaaattaagtgtgaataaaatgatacttgggaatgtttctccctcgtaccacaaaggatgttagtggtcagcctacgagttaatccttcctagcatggctctgagccttcatgccgagcagacgttattcacatgacgattcgaaaagtccattcatatatctcgctacctggatttgnatagaaaccagacagcaattctttagttccagccaccattcgccccactggacaatagcgatttgttagcacagagtcacaggctgtgggacacaaagcttggagctgcagaaagatgggggattcagagaacaggaaattacaggctcgatgcactcctggcagctctgagaatacaaaaaaaaaaaaaaaaaaaaaggcaacacagagatgccatgtttaagagctacttctagcttttttaaccacctccaatgtcataaaagctctattgttggagtacataaagtcacgagtcccatgtgctcgcttttctcactacagggaacttcattcaatgcccttggcacagtaagaaatatcaaaagcatccagagttgattagctgtacactctggtagaaaggagagcattttataaataaaatgtcaggaaaaaaatacgcttagtaacacaagtgacatgtaataaaattagtatctttttaaaattcc

SEQ ID NO: 126683 - DNA, 722 bp, Homo sapiens
  misc_feature (395)..(395): n is a, c, g, or t
  misc_feature (397)..(398): n is a, c, g, or t
  misc_feature (427)..(428): n is a, c, g, or t
  misc_feature (659)..(659): n is a, c, g, or t
  misc_feature (661)..(661): n is a, c, g, or t
agttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactgggtaagcactttcaattttttttttttaactaaaagccattttaaaattgaaaaaaaaaaaaccanannaaaaaaaaaaaaaaaaaaaaaaaaaaaannattgggggtgcgataggcctaggcccatttaaatcttaaccagctaatgcttgcgcccgggtcccttgtcgctcgcccaggcccacttatctttaaactgagcacaattaaagggccggggccatacatgagctcgtttggcaaaacccccgctttggggatcctatcgatttgcgggcgatgccttttcaccggggggcgtggaaaccacgggccgcccccatttatttngnaaaaatttcgcctccgtgagttgaacataaccccctattttgtaagaattccgtttagggg

SEQ ID NO: 126684 - DNA, 508 bp, Homo sapiens
agttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactggcagcctgggcaacatggtgaaaccctatctctaccaaaaaaatacaaaagttagccaggtgtggtggtgtatgcctgtaatcccacctacttgggaggctgaggtagagatcacctgagcttaggaggtcgaggatgcagtgagccatgatcgtgccactacactccagcctgggcaa

SEQ ID NO: 126685 - DNA, 253 bp, Homo sapiens
gtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaag

SEQ ID NO: 126686 - DNA, 378 bp, Homo sapiens
ttaaacttcaaatggatccagcaagaatagaaaagatttaaagacaagccagaaaatagtcatttagtgtggtaatcaagcagaattattctaaaactgagcagtataaaaaacatttatgtcattcccagtttagtgactaaccaataattcacaaaaggaacctactaaaattggatattttccaaattttatggagttttttctgaacaatctgatagatggtggcttttattgttcatgctacattttggattcccaaggcagtgtgttagagattttatggaagggaagcagcaactaggggcatctgaattgctctgggaattacctaaatattttttacctgtcctcacctctttaatgagagtaatgata

SEQ ID NO: 126687 - DNA, 276 bp, Homo sapiens
aggttagggccaggtcgaggccccaaggaagaaagcacatctcacctgggggtcagccaactttctataaaaagccaaggagtaaatatttgaggtatgtgagccagacagtttctatcacaactccactgctgccactgtagtacaaacacagccattaacaatgggtgaatgaaaaagtacagcacgtgccagtgaaactttgtttatagaaaacaggtggtaggcggaatctgacccagcccatagtttgccaactcctgggtctaaccaaca

SEQ ID NO: 126688 - DNA, 216 bp, Homo sapiens
ggtgtttatcaatggcccaattcattctcaactatcccccttgtctgagccagcacagagatgggcattatgtcccagagctactaggaaaaaaacctccaagacatcgtcaccaattagagttcaaaggtacagaagccaaattgagacatatgagttgaaaaccagatgacatatttgaaattgaggatgtcccaggaaaatccagtgtgattc

SEQ ID NO: 126689 - DNA, 327 bp, Homo sapiens
agttctgttcctcgccctttcgctgctctgtatctttggggggttagcccgtgtaggctgtgtttatcaggcccatgtgtccattggtgttctgttggtttcagccaatgggaaggcagaaatgggagggggtctccacctcctctccctccccgcaattctagtttcccctgatgaccctgggttctggtttcaccatctcctcccttctggcctgcttgcctgagggtgctaatggcttcctgctgtagatgatctctagggtgcctcactgaccagtttgtcttctcagctcttccatcatctgtatgatcagttccctgaatt

SEQ ID NO: 126690 - DNA, 944 bp, Homo sapiens
gggcaaactgtattcattcaatccatgggcaaactgtattcactcataatttttgcagagaagccaccagcacaaaataaaatcaattacaacacaatttttttcaaaacgtgaacagatactattttataaaaaggttcataggatccccaaattagtattaactcggctcagatttatctaccctaagcacgtggggattcttcccagctcccacgctccttgccaccctaaatgctcaaggggagtcctattgtattagaaatgaacttgctaatcacgactttggacctgatccaagacatgcttttcaggcacagcactggtaaggagatgggtcccctccagaaaatgctgagaaatggtagcaaacaggattccctccttcggtctactcctcactgccttccctctgtgggagatgaagcattgctccccccatcccatgcacatttgattgctagcctgctggcacaaccctatgatccagtgtgtccagagagatccagatttctccctccgtacgttttctctctctggttggtcctgtctatagctacagatgagcaagaagcatccatggactgcccagggctttcgtttcccatacctctgctgtgtgagatctggagaacagaacacatccagtcagtagctcacaccccccatcacattctcaggcttcacatgtgaggaaaacagctggtcaaggaaggctgctgaattccatttataagccacttagcaagttatgaagctagaagggtcatttctgtagtcactgtgttattgttaccagcatatactgatcacctactggctctagaagtgagaatgatactttcagttcaaatcttagtgtcaggatttaatatcaaacaggaagaaactctacacctttgctgcttgtcttagccaagcaaatgagggtgtcagagaaactg

SEQ ID NO: 126691 - DNA, 378 bp, Homo sapiens
tactcagaggggccggccagtgtctgctcacctggacagatcatgcaacacaacagtttctcctggcaggaagagctggagtccaggacatttcaaaaggggctcttttctcctcctggctaattctgtttttctttttatttttttgagatggagtctcactctgttgcccaggctggagtgctgtggcccgatctcggctcactgcaacctccgcctcctatgttcaagtgattctcctgcctcagcctcctgagtaggtgggattacaggcacctgccaccacgcctggctaattttttgtattttcagtagagacggggttttgccatgttggtcaggctggtcttgaactcctgacctcaggtgatctgcccg

SEQ ID NO: 126692 - DNA, 392 bp, Homo sapiens
gttatcagagaatgtaaattaaaaccaaaatgaaagaccaccaccagaacagctgaaatgaaaaagactgttttccagcatatttacacagagtagaaaaataaagactctcaaaaatatagggcaaaagcaactttcataagctcctggtgagaatttaaatttctacaaccactctggaaaaccatcagcattatcttcttatgtgttaaaatggagcagtgattctactccaaagtacataccaacagaaatgcaggtacatgtacaccaaaaaaaagtacaataatgttgatggcaacataattcatagtagccaaaacctgtagacaacccaaatgtttaactacaatgtttacatttagaaagcatatttaagaggtaaaactatt

SEQ ID NO: 126693 - DNA, 311 bp, Homo sapiens
gacattcacttccaaccctgattccatcccgattccgacattcacttccaaccctgattccatcccgattccgacattcacttccaaccctgattccatcccgattccgacattcacttccaaccctgattccatcccgattctgacattcacttccaaccctgattccatcccgattccgactttcacttccaaccctgattccatcccgattccgacattcacttccaaccctcggcttgtcccaagagagggttggaagtgaatgtcggaatcggtatggaatcaggcttggacttccttgcctgtgt

SEQ ID NO: 126694 - DNA, 323 bp, Homo sapiens
gaagaataaatcataatccttctacccagagcagtcactgttaactttttagtttgtatctaaccttttatgtctgttatgtaccatttttaatggacatgaatttatgtcaacatttgtttataacatgattatcataagccagacactgagccatattgtgtttcgttagcatcatttttatacttacatattaatatatttttagtcaaatgatgtactagattctggagggagggtcacatgatatttatatggatttaatgtatttattacactttagtgtgttttctcttcctggttttcaaatgttttaaggtatt

SEQ ID NO: 126695 - DNA, 505 bp, Homo sapiens
gggaagaggtagacactcctaagtgctaagacaggagtaaacattctctaaaaactactgatatatcaatgaaccagcagtatcaaccactgagatattgaaaatacatttcctcccacagcatgtgaaagatcacatcggggattctttaggaaagagtacaattgagtacagaaggaaaaagaaggccgaggaaggctgaggaaggtgatgaaaaggataaaaggatatcgcttaactgattgattcaagatggcttatgaagacccagagtttcacaggcttggggcctgaaaacaggagggcagagcttattttggcatggcagacatgtgccatgtaaaaataaaaggaagagataactaaaaggaagagataacttttaatgttcacagatgatttcattttctcccttaaactatacatttgagtcacttttcaaaaatagcacttatattcaatgatacaaacattccaccattctctttttaagttgccttctgaa

SEQ ID NO: 126696 - DNA, 229 bp, Homo sapiens
tgtagtcgatctagaggtccctgcggtctcttcctggacacgtaaatccagtgggctggggtggcctactgagaagatgccatctgaacaaagaattgaaggaggcaaggagtgtgagcagtggggctatctgggagagagttccaggcagaggaggcagcaagtgtgaggctctagagggaagagagacgttctcatgtttcaatctgtgtttctggaggagagagag

SEQ ID NO: 126697 - DNA, 566 bp, Homo sapiens
cacgtggcagtgttggtttggtgcagaggagtggttatcgcctgtcggcagatcgtgcactcccagcaggatttgtgcccctgtgctacctatccgactcctctggacaattgcatttgcaacccttgtctataccatcgatctgccatgacttagcaaatatgtcttgtcttgttattgactgttctgtgtttacatgtgtgtcttatattcccttcacaattcaattgccctcttcctgagggtagggagtctctgttaactttacatgcctcctgcagtacctgacacatagtaggtctgttgtttgagaggccagtgcctgaggtggaatttgccttatgacttgcttctaggtcagtggttctcacttgcaccctctgtcaacattataccaggcttgggggtggggtacactctgtccagtgtttactagaaagttccagcagaggtttgaagcatgcccgccccttagcattacagggttgggcttgtggtgaaggcaatggcgggtgtcatttgcagaacccccctgggtgattccagggcatcccctagtggaaggc

SEQ ID NO: 126698 - DNA, 184 bp, Homo sapiens
taacccttagggcttctgcatacgcactaccttcagcctaaaatattcttatcattactccctcctcaattcttaggctttaacatcttctcatccttccatctttgtctcaaatatcatgtccttcactaggggtagcagtttatacctgtaattccagtgctttgggagatggtaagatcgc

SEQ ID NO: 126699 - DNA, 373 bp, Homo sapiens
tcttcgagtgccaaaagggaagtgctataaaacaaagacaaataaaaaatacctacactgatgacggtatatcaaagggacacaagagccaactgagcaggacatggtggttcatgcctgtaatcccagcgctttgggaggctaaggcgggtggatcacttgaggtcaggagttcgagaccagcctggccaatatggtgaaacccccatctctactaaaaatacaaaaattagctgggcgtggcggcacacacctgtaatcctagctactcaggaggctgaggcaagagaattgcttgaacccaggaggcagaggttgcagtgagccaagattgcgctgctgcacatgaacctgggcaacagagtgagacgcc

SEQ ID NO: 126700 - DNA, 246 bp, Homo sapiens
tgctgagatcatggacctgagccaccgcaccaggcctatacaactgttttgattttaaaaaaagatacaaagttttcagtgaacccaaagagaagagtaggtttacatgaaagcagggagatgagtgagctgcagaggtagcaggctgtggtcctggaatgggaccctggagtgtattatctgtctatggaatcacaaggtcttagatctgaagaggagtagctggaatctggtcccaccctgcca

SEQ ID NO: 126701 - DNA, 706 bp, Homo sapiens
aatgacaagatctcattcttttttatggctgaatagtaatccattgcagataagtgccacattttctttatccattcatctgtgaatggacacttaggttgcttccaaattttggctgttgtgaatagtgctgcaacaaacatgggagtgcaaatatattttctatatactgatttcctttcttttgagtatatacccagtagattgttaggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattagaagtaaaactgcctttgctatatagtatgcatagaatattttaaagttattactagaagctgacacattgttgttttctattacaaacaataaaattagtttccatttattgagggcctgtttcatgttaactgctttacagatattccttatctcatttaattctcccaacaatcctacaagaaagctaatatcccattttatagatgaggaaattgaggcttacagagggcaagtaacttgcccaaagtcactcagtaccagcaaatggactttttcccctctccctgccccc

SEQ ID NO: 126702 - DNA, 311 bp, Homo sapiens
cctcatcttggtccctctcagcactttatctgtccactcgtctgacaatcatcctttcctaacaaagacaacattatgtacatcacagctcttttcctccaacaggaatctgattcattattgcatctacacagtgttttgaacatagtaagcattcaacaaattactgatctgttaagggatgaaaggatgagactttgtaccacagtcaggcagagtcagagaaaatgagagaagctgagtccttttgcaaagctcccaaatgcagccagggtggctaagacactgggaaaggaatattgcaacagcaa

SEQ ID NO: 126703 - DNA, 388 bp, Homo sapiens
tggcctgacattcaagacttaccatgatactcatttaacaaacatgtataaaaacctaagaaatcaaagatacaatgctggacccaggggaaaataaaaagatagactgcgtctcaaaacaatgtcccagctttacttcccattattcccaatacacattctcccaacaatttaagtagtttacatttccaaaatatctcctgtccaaaagtcacagactagtgggcctaagccaagaatttggctggaaaagtgttttgtttggcatagtgtttgaaaaaatatttgaatttgaatatgttttgagggaagggggaatatactctctaattatcctggtccatgtcacttcatctacaatgtctgcctagcccctaaagaaatctga

SEQ ID NO: 126704 - DNA, 426 bp, Homo sapiens
actgctgttctcctcctcgattacagttttgatgccatgtttcaaattttattgcatatgtagtccatgtttattttagaataatttgtaaaattcaggtatatagaaagaaaaaccaataaaaaaagttcccatagttctgtaatccagagacaactgtgtttctctgcaaaaacatataaatgcatgtgtacatacacagtatatataaaaaatggtattatataaaaacctggcctaaaggcagatttttaaaggtggaacataatgcaagtctgcctttcttaggatgatctaagttacatgttaataaagttcttggagatctagcatagaatgcattcagcactttgggaggccaaggcaggtggatcaattgaggccaagagttcaagaccagcctggccaacatggcgaaatcctctc

SEQ ID NO: 126705 - DNA, 511 bp, Homo sapiens
tcatctctttttttgcattgttttttatagtttgccaaaacagtcacagctgccatccatttgaccctttcagcagccccattcactgggtggtgaacagaatatgggtattgggggtcagccagatctgggtttgattcctaaatttccgacctcctagctgagaggtcttgggtagggacctcgtctacctcatcaggctcagggcctgcaccagcaagatggggaaaatcacatctcttcaaaggttcacatgagagttaagtgcataaatgcttcacatttaacagatgcttaatacacgggagttaccttcactgtcaacttgcagacaagaaaactgaggctgagggagggcaggcacctggattgagttaaaacaactaggagatggcagagccaacttggaccaggtcttttgtatctttgggatcaatgtctaaacgtttctttcctccctccttccttccctcctttcctacacactctgtgctcggcatgggtccccagg

SEQ ID NO: 126706 - DNA, 162 bp, Homo sapiens
tttgaattcttggtgcaaatgtctcttgttacatactgctcgttttcaagtatcatcttgttatgctacctatttttttgattcattacttctgatttactttttcctggtaaaactaataatggatctcattaaatttatgtataacattgaagaaagtgg

SEQ ID NO: 126707 - DNA, 464 bp, Homo sapiens
ctcctgacctcaagtgatctgcccacctcagcctcccaaagtgctgggattacaggcatgagctgtgacacccagcgtgtctaatttttgacagataaaatgatttcatgatccaacatttccttagcagtgagggatacaataaaataccaattctcagtgggcctttatacttcttttttttttttttttgagaggagtcttgctctgtcgcccaggcaggagtgcaacagtgcaatcttggctcactgcagcctccgcctgccaggttccagcgattctcctgcctcagcctcctgggtatgggtaactgggattacaggcacgtgccaccatgttcgactaatttttgtatttttagtagagatgggatttcaccatgttggctagcctggtctcaaactcctaacctcaagtgatccgtctgcctcagtctcccaaagtgctaggatgtgggtgtgagc

SEQ ID NO: 126708 - DNA, 156 bp, Homo sapiens
actaaattcctacaacattaatactggttctctaagaagccgggactttttcagtaagtactcttcagagataaatagaagaaaattgaaagatgagggtgctgagatatgtgaaggtagggctgggcacagtagctcatgcctataatcccagca

SEQ ID NO: 126709 - DNA, 655 bp, Homo sapiens
ggcttttgagcaaaggagtggaaaggtacggaaagaactggagggggctaagaagacacaggctgaatccactcatactgagaagatgctagagggcctcacaggacccttccatcctcacctttcccaccccacctcacaccccgagcagctctgcatcaatctttttaaaaaactgttgaataaagcaaaaagaaaaggaaaaaaggaaagccattagtctttatgctccttccaggattaaaattcaatttcttcaattagggtaggaatccttgtctatttctcactttgcatatatacctccccaagtataaacttcccatcttcattctgaaaagtaaatgtgcctcaaaccaattagtgaagtagaacaaaaccttcaaattctattttccacagagcatataatcctatatctacttaaatatacaaagcactactttcagtcatcattcttgctcaatcaataccatttatctattaataggatggctctcttatttgctctagcataaaactgaccccatagtagttatagaagttgaagagatacaacttaaaaagaatctacccttttaaatttaaccaatcccagttgtcctttataacaactgatacatggatattcaactagtgtatggcaaggcagtca

SEQ ID NO: 126710 - DNA, 300 bp, Homo sapiens
attaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcat

SEQ ID NO: 126711 - DNA, 330 bp, Homo sapiens
gtgtcagagctatttttgttttttaaaaaatattcttacaaacacccctcttcttgagcttaaccaccacatatcccttccataggaacaagatatggtatgtgtaactaagtcatctctagtgagtcactggatacaatttatatatcgaagtatccttagcatgtgtttgcttctgctttagttgaaatgttaagccttctataggtgttattcatatttatactcccacagcccagaagagtggctgatacataataggttaataataagggcttgatgggccaggcacagtgactcacatgcctgtagtcccagcttcttgggagg

SEQ ID NO: 126712 - DNA, 723 bp, Homo sapiens
gggggtaagaagctcatgccgcatcaagatatcttaactgtcagaggctatcagtggaggggagagtgacagctccagcctttctcactacttgctgatgtggaaaattatcatccagtaatggagggagattagccacgtattgtatttccatcgtcgggtgcatggcatgggaggatgatttatagaactggaaccctgaagctagtggaaaggtcacagaaagtggaatcattggcctcaacacagtggctagtgtctgagggaacctcctagagccacatgcatgccaggccatcctgagtgcttgagagagacatgggcacattaacacacatttaagtcccaacagggcacccagaatactaagataaatagacaccgtctctgtcctaaggggaattacagcctagttcaggagacagatgcaccaacagacaggtgacagtgatgaattgcagtcatgaaccaggggctggagaaacacagaagacagagagcagagtttggaagagggtgggagggactgcctgccccaagaaggattcatgaaggtgccatgtcagtcagggttggtggaccattgtaataagcagcccccaaatgaaatctcagttgcttagtacagtaaaggttacttttcaccccacggtggagtgtgagctggggatgggagggaggagagttccaccacaccggtcttcaggccccaaggctgcaccc

SEQ ID NO: 126713 - DNA, 423 bp, Homo sapiens
  misc_feature (7)..(7): n is a, c, g, or t
  misc_feature (171)..(171): n is a, c, g, or t
  misc_feature (213)..(213): n is a, c, g, or t
gagtatnccttagtcctcctcctccttggatggggaaggaagcggggggactgctccaggagagtgaggacggcgtggggatgatgggtgctggcaagggaatctgaaccgggtgtgctgggctcactgctgctcagctcactgctgacgctgagccagaggggcccaggnagctactggccccagccaccccagtactggctgggcgcgtgngcagttttgcttaaacaaataaacaaaacaaatacatacgtacacacatacacaggaacaaagtctgggaggacaatactaaaatattaatgagttaccagcctggccaacagggtgaagggtgaaaccccatctctactaaaaatacaaaaatcagccaggcatggtggtgggcacctgtaatcccagctactcgggaggctgaggcat

SEQ ID NO: 126714 - DNA, 546 bp, Homo sapiens
aaggatccccttcgacggtgttctggtgtgtgtcacctacaatgctgcaagttcctttaaagtctattcttattttttttctgagacagggctctcattcttggcactcaggctagagtgcagcggcgcaaacacagctcactgcagcctcaatctcccaggctcaggtgatccacccgcctcggcctcccaaagtgctggaattacaggcgtgagccaccgtgtccaggcaaaataataatacttttaagatctaagaatttattgctgaaaagatcattatatggtgagactacctagttagtaaagagaaggaacttcatgagggatggcaggggttgggctgtcacacggagatgaccagccagattagatggaaggtatcttagtggaaagatgtaagggtaagaaaaacgggcaatttaggcagggtatgttgataataggatcatgtgtttgtttagatggggaactgagttcctggacaggggaataatatgatgaaagcagtgtaatcacactaatatagggtggatttcagtgtgg

SEQ ID NO: 126715 - DNA, 756 bp, Homo sapiens
gaggcagggcacagtgtggctcacacctgtaatcccagcactttgggaggccgaggcaggaagatcacttgagtccaggagttggaggccagcctgggcaacataacaagacctatctctacagaaaatttttttaaattagctgggcatggtggcacatgtctgtagtctcagatactccagaggctgaggcaggaggatcgcttgaacctggaaggtcaagactgcaatgagccatgatcctatcactgcactgcaacctgggtgacacagtattatttattttgagatcctatctcaaaattaataacctaaataaataggtgggagagtggacactcttacatcaggtcagaggcttaatatccataatacagaaagattttcaaaactgacaaaggacaccccaacaaaaaaatgggcaaaagacaggcaattcttagaaaaacaaaatcaaatggcaaacaaaggcaagtcttaaaagaacaagttcaaatggcaaacaacattaaaattcacaactgggatcaagttccaatgagatatccctttacatccaacagactggcaaaaattaaagatcataaagccaacttctggcccagataaaaagaaaaagctgccatttattattgatggagaacacaggaagcatcagaagcctttttggaaagcaatctttcaacatttattacagttttttgtttttttaaaggttccctttcaccaagctatcccattctttgatatctatcc

SEQ ID NO: 126716 - DNA, 445 bp, Homo sapiens
ggagcacatgtggtaatttaatacattcacacaatttgtaaagatcaaatcaatgtacttgggatatgtatcaccttaaatatttgtcttttctttatgctagaaccaaattgttctcttctagctattttgaaatatacagtagattactgtaaactgtagtcaccctactgatctagctaacatgaggtctttaaaatgaacataataattgtaaggataaaatgagagcccagcacacggtatatgacagtccagtggatgtctcagaaaaacctcatgaaattcgggttaaaaaaaaaaaaaaagtcaaggattgaagttctgaccaagtctgctctacactgtgctaggagctgtttttgggcctcacaaagtgaagtattcttgataggttgtgtgcacatcccagttttcagaaagcaaatcctacctcactccactc

SEQ ID NO: 126717 - DNA, 468 bp, Homo sapiens
tctctttgagaaatggtcctgaaagccacccctgtgatctttacgaagaaaacttttccccataaattatgaatacatttttcctcacaagtcaaaaacatcctctttgatccaccatctgtctttactgaacaatattagaaatactgtaataaggccaggcacagtggctcaagcctgtaatctcagcactttgggaggctgaggcaggtggatcacctgaggtcaggagttcaaggccaacctgaccaacatggtgaaacctcatctctactaaaaatacaaaaattagccaggcatggtggcaggcacctgcagtcccagctatttgggaggctgaggcaggagaatcacttgaacccgggaggtgaaggttgcagtgaactgagatcgcacccttgtactcctgcctgagcaacaagagcaaaactctgtctcaaaaaaaaaaaaaatactataataaagaca

SEQ ID NO: 126718 - DNA, 140 bp, Homo sapiens
tggggagccaattaagaatgtgagccctgaagtcacaaagcctgcatttgaatcatagtttacccgtgtaacacctctgtttcctcatctgaacagtgaaggttcttggcctcagttgaagatgtgagcatttagtcagt

SEQ ID NO: 126719 - DNA, 758 bp, Homo sapiens
gaagattttaaaaatgtgtttgtttcttttaccctggagattctgagcaatcagtcttgggtttttcttctctaaactgtttatgcttatgaaggaaataatttaatcaacttgtgaaagtggatttttttccaaacattttcagctttgatggctaattcacatataagagcattgaagattgttttcggggctttgttctatgcagcctgtctatgctatttgttgtgttaggatacttttgttaagcagtgtgggctaacttaaaattaatttaaaatcaataactgttacctttgaaaaatctgcagttaattatgtggtttttggctacatttagaatttggtgtgattgaagcttgtcattttctctcataaatttagtgtccaaactctctgacccaaagcatagggccattctgagtcactgatggacatagtccaagataaatatagcagaaatgcattcctgggctctacatgtgtaaatgtgaggtataatgaaataatttctactggcttatcaatatatcttttagggtcattcctcactctcaatgcataacctacaacagtgttggaaatatgtttcatttcagtagttataggccttatataaatctctactggggaggattctgaggccatatccagccttagtaagacaaatgttttgattgattagcagtgtgttccacggatacagcaagagtcaggagtggtcctaccctggccatcatctctgtttgggctggaca

SEQ ID NO: 126720 - DNA, 316 bp, Homo sapiens
acaggaaatgcattgcatgtttccagttgcagcccttgccctctcttcactaaactgaaaatctggccatgccagcatgtggtggttcctaagacccaggcctctcctcctctctgctcctttgctagaagccctcttcttccccacttccaccacagcctcttctacaccacataaatatctgtatgggctcaaggcccaacccaaatgttaccttttctcttgaagctgtctccaacccttctaaaggaacatttgtgatctttcacattgcattgcacttttcctgtatttctattccacaagttgcagtgtg

SEQ ID NO: 126721 - DNA, 201 bp, Homo sapiens
ctctgagaaattaagtgacttatttaatgtcacagggctagggccagggcagtgataagaggaataactaagtcttttagaagaagaagaggtggacacaagagagaagctccccgctggaagctagaactccagaactgagagattccagagtgggaattactggcagcactaatgtgtctttaggaattgaaaaagcaa

SEQ ID NO: 126722 - DNA, 488 bp, Homo sapiens
aaggcagcgcacgtcgggggtgcttctgccaccctgccctgtggagtcggctcacagtaaatgctctaggcatgtttgtctttcctttgtgtcagtgagctgcataaccttgggcatttgtcagggaacctaatgcaggccctgcggtgtgagcttgggatcccctcagccctcaggcaagcaggcgtggctccagggaagtgacccaggcatggcatatatgtgccgacgaaatgcagactggagagcaggggccgccgcccatctgccaggttttccagagcaaacctgaatcaatcacaggccttttaatctcgccacccagagcgtgggggacacccctcagaagtacagggtttgggacctctgacagagggcagctgtctaaatatgcgaggaagcgtgcatggcgtgcgtctgggctgccttgccaaggtcaagttgtaaatctctttcccaagatctggccacacggtgcgttggcccat

SEQ ID NO: 126723 - DNA, 371 bp, Homo sapiens
aacaagacaacaactgaggggttcccgggtactgctagcggtcaccacttagacatcgggcaagcaggcgtggctccagggaagtgacccaggcatggcatatatgtgccgacgaaatgcagactggagagcaggggccgccgcccatctgccaggttttccagagcaaacctgaatcaatcacaggccttttaatctcgccacccagagcgtgggggacacccctcagaagtacagggtttgggacctctgacagagggcagctgtctaaatatgcgaggaagcgtgcatggcgtgcgtctgggctgccttgccaaggtcaagttgtaaatctctttcccaagatctggccacacggtgcgttggcccat

SEQ ID NO: 126724 - DNA, 630 bp, Homo sapiens
agcggggaacaatcactcgagcgggacgcagtggctattttggtattttagtagagatggggtttcaccatgttgtccaggctggtctcgaactcctgacctcgtgatccacccacctcggcctcccaaagcgctgggattacaggcttgagccaccacgcccagcctacaattagaatcttatgctttcttttacaacctcaaatggacagtgctcataaaattaaaaaatcatgctttcataaacattaaaacctgtcataaaattagtggcaattaataggctttcttagtctctctatataaataaccagtgaaccatttattttctccctgttgtgcaaagccaagtggtcaatgcagttgatttcagattgagcattttttaacaaaattattgaagcatacacagacttaatacttttggagaattatggagtatgaaaggaaaattttgaactctgcagtttttactgctagagagttctaagacattcaaagttatttttctttttaaccgatgaaagaatgtttatgtgcagaaaaagatgagatatttttgttgaagcaagtgattgtgcttcagactggaatccttttgaattcatgttgttttccctgtaaagagaa

SEQ ID NO: 126725 - DNA, 226 bp, Homo sapiens
taaaccaggggaggggaagagaaggaggagagagggagggtgaatgagtaggtgggggagaagaaatgaggaagggtgggaggcgaatgctacagccgtgaaagttaggggagactccatgtgctgggcatacaggaagtgcccagcccagctcaatactcaacacgcatcgtcccgcagtatcacccactgcagctccccgcggcagatgctgccatgagcttca

SEQ ID NO: 126726 - DNA, 356 bp, Homo sapiens
taaataaacaggtttgctgaaaatggtctccttgttttccccaataacctccacaatgtgttagaaattacctcacttcagcttctcagtacttactattttccacattttacagttgggaaatgactttcctgagatcacatcctaatcaactacagaatgaacactagactctggttcttttgattccaaatctttttatttacatatatttcatcaagaggtggcagaaggtaaaggagtatagaaaacgaagtgtgtgatatgcccggtgtggttgtaattccaacactttgggaggccaaggagggcatattgcttgagcccaggagttcaagctagcgagaccccatctc

SEQ ID NO: 126727 - DNA, 458 bp, Homo sapiens
ccctccactcacccaaggaggcatcttagagacccagatgcctgggggtctcctacctccccctccacctacccaaggaggcatcttagagacccagatgcctgggggtctcctacctccccctccacctacccactttctagggctctcttaagggggaaatctaaatctatctcgggataggaatcccactctcccgcaggcttaaggaggactcctgcctcattcaccccttttctccatctcactctgatttaaagcagcgcaggtcatatccaggcttagctggccaacagggagggaacgttcccatctcaggcctggtgagtgtctcctgtcctcccctcactcctacctccactgtttaaaaaatgattctatgatactcgttaaagcacgagcaggaacattttattcaggatcatcacaagagatatctaggcaagactgcaatggga

SEQ ID NO: 126728 - DNA, 810 bp, Homo sapiens
gggaacacaagccagcccataatagtggttatttgtatacattacatgtcttctcctctttcctttcccccattagattgtgaggtatttgaaggcagagccttatacagatgggcttattaagtcttaatataatgcccatacataataaatagtctctgaatatctgaagttaattttgattaaatcaacacttcaaaaatttagtgtagttattagacttttatggaaatgatctatagccacacatactacttaaaaaattactttatgaatttggcaaaatgctgccaagtcatttataaaacaacacatggccagaatactaggcttctctgcttttttttccccttcagacttaagtgatactcattgttcttttgcatacacatcttctctcattcttataaactcaaggtcgaaaaaaaggtcagggtggaacttaacatgtccacctcctaaatccgcacaggaatcttcattctctgcattcaactggcaaatgttaaataaagcttggatgtaacaagccaattcattcagctctctggggtagtaacatcaaaggctacatcaggaagccatgctactcagaattggatgttccttgggaatacttatgaagtgaacattggctaggcgaggaatgcagtaactgccattttgaaaacatatgaggcttaaagcatttctgccatccaccgtggtgtagattcctggatgctctatcaaatacatgtctaaatgtcagagcagagtctttgctgcatgctaaaaagaatgccttgtttagctacagcctccttagca

SEQ ID NO: 126729 - DNA, 155 bp, Homo sapiens
attatagacacaaaattaaacatatcaaacccacacatcagaattattttttaaaagttaatgtaatcatctgtttggagcatcattatggcttattcaaaagagaacacttacacatatactttttccattaatttaaacacatatagctcact

SEQ ID NO: 126730 - DNA, 839 bp, Homo sapiens
gtggcagcctttgtgcaaggttgtggtttttgcagagtcttttgtgatagttcctgttatcaggcatacgtgcatgaaagtccttccttcatggccttccttagctctgtttgtcagggttttgacacaagtgactccattttgattctgacaacttttgcagacgtatgatggtatctgattgtggtttgaatttgcatttctctaatgtaatgatgttgagaaagttttaaaggtttatttgccatctgtgtatcttatttggtgaaatgtgttttcaaatctgactatttttaatggttgtttgtatcttattttattgtttgtctcgtattactgggtttgagagttcattatatattttggataagagtcctttatcagacatataatttgtaaatattttctcccgatttctggcctttcattcttaacagtatctttcaaagagcagaaatttttgtcttcaatgaagtcaaattgtcaaattttccatttatggattgtgcgttgaatactatagctgtgaaaccttcacctagtataaggtcacaaagatattttcctagatttccttctagaagttttgtagttttaggttttacacttgagtctatgatcaattttgagttaattcttgaatatgacatgtggatcaaagcacttttttttgcatatggatatataattgtgtcagcgtcattcattaggaagaacattctttctcctctgaatttcttttgcacctttataaaaaatcaattgtccattcatatgtgggtctatttctagactatgctgttccattgatctatttgtctatgtttatactaataacc

SEQ ID NO: 126731 - DNA, 394 bp, Homo sapiens
ttaatgcaacagcttcccaactactctgtctgcttctactctggtcccctgcaatctcatctcaaaattgtattcatagtgctccttctaaagcaaaagcaaaatcataccactcatttaaaaccttccactgggttagcatttcagagtgaaagctaaagtccttacaattggctttagaaccccatacagtctcccacctattctcttacctgtctcattcctactggctttctcctcacttactgtgttgcttggccacactggcctttgtattattcctggaatatggcaggtatgctgctgcctgaaggcctttgcatgtgctaagtctggttcttcctctagatattctcaggtctcactctcttacctcctttaagtctttgctcag

SEQ ID NO: 126732 - DNA, 300 bp, Homo sapiens
aatgggcttttaaagatcatctttcagcagtgagaaggtagtgtgaacggaaaaaaaaaaacccaggaaattcaatatcagcatacatataacatttaagttaattcagcccagctggtcagcagaggttgctgttctcggtgtgttccaagaccacagatggcaagccagtcttgatggctttttaaaaaaaatatttgagacagggtcttgttctgtgactcaggctggagtgtggtggcgtgatcatggctcactgcagtctcaacctcccgggctcaagcaatcctcttacctcag

SEQ ID NO: 126733 - DNA, 650 bp, Homo sapiens
gaaccctggaggcggaggttgtggtgagatgagatcgtgccattgcactccagcctgggcaacaagagcgaaactccatctaaaaaaacaaaacaaaacaaaacaaaaaatacttttagaagaaaacttagaaagatatctttatgacttagagtaggtaaagatttcttaggatacaacaaatataataattaaaaattgataaattacactttctcaaaactaaaaacttctgctcatcaggctaaacatttaaagaaatgaacatacacgttacaaactgggagacaatatttgcaaaacatgtatctgaccaaagacttgtatcctgagtatataatatatatgtgcatgtgtttacacacacacacacacacacacacacacctgcctacaagtcaacaatgaaaagagaagctaattaaaaaaaatgggcaaaaggtggaaggtaaccaccttttgtcatcttttcagctgaaaattacaaaacactgaggaaagaaatcaaagatctaaataaatggaacaatatatcatgttcatgggttgaaagattcgtacggtaaagatgccagatttcccaaatcgattaataggtataatgcaatttctataaaaatctcagcaagtttttttgtagaagtagaaaa

SEQ ID NO: 126734 - DNA, 519 bp, Homo sapiens
taggcagctcttgtgcgggagacctgggcaccagccaagaagagacacaggagatgggagcgggaccctgccactgccaacatgatcctacagcaggaagggcctgctcaacaccatgcagcaggggccctgggctcggccaggggtcccccagccctccactgttctcctgtttcctgtgccccacagtggtggggtggagggagctggtggattgcttggccattgagcctccccttcgtgctgccctccaggagcttcacatccacctgtctggcaccaccccacattgggccattactaactcactctgtgacctgaggcaagtcacctctctctgggcctgggttccccaaaagtcaaagaaggcactaaaccagaggttgtccttacacctctgcatcctagagttctctgagagaatgagtggtaaatccccacctcttgggagtttcccagtgggtggggatcagggcagggggtgcagggacttcccatgacaaggggcacattcaggga

SEQ ID NO: 126735 - DNA, 186 bp, Homo sapiens
atttaaaagaagcttctcttgacttctcttaaaactaaggctcttgaaagtataaacattaaggttaaataacgctggcaagaatacaaggaaatgacattggtgtattgctaatggtactaggaaagtattctgcaagtatctactaaattaaaaatacagtagtgcccccttatccatgatgag

SEQ ID NO: 126736 - DNA, 141 bp, Homo sapiens
atggtcctcagctcatgtgtgaaatgtgcctccctcaaaccatgttaggacgttggcatattgcccatctgaaatgaaaaaaagtttttgttatataaatatgttggctgggtgtggtggcacatgcttgtaatcccagca

SEQ ID NO: 126737 - DNA, 518 bp, Homo sapiens
ccaccatgcctggctaattttttgtttcgtatttttagtacagacggggtttcaccgtgttagccaggatggtctcgatctcctgacctcgtggtccgcccgcctaggcctcccaaagtactgggattacaggcgtgagccaccgcgcccggctggaacattgtatcttttacctgctaacgtgcccgtatttttctgtgagtcactgatatgactgacagtgagtttggagtttcctgtctgcgtgccaagtgtctttcagtgagccagggacaaagatatgccacaccatagcagcctttattccaagcacacctcacaccaagctagggggcacttttatatttctgtttattttctgtttattttgtggaagtctcctatggccacatggctcgaaatgttacagtgtgtgacagtggtgggaaatgtgtaggttatcctcattcatacctggggttattgtgaattcttccttcactcactgcccctccctcctccccctgctccctcctatc

SEQ ID NO: 126738 - DNA, 611 bp, Homo sapiens
tggggagaaatcatggcctcacatgccagtagctgggtgcctttgggactttgtgggcgctgtctgtctgcctgctcacctcttaaagccccccaggtcctgctaattcgctgctgacgaaatcgaaagagcacagcatcgagaaagtgcaaagccaactcagaatggagaaaagttcaggaaatcatataactgataaggggacctgtttctaaatatctgaagaactcttacacctcggtattaaaaagacaaacaacctacataaagtgggcaaaagactggaaaagacacttctccaaaaaagatatacaaatgcacatgaaaagatgttcagcatcattagccctcagggaaatgcaaatgaaaaccacaatgagataccacttcacacccactaggatggctacaatgatatatttttttaaaagacagggaggatgtggagaaatcagaaccctcctacactgctgctgggattgtaaaatggtgcaggcaccgtggagaacagcctgggaattcttcaaaacgttaaacagtttctatatgacccagcaactccactcctagctatatatccaagagaaggaagaatgtatatccacacaaaa

SEQ ID NO: 126739 - DNA, 357 bp, Homo sapiens
cttaaagaatcagattgctccactgaacaatcttaacaccattaaaacagagaacaatagatactggatgcaatatgatgccacaggaagtaccaagcgctgtttatgaagtgtttttgccaaaaaaaaaacccaaacaaaaaaaaaggattctgaatctaatcaacgccatggacctaattagcagtttatagaaaattggaagacatctgaacaagttaatgacatcatgaggataagatataaccagaaaaacccagaatttaggaaattcaacaaaacaaatgcctcagtttcttcaacaaaaaaataacatttcaaaaacaggtcaaggaaaattgttacaaatttaaaaag

SEQ ID NO: 126740 - DNA, 1259 bp, Homo sapiens
cctcagcctgatgctgtctgagtatctgacctaaaggcttccaagacaaagatggtcccacagggctctcagcagcctggaagaatatcgttgttcagaccagattgaagattgtgttctgcccagagggagtttgttgggccctcatctctaccagatccaaggactgtttctcacagagactcagtaggatgtggaagaagaaggccgtggctccgttggctcagggaacatctgccttttcccctcctgccacctcccctggcagtggagggtgacctgtctctctccttggcacctcatcagagattcttctctcttggacaacaccctccatcctcggaacccttttctttccttatctcgggaaaccttccatattgtacctacttctcattctcttattactgccttcctccgccatcaaacagcatttacccctcctgttggccattctgtcagaacccctctttgaacctctgtagctggttcactccttccttcctgcttgtcccagggagaggatcgtggctaagttctcctgggcacgtgttctgttctacccttgaagagcagtgccaggcctgggtacagcatgagtggcagcctccctgccagctgatagccctagctttccactgtcaccagcggagggtaagggaacagtccagcagcttcagaggcctgacgtggctcatgctgcccgtggctctgcagatgtgtgattctttctgtgtgtgagagagacaccaaagcccacagtcaaattctcagtcactttcgtaaattacaaggaagatgggctgtatagaatcattgaagattataaaaatgttggtttttacctttaaagtaacttctttgtttatcctttccatgttaattgctactccctgagtttattcatcttttgtttatctatcaagcatgtgttcagtagctgttaggtaccaggcactgggattcagtggtgagcaggacagctgcagcctttgcttccgtgcacagctcacggcattgctcgaatgatgccacaggcatctgcttctctctgccgcttccgtttctatcttccatggggcttccctcccaggagagcgtgcctcatatgtgcttggctttcgttctttgctctgcctgctttgcatggtccaggctctgtagcctggcatttaattattctgttccagcttcccttccttggtgctttttcccctcctgccacctcccctggcaatggagggcgacctgtctcctcg

SEQ ID NO: 126741 - DNA, 274 bp, Homo sapiens
catttcacctgtttagacacttactggcatgcctgccgctgctggccaacttcataaccttactcttgctcacccagagggtgttacagtgcgttcctcactgtctgcctccattttcttgggtcttccagaatcgctgccagcaccagccagaacatgcccctcttccttggttgttctcctatattgaccaagtcacacccagcctcttgatagtcagggccctttcgatcttgtcccagatgactttttcaccccatgtcctacccctctc

SEQ ID NO: 126742 - DNA, 428 bp, Homo sapiens
gtgatttggaaggagctggctttggttacatatgtaaactgtatacaaccatttcttgcactcttaaaatgtgataggctttagtctctcaggtaaactttttgaaaacttaaaacagctgcaaaaaaaagtaagcccaaaatgtttgtttcaagtcatgaatagataatagttattttgagggcactaaaatagattctgctttgaaagtaatattcttagggtgtgtgtgtgtgtgtgtgtgtgtgtgtgtgtgtgtgtgtgtgtgtgaccacaaaaaaaataaaaaattttcaacagagttttgaccacctttttacagaactaggctaaattataaatgcattcaagtgacatcccatcttaaaaattacaatttttttgattgaacacaaaaaagaaacaatttctttttaataaagagttaa

SEQ ID NO: 126743 - DNA, 533 bp, Homo sapiens
aataacctccaaacaagggtcctcatttttagaaactttcgtactgggatgccttatctagctgctcctacagaacaagtcatttccctggatttgaagacaatgacacaagactaaggataatggggaaaaaatgcaatcaataagtagaagtcagaagtgtggcatagcacaaaagggatccttaattagaaattcaatggtctcagttccagacccaggtatcactgacttgttataagatcttaggaaacttaccatttaggcaggtacaggggctcatgccagggctttgggaggccaaggcaggcagatcacctgagatcaggagttcaagatcagcctgaccaacatggtgaaaccctgtctctactaaaaatacaaaaattagctaggtgtggtggtgcacacctataattccagctactcaggaggctctggggcaggagaatcacttgaacctgggaggtggaagttgcagtgagccgaaatggcaccaccgtactccagtctgggtgacacagcaagactcc

SEQ ID NO: 126744 - DNA, 178 bp, Homo sapiens
cgtagaaaaaagggatttttctcataaagcaccgagcatgaagccaacgtggaaaccatgattttgtaccaaaaatctgacatcctttaaaagaattaattgcctctcgagtagctgagacaaagactgtgtccaacagtgccaagctagttccagtaatttttttaattaaaaaaaa

SEQ ID NO: 126745 - DNA, 556 bp, Homo sapiens
cgtagaaaaaagggatttttctcataaagcaccgagcatgaagccaacgtggaaaccatgattttgtaccaaaaatctgacatcctttaaaagaattaattgcctctggaaatgagtgttttcatttttgcaagaacctatccccaggcagatggcctcctcaggtggaggtgaatttcaggcttcaggagggaacgtcgctgggcccagggagtgctgggtggagtcaggttaggaggccatgaacttggcatctcttccagtccagccacttgggaacctgtcagggccttgtactggccttacacagttttgtaccaggcctgggggccttcagacagacctgaattgcatggccaccatctgctacctacacatgtgaaatcagttctggtaattctgattttgccttttttttccttcggacatagggtcttgctatgttgccccggctgggctcgagcgaacctcctgcctcagcctctcgagtagctgagacaaagactgtgtccaacagtgccaagctagttccagtaatttttttaattaaaaaaaa

SEQ ID NO: 126746 - DNA, 474 bp, Homo sapiens
ggcgggcttggaggaggacagggacaccctcagatgtcagacgacaaggtggacagggtacaacgagaggtccatgcagaagcatggaagcttaaaaccaccagactggaagagggagctgcacccagaacacagaatgtgcagaagggaagaatggagagtgcgaaaccgtgccaggagatgcgggctctgctgtgtgaagccatcggattctggaacaaaatgacactttgatccaagatttagaaaaagcatcaccgtaacaatgtaaagactggcaagaaaaaaacctgacggcaggaagactaggagagaaacgattccttccccgcctggaaaagaggtagggacagacgaaaaagagggaaagggacaggccaagagatattctgggttcaagcagctggactgcgagctgccgccgtgttatgcccttcttttcgtagctctggatccctgaccacctggtgcagt

SEQ ID NO: 126747 - DNA, 513 bp, Homo sapiens
tggctctttggagcctcagttttccttcatgatggtggtggaaaagcactcaggacaaagtacttgatgttctcaagggtgagtgagttgtggagtatgaaccatgtggaccatgtgagatatgtggatggaaagagacccctgggcaagatgagacatacctgaattgaacagaaatggcaacaataatgatgttgaagaaagtaaacctaaattcatgcacagttcaggggttgagtaggggaattctcagtccatcccagagtctttttttctccctcaagtttaactttattctgactcttgcagactcttgtaagttctgggcttccttcctctgagatctgaagtggtctctgagctgctggctcctggaagctttacttttccctctaattacttctctctgaaatgtgtggttcttctgggttgtattcatccactggctatcaagactgaccctatccttctgtgaggctgagctacttcacctgttttagcctggcaccctaa

SEQ ID NO: 126748 - DNA, 479 bp, Homo sapiens
caactcttgtcctgctgaagtcaccaccagaccttccactccaccaccagtatctggtacattctcataacacagggtttcttgacttcagcactactggcatctggggccaggtaactcttggtgtggggccatcctatgcatggcaggatgttcagcagaatccctggcctctacccataagatgccaggagcacagcccctcaaccccaacctggctatgaccatcacaaaatgtctccagacattgccaaatgtcccttgagggtgaatttgatctacctccccctctgaaaaccactgtcataaacacctgatatcagattatgagatcagagaagaaataagcagagatcaaggaagatggcatcactagtaacctctctgacctgaagttcttaactacaaaattgcagatacctgagcctcaagatgttgtcatgatgatacctttaaagcaatgagctggaccccaaaaa

SEQ ID NO: 126749 - DNA, 480 bp, Homo sapiens
ctctgtccttgtgccaacatgttagttgcagtctatctgtgagcttcacagtcccattgactcttgtacagaaatcagcaagcagtggtcttcagtcaaactgggacctcaacaatcgactttggtcctgtcagggttcctttcccttactcttcttaagagcacccagagtcaccatgaaagaaccacaagtggaaaaggaatacgtgggctcagacgtgtgtccatccttgcatgacccttggctcctcatctgttcatgggtttaaaggtcatccttcctgccctgcctaccttattgagtattcacaacagaaaatgaatgtaggagattgaaaattgtataatgcactctaagttattattacctctcccaaattgtcagcatttcatccttgctatctagcagcagaatagtgtagggtaggagtttacaaactacagcccacaggccaaagccagcccaaggccagattttct

SEQ ID NO: 126750 - DNA, 741 bp, Homo sapiens
gcttcaaggcaaagaggaatgctgggactgggaagaggcaggacatggcatccctcagttcttggcattaccctcacaacctctgttaatcaggatgggtgaagttatgtagcagtaacaaataatgtcaaaatctcaatggctaaaacacagaattttctttcttacactgtacgtgcacgatgggggaaaggggttctgcccatcatagtcactcttggactataggtgttggagcagccaccaaccaggacattgccagccgctgtaccagagagaaaagcgagtcctcaagtggctagcattaacaaataaattcttagccagagagagacacacattacttcagctcacaactcactggcttgagctaaccagaagtcccagccacctacaaggaggccaggatgtgcagtcctaccttaggcccagtagacagagagccgcaggcattcagtgagtagcccacaaggaggctttcatctgctggggtcatgatggattcgtatcctccccctctagttgggaaactaaagcaccagttacagaaacctgaaatatatcgattttccattcatttaacaaatatttattaagcactgctgtgagtaaggccatgctggtggttgtagatacaatggtgaccagatacagtccttccttcaaagagctcccagtctaatggagaagagaacaaacctatacagtgtgacaagagcttcaacagggagaaacccagga

SEQ ID NO: 126751 - DNA, 389 bp, Homo sapiens
actgcttttatattataaattaattgttaaactagaataaatgccactgtgaccacatcaaactaaagagctaggtaaaaaggaaataggcacaagaacagctgctttacatcttcctattaaagttgacatctttacatgttccagggataactctgatctagaatcagatcttctttttataggaattccattgttcgtgaatcaactatgtagtagatgtcaccatgtacttggtattagcaataagccttagaaacctttgtactttctactctgttccctggctccaaaaataaagagtttgaaatgtagctgaacaccatggttcaggaatatatgtctaaaacaacattatcacttgaaatcatttaactagaagcattaaa

SEQ ID NO: 126752 - DNA, 273 bp, Homo sapiens
cttagctctctcttagacttggcactttagagtgacattgataaatgcttagcaaagtttctaaatctctgtgctttagtttactcacttgtcaaatggggcttttaacaggacttacctcctagggtggttcctcatgaatctcatgggaagattaagaatggtaatatacataaatcattacaacagtgcccgggcagagtaaatggtcatttttgtagtacaataattgtgtactgttttttttttttataaacctgttgacttctaaag

SEQ ID NO: 126753 - DNA, 791 bp, Homo sapiens
tgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtataaaataacactctgtgctttaaattgaggttttatgtcattttagcagaattataatatttctgatatactcatgtttgacaagttgaaacagatttgtttcttaaaggaaggtttaatatacaaaaaaaggtaatcttaaacttacgaaaaagtaaattttacaatttgagcattactagatgtttagt

SEQ ID NO: 126754 - DNA, 602 bp, Homo sapiens
tgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtata

SEQ ID NO: 126755 - DNA, 251 bp, Homo sapiens
tgcagcagggcctcatctgggctctgagagcgcaggaagccagagcctcctctaatgcggacagaactacagaacggctctggggaccgcagcagggactgggaaagagggtccaggcagaggagcctagaggagcctgcgcagccacagggcccaggcaaggctggagacactactagccagcactccactccccaccactccctacaacttgggggccccgttatcgcagccccaactgggactgggct

SEQ ID NO: 126756 - DNA, 326 bp, Homo sapiens
gttgctatgaactgagatcgtgccactgcactccagcctggatggcagggcgagattccatctcaaaaaaaataaaataaatgaaataaaatcaatccatggacataaaaattgtcagacccatggttaggttcatgaggcagcacaaccaggagcttatatttgccaacaacagccaggcccactggcaatctggtgtcatgaggggacttgttcagtgggactgttccaaggagctaagtaagtggttaacaaggtcttgctctgtcacccaggctgcagtgcaggggcacaaccataactgactgcatccttgaactcttggg

SEQ ID NO: 126757 - DNA, 266 bp, Homo sapiens
attttccatcaagtactgttactccaagccctgttaaaaattctcagccctgttaagaattcagctctgttaagttgcgtgagccaccgcgcctggccgattttaattatttttaatgtgcttgtttcctcctcatgtgaagtctctccctcctttctgttctgccccttcctttttccttacctgacctgggacagcttctgcagaaaggtatgatcactatagataatgctttggggaaaggctttctttttaagatgtcttag

SEQ ID NO: 126758 - DNA, 724 bp, Homo sapiens
gggttgctactggcatctcgtgggtagaagccagaaatgctgtgcgtcctaccatgcacaggacagccacgctccccaacaaacaactatcaggcccaaatgtcagtagtgccaagactgagaaaccccgacttagaaatagaaatcaatttaccgtgaattgtttttagtagaaaagatcccttagagtacaaaaaaatacaggttgatgcttgcagtaaatatcattgtagtgatctattggaaatggtatgagggtgtttccaaacaatgccaggcagtactttctaccaaagctgtgctgtgaggtatagcaaagtctattaaatggcaagtccagtgttagaagtttgttaattaattctcacccatgaaagcagctattaggatatcattgtttagatgtaaatgttcttcacccaaacgaacttcaccaaaatgttcttaagttgctatggcagtatatttgaggagttatgttttaatttgcttcaggggagaactggaagaccatggtatttcgtctgagatcatattctaaatcagggtttcccaacctcacactcttgacattttagactgaataattctttttggggggtggggagggtgtttcttttgtgcattctaggatacttaacagcatacctggtatctacccactagatgccagtggtacattccttctggactcccgattaattatcccaagtgggacaattta

SEQ ID NO: 126759 - DNA, 278 bp, Homo sapiens
gccaaatcacaacatgcagaccggtattaacccgggctaccttaacaaagcttcctccagcccagacagaagattatgtgtctcaaatagatgcgtcccccttctccccttctctgccggcacccccatccccaggggtgccccctctctcccctccttccacagaagcatctggagcctgcagggcgccctgctccgccctcatccctcccctgcaggccccgccccgcttccctacacagtcttcccacaggcagcctgggggccggggtgattct

SEQ ID NO: 126760 - DNA, 121 bp, Homo sapiens
agaggtgggctcaagtgatcctcccgcttcagcccctcagtggctggtactacagatgtgaaccaggtcatttaccagtgtcttttttttttttcttggcagcatccctccttagactcat

SEQ ID NO: 126761 - DNA, 709 bp, Homo sapiens
ttttggcagttataatcaaggaagagaaaatgaaagataatacatttagagtattaatgatgataaaagagacacaactctagattatatcaagcagatttttaaaattataaggcaaaactaggccgggcacagtggctcacacctgtaaccccagcactttgggaggccgaggtgggtggatcacttgaagtcaggagttcgagaccagcctgaccaacatagcaaaaccccatctctactaaaaatacaaaaattagcctgtcatggtggcgggcacctgtaatctaagctactggggagcctgaggcaggagaattgcttgaacccaggaggcagaggttgcggtgaaccaagatcacgccactgcactccagcctgggtgacagagtgagaacctgtctcaaaaataataaacataatatggtaaaactatacatgcacacatgcacaaacgtgtatattcattccagtacaagtaaaaatgtaggattgcatttttcccccaaaaggaatatgttttacaattaactcaccgtataacccaaatagattaacaaaaaatgtgtgtgtgtgtgtgtgtgtgtgaactccctgtttaaaaaatctgatacttataaaaactttaaggaatagataatcctaaagattttaccaattaattctgcaaggtaaaataatcctaataaaaattagatgaagatagttt

SEQ ID NO: 126762 - DNA, 650 bp, Homo sapiens
aaagctccacagaagtaagccattatgtgagttctaagccactttgaataaaccaacacaactcctttcaaaaaagcaccgggagaaggtcattcatgtgaataataaccattctttctctttaatcattaaaataaataaattcaaattacatctccagagagcacccatccccccatcaatttctgctcttgagtttaatagaaaaatggctcctgaaaaattctcctgtgaagtgaggctggtgtggaagacgccaacacagtgctctcattcagaacactctcgaatgcagactgaatcaggccctagacagagggctacgtgtgtgcctatgcgtgttggtcttggatgtgcgaactgtctaaccctgctctgagttttcctaggaaaaggaaaaatgtcctgaacctcgactcttccccaggctgaaaatctccaacattttccagcccggcttcaaacctgacagaaaaagacaaggggagacaggtattaagaaaacggagagctcgtttggatttttgcttcacttctgattctgtcccaaaaattacttttggaaaagaaaaggtaaaaagaggcaaaacaaaaacaaaagtaaaagagacatcgtgttctttccctgtgacccccccaaatccaaacct

SEQ ID NO: 126763 - DNA, 358 bp, Homo sapiens
agagagtaaggtgtggttgggacctacagcaaaacctggtgcaaaaagcaaatgacgctcaaacttcagtgtgcagcagtcatatcaggagcttgttaaaaattagacacctaacgctgagattctgagtcagctaaatctgggagatggcctagacatctgcatttgtaattagcacagcccaccccttacctctacgtaggcagtcttccaccttcagctttcagaaacacatagaacggtgacgatgcggttatctgtggaggagaaaaagctctcgctctctctcacacacacacacacacacacacacacaccaccatttcagcaggcacactaccccagcataacattcacc

SEQ ID NO: 126764 - DNA, 193 bp, Homo sapiens
ggtctgtgctgaggaggattagtaaaagaggaaggcacgcctctttgcagttgagacaagaggaaggcatctgtctcctgcccgtccctgggcaatggaatgtctcggtgttctgttaaaaaatgtgtctatctttggttgcacttaagatgttctatttatcactgattttgagcaattttattaggatgtg

SEQ ID NO: 126765 - DNA, 554 bp, Homo sapiens
gacatacaccagggccttttggggggttgggggtgaggggagtgaacttagaggataggtcaataggtgcagcaaaccaccttggcacacatattcctatgtaacaaacctgcactttctctacatgtatcacttttttttaagaagaaaaaaaaagtggggagggttacaagtcaagaatgtagctcctgaatggaagacagggcaaggatggtgtgatgtcacagtgaaggagcagcagggggacaacaatggaaaacaaaaatctggccaagatagtttgactggtgtatgccaaaggttttccccaccttttattgaaaaggaaattgtaaaagtgttgtttcttgaacagctaaataattatcataatcacataatgcatggcaatagttgctaagggtttggtcacttgcaactagtcctttcattacctttaaaaagtccgaggattaaagaacacttcctggctatgccatatggaggacttgatgaacctctctaatttgatgatcactcgaacccagattctggtgcttaccctgggaaaataa

SEQ ID NO: 126766 - DNA, 254 bp, Homo sapiens
gtcaaattaatgtagtatacaattttcttaataaacttttcctttcctaccctctttcgccccattttgaactttaaagaaaaatttgcctttttgctgcttcctaaacaatctatgactgctacaatagtcaatattttcccacttagtttgcttatggatgtgagggttaaatgttatgaacataatttagtgcttacaacatcagcaaatctggcttcttccttgagctgatacacagtgaggttaaggtc

SEQ ID NO: 126767 - DNA, 299 bp, Homo sapiens
agcagtaaggggtggctccagggctgtaccaacacagcagtaagggagggtccaaggctgaagggatcacttggtgactgggacgagtgacctaaacgtgtttagtcagacaggtgtgaagtggcctgttctgacctcagctagcagaacagctctgaccagcagcctctgttcccacatttgaaattcattcacagacggggacatagcacaggacacagaggagccccaggagccgagcttctgacacacccctttcatctccagagctagtgaggccatctgcacatgtgaactgg

SEQ ID NO: 126768 - DNA, 825 bp, Homo sapiens
cattttagcatggtttttttgttgttgctaaaaagccttaccagagagatttagcatgcttttagttctaaatttctaatatacaactgtttcagatcactgttagctaaatattaggtatactgtatcataatttcattatgttggagaaaacctcaattgctttaatatttggaatataggtatttcaaatgtttatttttgcttcacagtttgcagaactatggttagaattttaacattccatttggtgatcatggcctatctcccgtgtttcctatagctgtgattagaagttttattataattcttattgcttatatacaaataaatataaattaataatgtttacctttgcaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattggtaatttttttttttactagattttatcactggagactaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacctatctacttacctcttagattcaacaatgaacattttatta

SEQ ID NO: 126769 - DNA, 422 bp, Homo sapiens
caaggggacctcatgaaaggtctctatgaggaggtgacacttcactcttagtaaaacttgaaatgtctcattttgcactctgaggctcccaacaggtccaaaggcaagggtggcataactttcatgaagaggggctctcttacctcagtcagcgctctgggacaaggacatgcctcgagtgactgcctcagtgagcaagtggccccatctgatgcaccctgttagtgacctggcagcagcagcaacaaagtcgaaagccagcagccccaggaagtacttggaccccctgctgggaggcctgtaggttggtgtggcctgcctgaagggcagcttggaaatacctgccaaaggcgtaaaatgcatatgccccctgacccagcaaatcccaccacgtggaatctactctataaaactccagcatg

SEQ ID NO: 126770 - DNA, 643 bp, Homo sapiens
catttagtataaaatataatttagaaggaacatttgttttacatatgtgttatagtatgttttgtaaatgctgtaccctttcctaaaaccccagactggcttcctggtgtttgcttcagtagttctatatgaatagcaaaatctaagggattaggtctggcaaccaaacacttctgcaaacaaaaggaaggtaaactgatcatttataatgataaattctcctttacctttgtgatttgagctattctgcagacaattcccaaaggatgtgatttacagttttcactctgagagatgttgcagtcttgctgactaacacccttttaattaaagatcactttccatttcttgcagctcttacatctaggctatttaaaatcattttatagtgtaaattcactttttgctactactaccattttattttcagaaaagttacacaatgtggtattacagaaacaaaataatctttgtagacagacataatttggttctttctctcccttcccccacctccccaaaaacaactcttttcttcaccttaatttttgtcattttcatgagaaattgatcttttgtatggactaaagataactaggtacctctgaagtaaatgaattatttctgtttaaaatatgctagc

SEQ ID NO: 126771 - DNA, 398 bp, Homo sapiens
ctcaaaataacagcctggctcctaacaggagggaagatgaagcagactgccgggagatctctgccagcaaactcttctcttcccactcatgttaggcccagtgttgtccctgaaacatctaacattactaatctctaatccagggctgtccctggaatgtgagccacatgtatcactacataggcaattttaaattatcttgtaggcacattaaaaatagataggtaaggctgggtgcagtggctcacacatgtaatcccagcactttcagaagctaaggtgggcagatcacttgaggtcaggagttcgagaccagcctggtcaacatggtgaaaccccgtctctactaaaaacacaaagattagccgggtgtggtggcacacgcctgtagtctcagc

SEQ ID NO: 126772 - DNA, 749 bp, Homo sapiens
agacaaagacataaccaaaaaagaaaactacaggccaatgtccttgatgaatatagttccaaaatcctcaacaaaatatgagcaaatatgatttaacaacacattaaaaagatcattcaccatgaaccagtgggattcatcctaggaatgcaagtgatgaatgcaacatgtgccaatcaataaacatgatgcattacgttaatagaagcaagaacaaaaatcatactctcatctcaatagatgctgaaagcattcaataaaattcaacattcctttacgattaaaacccttcaacaaaatgggtatagaagggaaatacctaaaaatgatacaaggctatatatgacaaacccatgatgaacattggactgaacagggtaaaaaacaaaagtctttcctcaaagatgaagaacaagacaaggatggccactttcatcagttttattcaatatgatactggaagccctggccagagcaattaaacaagagaaagaaagaaaaggcatacaaattgaaaaggaaggagtcagattggcttttaactcagataacaaaatgtaatacttagaaataccttccaccaaaaatactgttaaatatgataagcaaattcagtaaagttcaggatacaaaatgaacatccagaaatcagtaccatttatatacatcaacagcaaacaatctgaacaagaaatcagaaaagcaatcccatttgcaatagctacaaagaaaataaaatatttatgaac

SEQ ID NO: 126773 - DNA, 425 bp, Homo sapiens
aatggcagcaggagctggagcgaggagcagtgagaaatctgacttaggagaggtcctcatggggagaggatttcagggtgacttccttcagtcccttgggaagacttgcctgcacagcctagagccacgtatgcggaccttcttcatgacaggccacatgtaggacacgcaaacacctgtgcagccccctggctaactgggtgaggcagctcgaggctggaggtgagcaccccggggccaagggcaagagcatctcagcatacctgttactctggcctgggagaggaaggatgagacgcactcatgggtaccccttagtttatgtcttcttgtaaaactgtttctcagaactgctatacccctgacactgtttaagcttctgaagtattgaaatatgatgtaaataaatgcctacaaaaccaagt

SEQ ID NO: 126774 - DNA, 389 bp, Homo sapiens
cctggagagccttatggagtgcacctttcaggttggagatggtctgatctctctctgtccatgtacttgtgcgtatacattcccaaatatttatttcactaggtagcttctcttccaactcccgctacaggccttagggtttcttgggagattgctttctgcgcttatggggcagagatgtggggtggaagttggtgacaaggagacatctattccctaccaatattagggcacgtgaaccaaggcccatgtgtccctcacacgtggggatgagagaccttgccagtggctctggccaggcctgatgcggctcagacgtggccctttgctcccacagctagaggaaaatcctgtcaaaatgccttaacgatcttctaatatttccatgc

SEQ ID NO: 126775 - DNA, 235 bp, Homo sapiens
gccccaatccccgacaggcacacatcatcctagggcagggcccttccttgtgggaaccatccatgcccagctgagggcctggggaggacgagtgctgggtgggggagccctccctctctctgcacacccctgggagcccacttctgtgtatcatggcatacgtggcatgtgctgtggtctctgccatcagcatctaaacaggctcagcctctgctagcctcatgtacaaaccaca

SEQ ID NO: 126776 - DNA, 379 bp, Homo sapiens
gccaacacccggattgcagccttgtgagactctatgcagaggacccctcaactgggcctggattcctgactgacaaaaactgtgagatatttatattattttaagtcactaagtttgtgatcatttgttacgcagcagtactaatcaattgcactgccaccacaccacttctcagcttcactcactgccacctggccacaaagacctccatgtgctttctaaagtaagccaagaacagcacactccgtccttaggccttcacacttgctgttcccacttctggcatgttcttccttttcctagatatctgcagagctctgggcttcatttctttcatttcttctatgttccctcctcaaagagggcttccctaagctct

SEQ ID NO: 126777 - DNA, 584 bp, Homo sapiens
agccttgtgtctgactgaatagctataaattggggttcccatgatccgctccttgggttcgattaattttctagagtggctcacagaactcacagaaatacttacatttatccacttattataaaggatattacagagaatacagatgaacagctagatgaacagacaagatgcataacacaaggcgtggagaaggggcatggagttttcatgccttctccagctatgccacgctctgggaacctgcatgtgttaatgttatccagaagcccacaaaacagtcctttagaatttttatggaaacttgtttacttaggaatgattgattaaatcattggccattggtttatcgactcaaccttcagctcctctccccttcctagaggttggagtaggaccgaaagtttcaaccctctaattatgattacaaacagaaaggaatagtaccaacatcaaagaccaaaggtagataagtccatgaagatggggagaaaccagcgcaaaaagtctgaaaattccaaaaaccagaacacctcttctcctccaaaggatcacaactcctcaccagcaaggcaacaaaactg

SEQ ID NO: 126778 - DNA, 506 bp, Homo sapiens
caggagtatgtgacattagaacagggtgaggaaagaaggtcctcctcagacagaccctgccttgtggacaggacaggcacctcagggccaaatagctcccatggcctcagtcccaggagagcaaaagcgttcagagtttcaaaatgggctgccatgtgatccaagtgtgggttctcacttgagaagatgcattccacctacatcaaggacaagactggtactcctgggcacaaagccacctggcctgccttttccctctagctctccctcaagtatttctggctgctggccctgcagggggtggcaagtgagggggcagaaagaggagctattacagggctgtgattagctcttgggtcccctgagagctggggacatttgcaaataatgttacaaacgtataccctaggactccttggatcttgcctcctcacctccacaagaggagggctctgtggtgccaccagttgcattggcctttttttttttttttgagacggagtctc

SEQ ID NO: 126779 - DNA, 602 bp, Homo sapiens
gcacaccccacagtatggtattgtgtggggactctcagcttgatggatgctgatttttctggttctaaaaaatgttatttattgatctatctattttaatttacacctatgcagttatttatttactctggtgaatagagaacacattcttgacacggggaaggaatacactcctttaagcttctcctagcaccactgtgaaaacttctagactttttttcctcccaaatcctatgaacatgttagcgagttcctctctgccttctactcagaactcaaaatacagtttctctaatctgaaggtaggaccaaaccccatatataaaattaccagagtaatatttgtaaagacagtttcaaaagaagaaaaggcttaattgtaacttgtaaatgatggttcatgaaggaatgtagataatttataagactggtttgatttcgttggtagaaatattttcaacagcgtgtggctgaaaagttagaaaatttctatcagtcatgctttttagcaaagcatctttttactgcttttagagtcatgcacaagaaaacatgcagcttactagctataaaatactattgctccattttaactctctctt

SEQ ID NO: 126780 - DNA, 582 bp, Homo sapiens
aggttttctttctctggggctggtttttcaagagaagactcccttgtctttgcctgaggagtggagggtggtgtggtgtttgtctgctgccctcctgtgaggagcagcagaagtggggggcctgaagcttctgaggtttgccactcaggttctctcttcacttttttggggggtctcctttccccaccccttccccctctgaccctggtgttctcaagtctagacttctcttgtttaatgtatccagtgggggagggaaggggccgtaggtgtctagctgttgcacttgcagccttcagccagtccccccacatctgagttcccaccttcccctttcatgcaaggtgcctgccacctcctacgacctcctgagccttctgatatcctgggtgaagggaggttttcccctctgcagtcctcatgttgtggcatctttcagtctgtgaaatctgttcatacttttgccccctccttgccaaaactgtccctgttgtttgggttcttcgctgttttcattttcgggggttggaaggatgagctgtacaagccctcagtctttctgccatgtttaaccagaagccc

SEQ ID NO: 126781 - DNA, 133 bp, Homo sapiens
gggacactgctcgctcaggagggttctgtccgttatgaacgtgtgttagtgcagctgcctcggcagtcctctgtcatcttcctgcgagggtctgaattgaaactcacaagttaccagggtctgaggagcttgt

SEQ ID NO: 126782 - DNA, 318 bp, Homo sapiens
caggttgcagtgagccgagatcgcaatgggccactgaactccagcctgggacggagagcgagacactgtctcaaaaacaaaacaaaacaaaaagtgctggcaaggacatggagaaattggaagccttgtgtattgctagtgggaatataaaatagtgcagccactgtggaaaacagtatggtgcttccttaaaaaattaaacatagaattaccatgtgattcaggaaatccacttctgtgcatctacccaaaagaactgaaagcaaggacgtgagcaggtatttcttcacccatgttcaccgaagcattattcataat

SEQ ID NO: 126783 - DNA, 302 bp, Homo sapiens
cctctatctccactgtccatgtccaccatccatcaccaccctctatctccactgtccatgtccactgtccatcactaccctctatctccactgttcatcaccaccctctatctccactgtccatcaccaccctctatctccactgtccatcaccaccctctatctccactgtccatcaccaccctttatctccactgtccatgtccactgtccatcaccaccctctatctccactgtccatcactaccctctgtctccactatccatgtccactgtccatcaccaccctctatctccactgt

SEQ ID NO: 126784 - DNA, 501 bp, Homo sapiens
cttttggggtctttgctaggctttgggttaggctgctgaactccagttctgccaaacagtgatgcaggcaggattcagaagtcaaacctgaatgctttgggctgaagtttgctgtgaaacttccaggacaaagaccccaaacaatatgatcttttgaacaaactaagaaattcaaactgagtggtgttagatttttaaaatacacctgatttggaagttgatcccatagatggttatcacaaagtcatcccatcacaattttaacttcagtgcagtggcattttactagtttttgaggcagagtgaaaggaaagacaccatgtctgtattagaaaaaaagtaggtcttggccaggcgtggtggctcacgcctgtgatcccagccctttgggaggccgaggcagaagaattgcttgaacccaggaggcagaggttgcggtgagcaaagaacatgccatttcactccagcctgggcaacaagagtgaaactccgtctcaaaga

SEQ ID NO: 126785 - DNA, 379 bp, Homo sapiens
ctacataaatacgttggtaggtatgtgggtgtgtggttgagaaaactcaagcctgagcattctcttctggaaccagagacaagctcagaatctgctgggaataagcatggagatgaggaaaataagtctaaggagaaacaaagaggcttggaatggaccaggggcatgtgggaatacaaatggtacgtgcttttgttcagagttgctcagcagctctaggaggatttggtctggcatcgggtggggggtacattcagtcggaaagggagaacagcaaggacattaaggctatatggagatgcagatgaagtggtccaagggactaggctggatacaaaggtagaaaagctaaaaagagaagtcagagagcctgggatat

SEQ ID NO: 126786 - DNA, 642 bp, Homo sapiens
cttgaaaattgtatttgagttagcagttatatgtttttttgctgtgtgtttaaagaacacatgttgagtgttttctaacttcttatccaacaagcatggcccttgtgccaagctcataatgatagtcctatgggatttgaacccttcagcattgcgtaatcataacagctcatgtaaattagtatagtttttagagcacagattgaagtcagatcgaatttgattcaaatctcattttgtaacttttcttagaatgctaattaagcattcacattggctacctaacctgtttaagctttaccttctcattcataaaatgggaattaataataatgcctattcagagagacattgtaaggattaaaagagatcatctatacaaacttgtctctgtggtggctggtacataagcacttaataaatatctattacatgatattcattattctaaagatattcttactacccacagcatcttttgtacaaaatacagtttattgctatgatctgcagtataggctaatgtattctttaattaattgtcaacctgtatttaatgaatatctattccatctaagatccacatggagctagatttttgagtaattagggaaagaactggaaatggatcttatgaaaaag

SEQ ID NO: 126787 - DNA, 5973 bp, Homo sapiens
  misc_feature (4023)..(4023): n is a, c, g, or t
  misc_feature (4061)..(4061): n is a, c, g, or t
  misc_feature (4091)..(4092): n is a, c, g, or t
  misc_feature (4121)..(4121): n is a, c, g, or t
  misc_feature (4153)..(4153): n is a, c, g, or t
  misc_feature (4197)..(4197): n is a, c, g, or t
  misc_feature (4227)..(4227): n is a, c, g, or t
  misc_feature (4644)..(4644): n is a, c, g, or t
  misc_feature (4791)..(4791): n is a, c, g, or t
  misc_feature (5196)..(5196): n is a, c, g, or t
  misc_feature (5199)..(5199): n is a, c, g, or t
  misc_feature (5237)..(5237): n is a, c, g, or t
  misc_feature (5260)..(5260): n is a, c, g, or t
  misc_feature (5293)..(5293): n is a, c, g, or t
  misc_feature (5557)..(5557): n is a, c, g, or t
gagcgtcttttgccacgaacacctgcggcgtgccgaagttcctcttctctgccccggttccgggcggtccgctgggaggtggcgcccggagggacacccgtgcctggggtcggggccagtgctcttctcggagctccagaagttctgctgagaagcgcggcggcagcaagacgacttctccggagccgccgagctggagttagaggtggagctccgtggggccgggcccccggctgcggggcagcggctcctgcaggcggaggccccggcggagaatgagccggagccggaggtggtggtggtctcctggcagagcggtgggaccgggagcaagctgcggtggttcaccaccttgatgctgtgtgcctccttcctggggctgggattgagtgttgctatagtgggacccacgtttcaagatttggcaacaaacgtgaaccgaaatatcagtagtctgtctttcatttttgtgggtcgtgccttgggatatttgagtggctctgtgattggtggatttcttgtcgatgtcatgaattattttttacttttgggaatctcaatgtcggctaccaccgttggtctttatcttgttcctttttgcaagacagcaatattactcactgtcatgatgtctatcttcggtgtttcaattggcattctggatacaggtggtaacgtccttatcttggctatttggggggacaaaggagccccacatatgcaggccttacacttctcttttgccttgggtgcctttttggctccactgctagctaaactggctttgggtccgacagcgtctgctgaaaaccacacagagtctgacttccatcctgcactcaaccaatcatctgatgctgactcagaagctctgtttggagtacctaatgataagaatttactgtgggcttatgctgttatcggtacttacatgttcttagtttctgtcatttttttttgtctgtttttaaagaatagctcaaagcaagaaaaagcaagagcatctgctgagacatttcgaagagcaaaatatcacaacgcccttctttgtctcctttttctgttcttctttttttatgttggagctgaggtaacatatggctcttatgttttctcatttgcaaccacccatgctggcatgaaagaaagtgaagctgctgggttgaactccatcttctgggggacatttgcagcctgaggggctggcaatcttttttgctacctgtttacaggcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggtgcagtggctaaagcctgtaatcccagcactttgggaggccgagacgggcagatcacgaggtcaggagatcgagaccatcctggctaacacagtgaaaccctgtctctactaaaaatacaaaaaattagccaggcgtggtggcaggcacctgtagtcccagctacttgggaggctgaggcaggagaatggcgtgaacccgggaggtggagcttgcagtgagccgagatcatgccacaccgtactccagcctgggcgacatctagactccgtctcaaaaaagaaatggagaggtatttttattaattgctttaccttatctgtagggttggatcaaagaatgtaatgactcatttgatttctaatttcaatgaagagaacacagaacagggcccaaggggtcgggcttcaagccttgacttcttctagccctgcactctgtcacttaacgtaggccttgtttatctcgcctcctgatctgtgattctagaaatgaaaatgagatgatttccaaattgggaatctgtaagttttaaagtttgtgcaaaatgtctgctagaaattagtacaagtgacagcatgttcttcatttcaaatgagaagtgaaaccaaaatgataaatagctttaagaatgtgctaatgataaatgattacatgtcaatttaatgtacttaatgtttaataccttatttgaataattacctgaagaatatattttttagtactgcatttcattgattctaagttgcactttttacccccatactgttaacatatctgaaatcagaatgtgtcttacaatcagtgatcgtttaacattgtgacaaagtttaatggacagttttttcccatatgtatatataaaataatgtgttttacaatcagtggcttagattcagtgaaatacagtaattcattcaattatgatagtatctttacagacattttaaaaataagttatttttatatgctaatattctatgttcaagtggaatttggagacactatgttctaattttaagaactgtttcagtgttattagattagtagtagggctgtagatggggtctttcgaggtcctttgcctacctcagtaacagaggctgggtctgagccttgctcgagattagctcttcaccaggtctgtgtggtaatcatatcgtagttaccgtaggtcacgctgcaagtgtaatttacagtgaggcatagtcttttccagtgattggaatacttgtgtcaccgatccagggtttctctttcctgagtctgaaatacctgggaaaccagttagaaggtgactgggtagcctaggagtcaaggatcagaaagggtacttcatatatatatggcagaattggtgcaggtgatcctttgaaaaatgacaagaattgatgaaattttgtttacttcctccaattttttgctgaataacatctcctttctacctgattggagtaggcttgctttctcttacttaatttctataaatttgccattgttttgtctcaagtaaaatacagtgtctttcttgaccactgcccgcccattcaccttatatgcctgccacagtcttggttcatgtaataacctaacagctttggagatggcggtggagaagttaatggtaaaaaccttcttgctctttttatttttatttatttattaggggtgggggatggtgtctcnctctgtcactcaggctggagtgcaatgacgtgatctcngctcactgcaacctctgcctccctggttcnngcgattcttctgcctcggcctcctgagtngctgggattacaggcatgcgccaccatgcccngctaatttttgtgtttttagtagagagggggtttcatcatgttncctaggctgatctcaaactcctgatctcangtgatctgcccacctcagcctcccaaagtgttgagattacaggcatgagccactgtgcccagcccttttgctctttttatagtgtaaatttccctcagttagaacttggaaattacttctgcttcacttactgccttttctcaggttgttggaatctaggcagtagcagttacttggcagctaggaggcttgctagaataggaattccaccttcagcatttactgttacagggtagaagatgcagctcagggagagaaggatgatgataagaacatggcagaaaatctcaaaatctactctggaaaattcactatgtttccacacaccaacatgtgaatcgtcatgagatcatagggcattgttaaagttccatattggaaggaaaagacttagtacaattctaagaattagcattnatcctgctgatcagttcttagctaagtgtctgctgatacctaagtaaccaatatacccaagtgttctattgctgggtaacacagtaccacacattgaacaccttaaaacaatagacatttggtaatgtctgtacaggctgtactgangcggcctgtacagggccgcttcagtacaggaccttacctatgtagactgaggtacgtgtttcttgctgactgtcagctgggcaccactcagcttcgagaggcctcccacagttcttgccatgtggccttctcacagatgcctctcacaacatggcagtttcttcaaagcaagcaggagaatctctaaatgagtcttgtatgacattacgtcattatgggaataacatcccatcacctttgccatattctagcgtctagaagcaaggtatgagttccaacaaaactcaagggtagaggctagaacagggatgtgactcattgcggatcaccttagagcatgcctgccacactcgggtacctgcagaatagagattctcaaaagttctaaaaactgagctaagagcnggncatgatggctcacacctgtaatcccagctactcaggangctggggtggaagtatctcctgnggtcaggagtttgagaccagcctgggcaatatngtgagacctctgtctctaaaaaatttttaaaagagaccccttctctaaaaaacaggaaggctgggcgcggtggctcacacctgtaatcccagcactttgggaggccgaggtgggcggatcacaaggtcaggagatcaagaccatcctggctaacacggtgaaaccccatctctactaaaaatacaaaaaattagccgggcgggcgtggtggcgggtgcctgtagtcccagctactcgggaggctgaggcaggagaatggcgtgnacccaggaggcggagcttgcagtgagccgagatggtgccactgcactccagcctgggtgacagagcgagactgtctcaaaaaaaaaaaacaaaaatattcaactatgagctggggaaaaaagcttcagcggtcactgaaagtgcttacaggtacagctagtatggggatggaatatgccccattagccaggccaacagatctcatataggagaatctgttttatgtttgttggacagtgggtgagttatcgcagagttatgccttttttttctgtcactattttatgtcccttatcactgtgcctttaacctactgaaatgcagttgaggccgggtgcggtggctcacgccaagatggcgccactacactccagcctgggcaacagagggagactccatctcaaaaaaaaaaaaaa

SEQ ID NO: 126788 - DNA, 3849 bp, Homo sapiens
gagcgtcttttgccacgaacacctgcggcgtgccgaagttcctcttctctgccccggttccgggcggtccgctgggaggtggcgcccggagggacacccgtgcctggggtcggggccagtgctcttctcggagctccagaagttctgctgagaagcgcggcggcagcaagacgacttctccggagccgccgagctggagttagaggtggagctccgtggggccgggcccccggctgcggggcagcggctcctgcaggcggaggccccggcggagaatgagccggagccggaggtggtggtggtctcctggcagagcggtgggaccgggagcaagctgcggtggttcaccaccttgatgctgtgtgcctccttcctggggctgggattgagtgttgctatagtgggacccacgtttcaagatttggcaacaaacgtgaaccgaaatatcagtagtctgtctttcatttttgtgggtcgtgccttgggatatttgagtggctctgtgattggtggatttcttgtcgatgtcatgaattattttttacttttgggaatctcaatgtcggctaccaccgttggtctttatcttgttcctttttgcaagacagcaatattactcactgtcatgatgtctatcttcggtgtttcaattggcattctggatacaggtggtaacgtccttatcttggctatttggggggacaaaggagccccacatatgcaggccttacacttctcttttgccttgggtgcctttttggctccactgctagctaaactggctttgggtccgacagcgtctgctgaaaaccacacagagtctgacttccatcctgcactcaaccaatcatctgatgctgactcagaagctctgtttggagtacctaatgataagaatttactgtgggcttatgctgttatcggtacttacatgttcttagtttctgtcatttttttttgtctgtttttaaagaatagctcaaagcaagaaaaagcaagagcatctgctgagacatttcgaagagcaaaatatcacaacgcccttctttgtctcctttttctgttcttctttttttatgttggagctgaggtaacatatggctcttatgttttctcatttgcaaccacccatgctggcatgaaagaaagtgaagctgctgggttgaactccatcttctgggggacatttgcagcctgaggggctggcaatcttttttgctacctgtttacaggcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggtgcagtggctaaagcctgtaatcccagcactttgggaggccgagacgggcagatcacgaggtcaggagatcgagaccatcctggctaacacagtgaaaccctgtctctactaaaaatacaaaaaattagccaggcgtggtggcaggcacctgtagtcccagctacttgggaggctgaggcaggagaatggcgtgaacccgggaggtggagcttgcagtgagccgagatcatgccacaccgtactccagcctgggcgacatctagactccgtctcaaaaaagaaatggagaggtatttttattaattgctttaccttatctgtagggttggatcaaagaatgtaatgactcatttgatttctaatttcaatgaagagaacacagaacagggcccaaggggtcgggcttcaagccttgacttcttctagccctgcactctgtcacttaacgtaggccttgtttatctcgcctcctgatctgtgattctagaaatgaaaatgagatgatttccaaattgggaatctgtaagttttaaagtttgtgcaaaatgtctgctagaaattagtacaagtgacagcatgttcttcatttcaaatgagaagtgaaaccaaaatgataaatagctttaagaatgtgctaatgataaatgattacatgtcaatttaatgtacttaatgtttaataccttatttgaataattacctgaagaatatattttttagtactgcatttcattgattctaagttgcactttttacccccatactgttaacatatctgaaatcagaatgtgtcttacaatcagtgatcgtttaacattgtgacaaagtttaatggacagttttttcccatatgtatatataaaataatgtgttttacaatcagtggcttagattcagtgaaatacagtaattcattcaattatgatagtatctttacagacattttaaaaataagttatttttatatgctaatattctatgttcaagtggaatttggagacactatgttctaattttaagaactgtttcagtgttattagattagtagtagggctgtagatggggtctttcgaggtcctttgcctacctcagtaacagaggctgggtctgagccttgctcgagattagctcttcaccaggtctgtgtggtaatcatatcgtagttaccgtaggtcacgctgcaagtgtaatttacagtgaggcatagtcttttccagtgattggaatacttgtgtcaccgatccagggtttctctttcctgagtctgaaatacctgggaaaccagttagaaggtgactgggtagcctaggagtcaaggatcagaaagggtacttcatatatatatggcagaattggtgcaggtgatcctttgaaaaatgacaagaattgatgaaattttgtttacttcctccaattttttgctgaataacatctcctttctacctgattggagtaggcttgctttctcttacttaatttctataaatttgccattgttttgtctcaagta

SEQ ID NO: 126789 - DNA, 4359 bp, Homo sapiens
  misc_feature (2409)..(2409): n is a, c, g, or t
  misc_feature (2447)..(2447): n is a, c, g, or t
  misc_feature (2477)..(2478): n is a, c, g, or t
  misc_feature (2507)..(2507): n is a, c, g, or t
  misc_feature (2539)..(2539): n is a, c, g, or t
  misc_feature (2583)..(2583): n is a, c, g, or t
  misc_feature (2613)..(2613): n is a, c, g, or t
  misc_feature (3030)..(3030): n is a, c, g, or t
  misc_feature (3177)..(3177): n is a, c, g, or t
  misc_feature (3582)..(3582): n is a, c, g, or t
  misc_feature (3585)..(3585): n is a, c, g, or t
  misc_feature (3623)..(3623): n is a, c, g, or t
  misc_feature (3646)..(3646): n is a, c, g, or t
  misc_feature (3679)..(3679): n is a, c, g, or t
  misc_feature (3943)..(3943): n is a, c, g, or t
agtagacaggacacaagtagcgtggggcagacagaaagcttggggaggaagaggacctatttgacagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggtgcagtggctaaagcctgtaatcccagcactttgggaggccgagacgggcagatcacgaggtcaggagatcgagaccatcctggctaacacagtgaaaccctgtctctactaaaaatacaaaaaattagccaggcgtggtggcaggcacctgtagtcccagctacttgggaggctgaggcaggagaatggcgtgaacccgggaggtggagcttgcagtgagccgagatcatgccacaccgtactccagcctgggcgacatctagactccgtctcaaaaaagaaatggagaggtatttttattaattgctttaccttatctgtagggttggatcaaagaatgtaatgactcatttgatttctaatttcaatgaagagaacacagaacagggcccaaggggtcgggcttcaagccttgacttcttctagccctgcactctgtcacttaacgtaggccttgtttatctcgcctcctgatctgtgattctagaaatgaaaatgagatgatttccaaattgggaatctgtaagttttaaagtttgtgcaaaatgtctgctagaaattagtacaagtgacagcatgttcttcatttcaaatgagaagtgaaaccaaaatgataaatagctttaagaatgtgctaatgataaatgattacatgtcaatttaatgtacttaatgtttaataccttatttgaataattacctgaagaatatattttttagtactgcatttcattgattctaagttgcactttttacccccatactgttaacatatctgaaatcagaatgtgtcttacaatcagtgatcgtttaacattgtgacaaagtttaatggacagttttttcccatatgtatatataaaataatgtgttttacaatcagtggcttagattcagtgaaatacagtaattcattcaattatgatagtatctttacagacattttaaaaataagttatttttatatgctaatattctatgttcaagtggaatttggagacactatgttctaattttaagaactgtttcagtgttattagattagtagtagggctgtagatggggtctttcgaggtcctttgcctacctcagtaacagaggctgggtctgagccttgctcgagattagctcttcaccaggtctgtgtggtaatcatatcgtagttaccgtaggtcacgctgcaagtgtaatttacagtgaggcatagtcttttccagtgattggaatacttgtgtcaccgatccagggtttctctttcctgagtctgaaatacctgggaaaccagttagaaggtgactgggtagcctaggagtcaaggatcagaaagggtacttcatatatatatggcagaattggtgcaggtgatcctttgaaaaatgacaagaattgatgaaattttgtttacttcctccaattttttgctgaataacatctcctttctacctgattggagtaggcttgctttctcttacttaatttctataaatttgccattgttttgtctcaagtaaaatacagtgtctttcttgaccactgcccgcccattcaccttatatgcctgccacagtcttggttcatgtaataacctaacagctttggagatggcggtggagaagttaatggtaaaaaccttcttgctctttttatttttatttatttattaggggtgggggatggtgtctcnctctgtcactcaggctggagtgcaatgacgtgatctcngctcactgcaacctctgcctccctggttcnngcgattcttctgcctcggcctcctgagtngctgggattacaggcatgcgccaccatgcccngctaatttttgtgtttttagtagagagggggtttcatcatgttncctaggctgatctcaaactcctgatctcangtgatctgcccacctcagcctcccaaagtgttgagattacaggcatgagccactgtgcccagcccttttgctctttttatagtgtaaatttccctcagttagaacttggaaattacttctgcttcacttactgccttttctcaggttgttggaatctaggcagtagcagttacttggcagctaggaggcttgctagaataggaattccaccttcagcatttactgttacagggtagaagatgcagctcagggagagaaggatgatgataagaacatggcagaaaatctcaaaatctactctggaaaattcactatgtttccacacaccaacatgtgaatcgtcatgagatcatagggcattgttaaagttccatattggaaggaaaagacttagtacaattctaagaattagcattnatcctgctgatcagttcttagctaagtgtctgctgatacctaagtaaccaatatacccaagtgttctattgctgggtaacacagtaccacacattgaacaccttaaaacaatagacatttggtaatgtctgtacaggctgtactgangcggcctgtacagggccgcttcagtacaggaccttacctatgtagactgaggtacgtgtttcttgctgactgtcagctgggcaccactcagcttcgagaggcctcccacagttcttgccatgtggccttctcacagatgcctctcacaacatggcagtttcttcaaagcaagcaggagaatctctaaatgagtcttgtatgacattacgtcattatgggaataacatcccatcacctttgccatattctagcgtctagaagcaaggtatgagttccaacaaaactcaagggtagaggctagaacagggatgtgactcattgcggatcaccttagagcatgcctgccacactcgggtacctgcagaatagagattctcaaaagttctaaaaactgagctaagagcnggncatgatggctcacacctgtaatcccagctactcaggangctggggtggaagtatctcctgnggtcaggagtttgagaccagcctgggcaatatngtgagacctctgtctctaaaaaatttttaaaagagaccccttctctaaaaaacaggaaggctgggcgcggtggctcacacctgtaatcccagcactttgggaggccgaggtgggcggatcacaaggtcaggagatcaagaccatcctggctaacacggtgaaaccccatctctactaaaaatacaaaaaattagccgggcgggcgtggtggcgggtgcctgtagtcccagctactcgggaggctgaggcaggagaatggcgtgnacccaggaggcggagcttgcagtgagccgagatggtgccactgcactccagcctgggtgacagagcgagactgtctcaaaaaaaaaaaacaaaaatattcaactatgagctggggaaaaaagcttcagcggtcactgaaagtgcttacaggtacagctagtatggggatggaatatgccccattagccaggccaacagatctcatataggagaatctgttttatgtttgttggacagtgggtgagttatcgcagagttatgccttttttttctgtcactattttatgtcccttatcactgtgcctttaacctactgaaatgcagttgaggccgggtgcggtggctcacgccaagatggcgccactacactccagcctgggcaacagagggagactccatctcaaaaaaaaaaaaaa

SEQ ID NO: 126790 - DNA, 340 bp, Homo sapiens
atggtgatgtgagagttaaatgagttaacaccgagaaaccttaaatgctatacaaatataagggatggcattgtaactctttagttaagttcttgccactcacttctgtgcaagagaagctgatgtaataaagtatttcctaggtcgggtgcagggcccacacctgtaatcctagcactttgggaagtcgaggcaggtggatcacctgaggtcaggtcacctgaggtgaggagttccagatcagcttcactaacatggtgaaaccccatctctactaaaaatacaaaaattagctgggcatggtgatgcatgcctgtagtcccagttactggggaggctg

SEQ ID NO: 126791 - DNA, 676 bp, Homo sapiens
ggctgcaccgcagcccccttaggccctgctgccagatcaggtgtggagacactgcagagctgtcactccgcatggtttcctgcaagtcagctatctcgttcccatctgtgttggtattctttcctagcttttttcactgcttgcctggcatgcatatatttatccgataagcctcaatttggctttaagacttgccttcccaggtagagactaaagatgaaatttctccatgcatgtatcttccttttaattgtgcttgtagttaatacttaattcttaaatttgagatgttactgttttaagatacactctatcatgcatgttagcatccgtttacatgttgtctatactattttgaggatcttaatgcattaagatccaccctgttgtgagttttgtttgctttatggtgtaaataagagaaaatgagattacttcagtatataaggacttttttcactttatgtttatcttacataattctttaagctaagagtttacactgttcatcagtttttactttttagaaggaacttattcagatagctttattattaatattcagatgtgccatcctgcaaagtcagggatggattacaaggtgtgatacttttagtccataaatggtttttctatagctagagcttgatcctttgtgctttgcaccattaattgg

SEQ ID NO: 126792 - DNA, 178 bp, Homo sapiens
cagcttgaaggtccaggccacttacagactctaagaagagtgctgtcagccccggccctgactcgctggccctcccagtatttattcagtacacattaaatgacaaaagtctcaagtaaacaccattagagggtaatcaacctggtcgccttcctccattcccctccccacagagcgt

SEQ ID NO: 126793 - DNA, 211 bp, Homo sapiens
gatgagctaggggaaatggtggagagactagaaagggggatcagagacagatgagtggcagagcaggatcctggctcttttggagccctctttaatcacaggtgtctctgtttggaatgtccaaattaacctcatggttcagatttctcttctgtggtctccctgatataccaagaggcgcctaccacaatctgtctgaaatgtttttttt

SEQ ID NO: 126794 - DNA, 437 bp, Homo sapiens
atggagtggtggcgcctggtccagacatgggtgggacagtgcttcagagctcactagccagaagctcctcagcggcagcccccaagaagggaggtctatgggtctggagagggttcaggaagcttccacggtaacaagcagcctgagggaccgtgtggtgttcccggccagacatcgagaagtgcccaaaaggttagagctccggctctggtgccggaagacgtggattctgctgcaccacctgctactgtgtgactccaggaaggaaccttgagcccctccgagcctcggcgtcctcgtgtgtaaaacagggatggtttccgtgacctcggcgggatgccggaggctcagagcggaccgtgagactgagaggctctgaacacgccacaggctttgcacatgtgagtacgtccacacgccagccatgttctcacctt

SEQ ID NO: 126795 - DNA, 486 bp, Homo sapiens
cctggagccctggaggaagctgatctgcagcaggctggtgacagaggcacaaccaaaccctgcagtgcccttcactgagaagccttaccttcttgataactggcaaaggagaagtatttgcagagcccatctctcatcactgagcaggcaaagaagggtagatttggagctgagaagcaataagttaataacttaaagaagataagacttctgtcttctgggctctcaatatccatgctttctgcttccattccctgcactagctcattaaaactttcaactctaaaattctagggttttgtattcttcacttaagtgtgaattgctgtgcttgagatcccaagtccacattaactggactttaaaaaatcatgactagacactgtagtcatgattgctgttgttgctttaatacaggtaggctcttgcctttggggagtgtatatggacagtcctggctgcctcatgacttccacaaaacatggt

SEQ ID NO: 126796 - DNA, 663 bp, Homo sapiens
tattaacatttaaatgtaacttatgtttagtggtattttctcaagtctgtgattcttttgtgtctgtgtattaggatttactagtagaatgtgctggaatatttttttcaaacattattgccacccatctcaaactagcattcatattttgagaaccttatttattaggaattaaaagtttacttgctaacatggttgagaggacatctcaaaaaaaatgtgacagaatgtgctccatcttcacgacaattagaaaaggtaaacagttaaattttcttgtttttcattggaacagtatttaatttgcacctacaagaattatatgaaatagacatgtcaaaatttgcagtggtagaaaggccatgtgagatctagttggtggaggcaattaaaaatgtttcaacatataaacaccggtaaattcttttcctcaactaaaaatatttggacattttagtgccatcaaccatgagtttgtgaaaatgatataatttaactttgcttagctgggcatgctggtgtgtacctgtaatctcagctacttgggaggctgaagcaggagaatcacttgaacccaggaggcagaggttgcagtgtgccaagattgtgccactccactccagcctgggtgacagtacgagactctgtctccaaaaaaaaaaa

SEQ ID NO: 126797 - DNA, 316 bp, Homo sapiens
tcctattctacctccatgtggatgcaatgttagctcccctaaacctcaacccacctttcattctccgggcaaactcattttcgtttaggtgctgcctcttttgcaaaagcattcctgaccccctaagcagatttagggccttttcctcctgtgtttctccttgtactttattataaatgatttcattttacagttgaatgtaggagtctgtctctatctttgcgttcttcttccctagtacaacataagctccctgagatcaggaactacgtatttccaccactggctccgtggttggcacatgggtagatgctca

SEQ ID NO: 126798 - DNA, 653 bp, Homo sapiens
gtagcggttcctgcctgtaatcccagcactttgggaggctgaggtgggacgatcagttgagcccaggagtttaagaccagcctggacaacatagtgagacccggtcttcacacaaaaataaatcagccatgcgtggtggcgtgcgtctgtagtcccagctattcaggaggctgaggaggtgggagaactgtttgagcccaggagtttgaggatgcagtaagccacagttgcgccactgcactgcagcctgggtgacagagtgagatcctgtctcaaaagaaaaaataaaataaaataaaataaaacataaaatagaagtaaaggaaacaatactgcctataatagaaactccttatattatttgtttttgactggctaaatgaaaaccaaagatacaagaaatgccttttaaaagtaataaattttaaaaggattaaacttaaaaaaagaagtgatgaatagtattactacagctaaacaaagaatgctatcagttaaaacttgatttattgttcaaaatgcagctagttgatagaaaatgtccaatatttcttcataataggtacctgaggcaggactccaatctgatcattctgacaattataactctcaagattaattaacagcttggcattctggcttccttaagagaa

SEQ ID NO: 126799 - DNA, 234 bp, Homo sapiens
acccctcatggaactgttccattcataaaaacctgcctggaaacccagggcagcgtctccctggctcagggtgagaatcgtcgcacacatgcagtccgcctcgggcctctgcagggccgtccctgaggccggggtgaccattcccctggcacatctggcagggccctcacccccgtccaggtgcccccgggtagcccttggcagtcacagggagacagtgaggtgcagtggtta

SEQ ID NO: 126800 - DNA, 218 bp, Homo sapiens
gtaggaggcagaggtgacgcatcagtaaagcagggagtgctggacctcagagcctcttctcagagacagggctaaccgccctcggggaaatgacctgttaaggcagcttggctgctggacgctgatgagcagtgaaataacaacagcatctgaaggggcggggcttgcctggggcccacaggagcatagcacaggacatacacttgaccaagtttaca

SEQ ID NO: 126801 - DNA, 185 bp, Homo sapiens
agatcattgtgtggatgagtaaagagtgaggaaaatgcctagaagcaagttctgaggaactctaaacacttaggggttgggtaatggaggagaagctagacaaggagaacaaagaggaactgtgggggaacagtagtgagtggtgagaggaaaactactagagtgaggtaggaagaagctaggag

SEQ ID NO: 126802 - DNA, 568 bp, Homo sapiens
cggtttcctcttggggctggagatgtcgtctgtgaggcacagacgtgaattgcctggtgtttaatgatgagctgtttacgggcttggatggtgggtataagggtgatcactttattaactttgaaatgtcgtggtggcaggtgcctgtaatctcagctactcaggaggctgaggcaggagaatggaggtggcagggaagttgacagaatagggcacattagactgacaaagtcataacaagtaacccaagttggtaccagaaagaccacatactctgaccataatgcagttgaacagtgaccaataagacaaaaatggtatcatggagtatatgaatcccaagtctaaattgaatgaggctcaaagaaggcttcacattgaaaatgagaccacgtgtatgtgagttataatgaacctgctatataccaacatttatgtggcagagctgggagtgtgcaaagagggatatccttcatcttgtagcatttttttttttagaaaggaaaaactggaaaatcatgaacatttacagtgtttcagtcctactgtgcgctcattgtgcctaagt

SEQ ID NO: 126803 - DNA, 535 bp, Homo sapiens
agagagccgggctttgggtcaggacaggctcctcagagaggctccagcctcctggggaagcggctggagtcagcacagtcccacactgcgtggttttgcctgcacctgggtttgtcagttgtttatggatgttgagctgagtggcactgtttggaattggagttgtcatgtactgttgtgggggtatctgtaggggtgttgtcagggcctctgaacagtgcatgtgtggctggctagggtacggacgtgtagctgtccagaacagtgttgtaaggcagtaggcagctcctggccgtttgggctgctatcagatgtcaggttgtactgggaccatccggtggtgttttcaggctgtgagtgaatcctggccatgttttgggtgcctcttcccttctatctttgtacagaggggggccccaggacacctggagggaggtctcctgtcttaatcagtccctccacaggtaagcaggcaggcagcctcaagccccctcactctcagtaattttaccacggtgcctaagtcaggaacagg

SEQ ID NO: 126804 - DNA, 667 bp, Homo sapiens
gaaatttaaaggaattgacggaagggaatactgaaaagagaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacatgtaccctaaaacttaaagtatagtaataaaaaaaaaagtcattgtggtccatacactgaaatatgattcagcccccaaaggaaataaagtactgatccatgctacatcatggaggaatccccaaaacatgatactgagtttaagaacccagacacaagaagtcacatactgtatgattccatttacatggaatgtggcaaatcagtaaatcataagaacaaaaaacaagttagtagttgccagggactgaggtggggtgtgggggatgatgagtgactggtagtgactagagagttttcttttggggtgacataaatgttttggaactag

SEQ ID NO: 126805 - DNA, 285 bp, Homo sapiens
gatgttatttggaggcagagccaacaggacttcaggaagggttggctgtagggtgtgagagagggttgtccagggcagttcttcagtttctggcttaagcacatgagcaaatggcatggccattttcagaagagggggatgctgggaaaagcagaccagggagagggaaatcaagggttctgggttgtctgtgttaggactgggactcctggggctggatagggctggaggtgccaagggaaacagttgtcagatataagcctagagttccagagagggggttgc

SEQ ID NO: 126806 - DNA, 797 bp, Homo sapiens
tacttcattcagatcactacctgcctgctcaaaagataaccattacagccaggcgtggtggctcacacctgtaatcccagcactttgggaggctgaggcaggtggatcacctgaaatcaggagtttgagaccagcctggccaacatggtgaaaccccatctctactaaacatggaaaaaaaaaaatttagccgggcgtggtggcgcacgcctgtaatcccagctactctggaggctgaggtgggagaactgcttgaacctgggaggcagaggctgtagtgagccgagattgtgccactgcactccagcctaggcgacacagcaagacctggtttcaaaaaaacaaacaaacaaacaaacaaaaaaactattactctgaatttttgccttttttaccttctgtagtttatttttttcttagccctgattcaattatatcaggcattgttaaaattgaattaaaatctgaacacagtgaaatgtacaaatattaagtatacaatttgatgagctttacaaatgtacatacctccatacatatctcaatagcgatagagtcatccaagaaaatttccttgtgctttcttattatagtcagtccatacacaccatagacaaaaacgtttcctgatttccattaccttaaatttattttgcccaattttagcctgtcacataaatgaaatcatgtagcatgcgtattctgggggagtctgacttctttcgcaatcaagatgtcatttcaaaatttcatccatgtttcctcataactcggaggcaccagctagctaattggga

SEQ ID NO: 126807 - DNA, 411 bp, Homo sapiens
actaaactctttgcatgctgaatagctatttatatattatataaataaataaatatatatattatatatcgctctctctcacaaatgcaggccacatgtcaaattcagctttgctttctacaaatgaatgaacttaataaaaataaacgttggagggggtatttggaaagacatctatttaaatttttattacatgtttgatattaaaaactaagaatggtttagataaaacatataaataatatatatatatatatatatatatataaacacacacacactacagataaggcttttttagaaaacacattagctaacaggtgatatggaacttcaagtgttttgttatatagcatggatgttttattttgcatatcggaacataaagccattttacaactgtgaagtgtg

SEQ ID NO: 126808 - DNA, 727 bp, Homo sapiens
ggtcaactggtgtccaaaagtattaagtggaaatttccagaaataaggaatttgttagttttaaattgtgtgcctttctatgtagtgtgaagaaatcacataccattccattttgtgctccctagagtgtatccttttgcccagcacgtccatgctgtatatactgcctgtctaccagtcacttagcggccatctaggctgttagatggactgtagcagcaacatagtgcttatggtcaaggaacagttatttcacttaataatggccccaaagtgtaagagcactgtgcctaatttacacattaaacttcctcataggtgtatatgcataggaaaaaacctcgtactgtataggtaggatttggtactatctgtagtttcagcagccactgggggtcttggaatatatgccctgttgttaagggggaaccactgtagtgtttggtccagcaaaggcactcagtgactgaatgaagtaatacattaatttaggaatagccctgaggttattatgtagtttggtaagaaaagggctgtgaaaccacttttgctcgaagacattgtgatgctatgtctccataatatgaacaagaacagcaatgtaatagcttccatttattgaacattatgatgctttgctcagtaggaatctacaagttgtttgtgatcattcataagcttataattttatcactttggtctgtgggaaaaatgtgcagtggtttat

SEQ ID NO: 126809 - DNA, 460 bp, Homo sapiens
gcacaggagagaagttagggactggggaatttgtcacagcccccaacacccgggacaggtagtgcagtaacacagagcatgcagctggtctgctggaccatgagttccatggaggcaggggctgtgtctccctagtgagttccacggaggcagcggctgggtctttctagagagttccatggaggcagcaactttctagtgagttccatgggggcagaggctgcatctttttagtgagttccacgggggcagaggctgcgactttccagtgagttccacggggtcagggacagcgtctttctagtgagtttcacggaggcaggggctgcgtctttctagtgagttccacggaggcaggggctgcgtctttctagtgagttccaagggggcaggggctgcgtctttctagtgagttccacgggggcaggggctgcgtctttctattgagttccatggaggc

SEQ ID NO: 126810 - DNA, 578 bp, Homo sapiens
ggagaaacccaacaaaaactagccaggtgagcaaggttaacctcaacagtgagaaatcatttgatagtatatattctctatacatacatatttatcacttgatatgataaaaatggcaccttacctctgttgtcttcctcctccaaacccataaccccagtctgatcatgagaaaaacatcagataaatcccagttcagggacatgttatataatacttgaccagtactcaaaactaataaggtaatcaaaaacaggaaaagaatgagaaactatcacagccgagaggagcctaaggcggagacatgtcaactaactgcagtgtggtttcctggatgagagcctggaacagaaagagggcgttaggcaaaaactaaggaaattagaagaaaatatggattttagttaatatatcagtaatagttcattaactataaaaacatgtaccataatatgtaagatataaataggagaaacggagtatggagtatataggaactctctgtactattttcattatttttctacagtctgatactgttctaaaaattaaagtttattataaaaaataatggtcca

SEQ ID NO: 126811 - DNA, 345 bp, Homo sapiens
ctaaaacatagaaagaataaggcaggcatggtcgcacatgcctataactagacagaggcaggagaatggcgtgaacccgggaggcggagcttgcagtgagccgagattgcgccactgcactccagcctgggcgacagaccaagactccgtctcaaaaaaaaaaaacaaaaaaccctgctaaagctaagtgaatttagcaaatcataaaatgtaatatcaagatacaaaaatgtaaatactttaaggacaaattgtttctaggtgttaaagaacagatcattacaactctaaaatcttatcaataaaataaaaagaaactataatactgccttgactatagatgaa

SEQ ID NO: 126812 - DNA, 161 bp, Homo sapiens
gcagtgaactaatacaagatataaaatctactcattgataatataatagggatgttttaaggctgaagaaaaaactcagaattgagaaacctgctatctagtagttctctgttttaccacatttgagttgcctttcagcctataattcatatcctacccac

SEQ ID NO: 126813 - DNA, 722 bp, Homo sapiens
cagtggtctttggacttgtgggctgctcaggtttagaatgatttggtgtcttagcttttccccagcattagccagaattgaacccactacattcaaccagcagctgccactcaacacctgtgctggccctctgccccctgcctgttgtggtcagggagatgtgttctttttcagaaacatctttgtgtttagcagctttagacattcagacaagatattgctagcctggctgctcttggtggattttctttttctctaaggacctgaagaggtcattaggttgaataagagccattactgacttttctggctaaggtactaatcaggatttgaggaggaatctgggtcttccagaaaatcataagtgtagactcctagatccttgagctgcctgtcactgattggctgcgtccttggacaaggccctgaccttctctgagccctaatgctctgtaaacccttcctctccatctgggatcacgaggtggaatgtaaaatgaatgttttttcagcttcgagttttcctatagaaacaagagtttgcactgagttgcaaatgactagtattcctaaaaataaataatcaaggctatgacttgaatagctagaaacagcctagaatagctttctgtttcacttgaggaagctttttacctctttcaaatgcaccaggacatttttgcagtctttattttaattaaagcccatttattttaaaacac

SEQ ID NO: 126814 - DNA, 525 bp, Homo sapiens
tattcccttggtaaatgtgtgtgcctgctttcatcaaactcttgttgttcagcttttgggaacaattaaatgagaatcatgtctaaaaatcagaaataactaataatcttgttacacaaatttttttcttctgtattttttagaaaggaaagctgtatttgctaagaaataatgaattgagcagctagcaatttcactttttactaggaggtagaaaataataaacattttatataagataaaataggaagactgattgcaatgggaatattttgatatgaagtggaaaataattgctccctccaagctcctcaggtttttacaccctggaccatgcatcaagattcagtgtaggggagagacattcctttcttttgtaaagtaggacaaggactatggtgaaagtgggggcagtggtagagtggagaatgtgcatgaatatgtcagctggctcccaaatggattggtttttagaatttttttttttttttttttttgagacggagcctcgctctgtcacccagg

SEQ ID NO: 126815 - DNA, 359 bp, Homo sapiens
ctcctgagcatgcacaaaactcatacatatataaaaatacatttttaatttcattttttaattgatacatattagggaacacattttgggagtacatatgataatctgatacattcatataatcatatccagagagagtctcactttgtcgcccaaactggagtgcagtggcgcaatctcggctcactgcaacctccacctcccaggttcaagcgattctcctgcctcagcctcctgagtagctgggattacaggcacgtgccaccatgcctggctaatttttgtattcttagtagagaccatgtttcaccatgttggccagactggtctcaaactcctgggctcaagcgatccttctg

SEQ ID NO: 126816 - DNA, 407 bp, Homo sapiens
gtgactctaccgatcctatcctacgagcgccacattatttctcatatcctacttttgtgaaggaagacaatacagaaactatcttaaggagttgttcgggacttttaaagctcttacaacactcaacagtagtgctcaagaaatgttagggaacacagtggtgatcaaacataaatgtctttacctagctgtctcctaaaacatgtaaaggaaggccgggtgtggtggctcacacctgtaatcccagcactttgggaggccgaggtgggcagatcacgaggtcaggagatcgagatcatcctggctaacacagtgaaaccccgtctctactaaaaaatacaaaaattagccgggcgtggtgacggttgcctgtagtcccagctactcgggaggctgaggcaggagaa

SEQ ID NO: 126817 - DNA, 579 bp, Homo sapiens
aagcgagacgggaacacaggagtgacacctggggcttcgcccagcatcagggggaggcccactgcgggctctgtggccccagggcctgagtgcgaatcccggcccccttgccgggaaatacttctaaatcctgaaattctatcttgtgggtgtttgttgtttttctgtgagcatttttggatagcttaaagcttacagaaaactgtaacaatactctattggacaaaacagaaaacacgatgcctttcaatgtgaaactgaaggagcagctgagaaagttcactgcctggcagaggagagggaaacatgaaggggcgagaagacgcagctgggggcgctgaaagctgaggggggaaaagcagaattaaacaggttcaccaaatggcacgccatgaagagacagcctggcgttaaaacacctgcacctccccatccgcttcctccctctctaagctcagcacctccagggacagggcacccccccatccacttcatgttcagaaaactcaaagagtcagaaaacgctttcttaggtaaaactgtcatcttccttttggaaacttctagttgttacttcag

SEQ ID NO: 126818 - DNA, 340 bp, Homo sapiens
caaagtatgtcactttgccaaaaccttctagtggctttccagagtagaagccaaggctcttcggtggcctgcaaggctctgcatgagctgacctcccatgatctctcctcctcttgtcctcatgtactctgccccaggtatcctgacattcttgctgtttgccaagcacaccaggcatgctcctgtcctggggtcatttgcactggcatccactttgccccagacaccacatggccaactctctcaccctcttacagtgttcacccaatgatgcctacccaactaccctacttaaaattgcagcctgtggctcctcccttgtccccagcattcctgacca

SEQ ID NO: 126819 - DNA, 314 bp, Homo sapiens
ctcctgcaaagtgggatatttagcagcatttttagtttctactcatgagacaccagtagcactccccaagttgtgacaaccaaaaatgtctccagatattgctaaatgcaaaattgccaggagctaagaatatacttcatttttactcattaaatcccaaatgcatcctatgaaatactgtttctgttatgatcctatttgttccaactttataaataactaaatgtggcttagaatgcattaagtgacctgtttgatttcacagtctactaaagacaggacttcaacagagcctacactctttgtcctaacac

SEQ ID NO: 126820 - DNA, 193 bp, Homo sapiens
cctgagaattttctcatgacgttaattattcatttttgtaagaagcctgcataaataaaagtacaagtaccgggtgtccagtgtggcatttcaggagcttggagaaagaggatagagaaggtgagagctgggggaaaattgagaggtggccagaaagagaggctttggtcatttccagagtcatggagttgca

SEQ ID NO: 126821 - DNA, 493 bp, Homo sapiens
tttctttttcatctttttaaaattgttatcaaattaggtatgggcagaaaatatatacaatgtttgaggaaataatttttaaaggtttcaaatctaacttatcttatttctcttgtgttgcctattctcttttagaagaaccaaaactgtggcaggcctgcgatggctgtggttgaggaaagaggccacacccacagccagcagaaccacactcagcagcagcctagccccacgtggaagaggcgtgaacactctcgggagaggtggatgtacgctaatggttctcagctccgacctctgtgattaacagaacatgctgattggttttatctgaacgtcacacaaaagggtttctatgtccaggaaagactctaaacactctggaccctgctggggcagatggtgaccgtgacccagtgataccactctccagtgggcagcctggtctgcagagggggagatccctggggcagccctacctcagcatgggtga

SEQ ID NO: 126822 - DNA, 363 bp, Homo sapiens
tcaacactggaggtcctgcggggtgggtggtgctggggaggccacacggggagggctgttccctgttcccttcccctcaggagacagctggcccgaggtgacacagcactggatgcgatttcagggccagagaccatggtgcccggggctgtggaccacgccagcccacagccactgcaagccccagaccggggctgtggataacgccagcccacggcagccacacgccccagaccaacacgagaagaacgcaggccgacaacatcttcatctatggtaggtgacccggttatcgttcctaagagagtccacggccacttctactgggttccctatactcttcccctgccccagctggtcccc

SEQ ID NO: 126823 - DNA, 632 bp, Homo sapiens
aggtgacacagcactggatgcgatttcagggccagagaccatggtgcccggggctgtggaccacgccagcccacagccactgcaagccccagaccggggctgtggataacgccagcccacggcagccacacgccccagaccaacacgagaagaacgcaggccgacaacatcttcatctatggagcctggcctgtcccccgtggctccacagcataccgcacatcaaaggcacgattctctccgaagccctcagtggcttcctagtatctgacagaagaaccaaaactgtggcaggcctgcgatggctgtggttgaggaaagaggccacacccacagccagcagaaccacactcagcagcagcctagccccacgtggaagaggcgtgaacactctcgggagaggtggatgtacgctaatggttctcagctccgacctctgtgattaacagaacatgctgattggttttatctgaacgtcacacaaaagggtttctatgtccaggaaagactctaaacactctggaccctgctggggcagatggtgaccgtgacccagtgataccactctccagtgggcagcctggtctgcagagggggagatccctggggcagccctacctcagcatgggtga

SEQ ID NO: 126824 - DNA, 589 bp, Homo sapiens
cactggaatttcctgctttcaacttattgttctggcaacctgtagtctgaaagacagcattgtcttcaggcatcacatgatatccatgagatctgatcatactacacaaattaccctgcactcaggaatctcctacatgatattgctggaataagtgtccatatgaactacagttttgctgatatgaattaattctgcatggtattatttaaaaataaaacatccttaggctgaatccaggttactttcaaattttggctttgagatttcattctgcatagtaatattttttatcatttaataaacattcaacattaacacattagtcctcaaatctaaaaggaaagtagtggaagcctcattttaaataattgaagcagcgaaaactaaaccttatgaaatctcatattgatgaatgtttcagcatgacttaaaaatatgattgtacaaagaatattatagaagcattaatgtaatcaaaagaaagaaaattatcataatcccattctccaaaaaataaaaattattttcatttttctgtgtcttttcatctgttacatacaaatacatattttacaatattgttata

SEQ ID NO: 126825 - DNA, 265 bp, Homo sapiens
gcctggcctcacaaccttttttcaatgagaaaaacattagccttcttttgttacacataagagagttctttctagttgaagagatgtttccctgagtctttctgatgaaaatgatcctcttgctacataaaatccttataggagcaataaaacctgccttcggaaccagctgtaaagcacttattgtccatcatcatctgctggtgaggaccttgctccccggcttgtgattctcaaaccccaacttaggcttgctcccggttaa

SEQ ID NO: 126826 - DNA, 352 bp, Homo sapiens
taagtaatgatatcagacaagtgaggtgtgccacgaataaatctacagtgggaccggcatgttttggattgagtgttgaggtaaggcttccctgaagagacatttgagatctgaatgataagaaagcaactttacaaagataagggggaaaggcctttacagataatgaaactgaggaacagacaggttagtaagatggctgagattacgcagtaagtaaacagaacccaggtctgatgaacaccgagaccaccctttctactaaactatgttctctctttattcagttctcctcaaatgcaacagtgaagataaaagaaaatgtggaccttcccctggcctcacagaaatg

SEQ ID NO: 126827 - DNA, 598 bp, Homo sapiens
caggtggaggtgggaaggcggtggggaggcagggttggggctctgagcaggggcagggccaggcagtcatcccagtctctgtatttgtggctgatttgctctgtagcagcagaacagagacactgtgcttaccatgggaaaaaggaagaagagggaacttaccttcttttctcttacattccactggtgagagttggccccttgggagttaacctctgctcacttcagaggaacatcagccagcacttttaggagctaccagggaagcaaaatgctacgctttgctttgtggtggttcttccaagtctggaaatggtagaaggagccagaacttcaaggtgggaagagacagccaagcaagattctgggtggagtaggcagcttctgaaatctgaaatggttcacagtggtccccacctcctgggtttttgttgttgttgttgagatggagtctcactctgttgtctcggctcactgcaacctccgcctcccagattcaatgaattctcctgcctcagccccctgagcagctgggattgcaggcatgtgtcaccgtgacaggctaattttcatatttttagtagagacggggtttcac

SEQ ID NO: 126828 - DNA, 455 bp, Homo sapiens
ctgagcctcggttctgtagaaactttaagactcaagagctggacagcagcttcgagtcctctggaccggccgcttcacattatggatcaaagcctgagacccagagagggcgctgcagcccctggtgagcgcacacctaggtctcagctctggagcccagcaatccccttcatacaccctagggccagaggccaaggggctaagggcaggctggatctatctgggagctccctccgaaaccctctggttccaacacaggactaagtccccttcctaggactaagctggtcagatgcagtaactgagtctggggtccgagcttcatggtcattgatggtgcccattactttcacataaccagcccaggggcccctcttctccccctcccctttatgtgacaccctaggtcctgatgtgacacagaggaggggaagaggcctccttggcttccatta

SEQ ID NO: 126829 - DNA, 578 bp, Homo sapiens
gtgccacccaactacacatgctggagccagggccggagccacagggggacctcagtgagcgggcccccgaaccacagctctgtggatcacctgaccaccccccaactctgaccctcggcctgtggtgcctttgaatctttaggatttaatcagagctagtaggcagtaagcctgaatgggctggttgtcttcccttctccagtgcgtggtcattggtgcatggccacacgtccgtttccactgtgggagcagggggagggtttacagtgtgcattttctaacaaaatgcacaaggtcctttctccccttcacccaaggagctctgggtctgagaactggttgaggagccatgaatttcttttatgatgattcaagttaggctggtattggtcggcctagggcttttccctttatccagatcaatgagacttccgaaggccgatcgtttgtgccagccctggggataccacagtcctttagtcaacactggcacccctgtgccaacgctggcacccctgtgagtcaggcaatttgagtacacatgagttgtgctgcccgccacctggcaccattggagt

SEQ ID NO: 126830 - DNA, 291 bp, Homo sapiens
gcaagactttgaggcgtttatagatacaaaccttcccctaacgcttccctccgcccctgctacccggtcagctccaagcccctgtcccggtggcccaggatcttctgctaagggtctcattccgtcccgcgctccagtcctggcttggcgtgcctccctcgccttttattgtaggtctggtctcccagggtagcggcctcatcgcattcccttcgcagcgcccctggatccagaaaccgcttttacctgtccgctccggtgcagccagcacgccgaatcccgtcgtacccg

SEQ ID NO: 126831 - DNA, 378 bp, Homo sapiens
cagggatgaggaggagacttttcactgtgcatccttcaataccttttggattctgagccatgtgaatgtgttacctctgaaaaatataaattaacaggctgggcacggtaatttattacgtgcctgtaatcctagtactttgggaggctgagataggcagattgcctgagctcagaagttcgagaccagcctgggcaagatggtgaaacccggtctctactaaaatacaaaaaattagctgggcgtggtggcaggcgcctgtaatcccagctactcaggaggctgaggcatgagaattgcttgaacccaggaggtggaggtggctgtgagccaagatcatgccactgcatgcagcctgggcaacaaagataaactgtc

SEQ ID NO: 126832 - DNA, 324 bp, Homo sapiens
agtattataactctagggaaatataaaaatgcaaatatatcagctgaatgcagtggttcatgcctataatcccagcaccttgggaggccaaggcaggaggttcacttgagcccaggaattcaagaccagcctgggcaacatagtgagacctcgtttctactaaaaataagaaaaattagctggatgtggtggtgcacacttgtggtcccagttactcaggaggcttaggcaggaggatggcttgaacctgggaggtcaaagctgcagtgagccatgactgtgccattgcattccaccctgggtaacagagtgagaccctgtctc

SEQ ID NO: 126833 - DNA, 213 bp, Homo sapiens
gtcttcacaccccgcctcagagatttcacctgccacactcagttcccaggtccctgtcactcccctgcttgcctccctccccttgtcaggagctaccccagtttctaccacccagcccctggcatccttctcacagtgaaacagacagggtggctgaaaatggaaggaagaagccctggcccacaatgcccagcccctctcccagctctgcca

SEQ ID NO: 126834 - DNA, 372 bp, Homo sapiens
tgtgcgtttatccaaaccctgtgcctctgcctctgtaaactcttctccctttaaacaagaagtcaatctaccagactaacacctcatatcaggctttctagcctatatgcatgttggtgtgtgtgtactttaagttataaaaaaaactattttccttattttggtgactgatttggagatctaaaaagacatctgagaactctgtactcacaacaggttctatccagcagtaatgagctaggcttcagcaactattattgtattcagtttgtcccattttatcagtcccaaagaatcacttcagaataacctggaaggaaactatttcagtatatatatgttttcctacaagtagttaagataaggaaggga

SEQ ID NO: 126835 - DNA, 186 bp, Homo sapiens
ggggagttgaggaatgactgctaatgggtttcttttagtgattatgaaaaagctctaaagttaattgtaatgatggttacacacctctgtcaatatactaaaagccattgaactgtactttaaatgggtgaatatgaattttatctcaataaagcagtgcaaaagcgttttggtgcacatgacttt

SEQ ID NO: 126836 - DNA, 525 bp, Homo sapiens
atgagtttatgaatagtagcactagagtggtgtgttttgatgagagaaagattgcagcgagggttccttttctttcttcactggatatcatcttaaacgataagccaaaaaagttgtaagccaataagctaccatttttctttttttttgagatggagtttcgctctttttgtccaaaaagaaaaaaaaaaaaaaaaggaagatatttactttgaaataaacaaaaataaattaaattaaaagtagtaggctatgtagcaggcattattctcaaaattaagaggtatagcacagacaagtatagaatgctcctgtttcatggagctttcattcatactgtcatagtgaaagacagtaaacatataaataattgataattttagatagtgatatgtgatctgaagaaaataagatggaataaaataacaagggactgaaaagtttggcaacaacattaaataaggttgtcaaggaaggcctctctgaagaggagacaatttagctgagccctgaatgatgaaccca

SEQ ID NO: 126837 - DNA, 435 bp, Homo sapiens
caggctgattatactggaactcttccattactgagagggcagaaattcattctcattagaattgacacatattctgggtataaatgccttttctattcataatgattctgccagaacctccacagactcatagaataccttgtccaccatcatggtattccacagagcactgcttctgctcaagaaactcatttcatggtaatgggaatacagcagtgaactcatgtctatagaatgcggatactgcatcatctagaagtggctcccctaacttaaaggcaaaattgcttactgaaaactcatttatgctgcctgtcttagtctgtttgagctccagtaagaaaatactatggactaggtggttataaacaagagaaatttacaatcacagctgggtgtgatggctcaagcctacaatcccaacactgggaggcc

SEQ ID NO: 126838 - DNA, 129 bp, Homo sapiens
ttcctgacctcaagtgatttgcccgccttggcctcccaaagtgctgggattacaggcgtgagcgactgtgcccggccaggttttacctaaacgtaacaaaaattgttaaacttaaggaattgctgacct

SEQ ID NO: 126839 - DNA, 657 bp, Homo sapiens
cagaattgcacttgtacccttcaaatttatacaaaaaaaaaaaaaaggacgaggaggatctctttaggacttttgggagaggggctcacaggggaaattgtgactgaaaacttctgactgattacttctcagttagaagcccatacattcttctgctgcctgattatcatgattccctaggatccctaaattccctactgatctaccccaacactaagtaagtcggtctttccttttgactcagagagagactgaaactaaaagttactgaaggaaaatggatgactacttggtcctggatggagatcatgagcctaagggctgcgctctttgggccatatcctgcttataggatttgcctctggtatggcatgagagacagaccatctgcagggtatctgagggtggtctgaatggagagcatggggggaataaacagatggatctttttatccagagaacacgaggttctcagtatgaacctgtagggcagtatagaatagtattgacagcaaagactttagagtgataaagagccctaacaagtctcttcatgtctctcagacttcaaggataatcacacagacccctcacaccttatttgaaacttttagggacagatattttggaattcagtttttttcagattatagaaaa

SEQ ID NO: 126840 - DNA, 336 bp, Homo sapiens
gagaatggtgccatcttgtggacatgagagagcagcgccgcacgtcccacaccccatgcaaaggaaaatataaacacgtctcttctcgttggtgcacttactagcagaccatgatttccattagctacaactactgaaccatttgttatctattaaaattgccctaagaattattagatcatgcatctgtcttctagctcatcttcttgtgtttgggaaatgagttcttttggtagacattcatgtattattccagaccacataccttgtaacaacagtggaagctgattcatgttcactttaaaaaacatgaagtctgcacaatttaaacactct

SEQ ID NO: 126841 - DNA, 664 bp, Homo sapiens
gaatccaccctggcacccactaccaccacctcattcacaacttccacaactatggaaccaccttcaaccactgcagcaactacaggaacaggtcagaccaccttcaccagctctacagccacattgcctggagccaccgcgcctggccaggagtcttctttcttaggccacatccataaaacaagcaagagactaacgtattagtttgtaagtagggtaaagtcaaatctcagacctaaccatttgcaagtggtaattttctattaattttttcttttatatatttttaagagatagagtctcactctggtgcccaggctggagtgcagtggcgcaatcactgcttactgcaacctcgaccttctgggctcaagtgatccaccatcatgcctggctaatttttttgcagagacaagttctctgaaaagctatgttgctcaggctggtcttgaactcctggcctcaagtgatcctcccactttggcctaccaaattgctaggattacaggagtgagccactgcacctggccaattttctgctttcatcattcattatacatttattggttgaaattctgctgtaaggaagaactttcccttctcctccatgaatgactgactgaatgaatgaatttgtatcagtatggattcaagaattctattt

SEQ ID NO: 126842 - DNA, 200 bp, Homo sapiens
aagccatgttcattcccacctcacagcctatctcaacagcgtcagcctccagtcctggtgactgatccctgcccacaactcccttctctgactccaacagaactatttctgcacctcgcactttgacagttaccattccctctcttggcgtctgatttcacatgctgacatccttctgtcccctctatgagggcagaagc

SEQ ID NO: 126843 - DNA, 231 bp, Homo sapiens
tatgttagaatcctatttagatagatggagccaattgagcgggccctgcagaaagccatattcagttagtgtaaatcttcctgctggtgttggagacagcaaggtcccctgggattctgtctggaaatcttattggattttcaagacttaagttaatatagagaccccccaagatagtatagggcctcatttctttgccttgaaagatgtttttagaggtctgtctcaaga

SEQ ID NO: 126844 - DNA, 631 bp, Homo sapiens
cgcagtgactcacgcctgtaatcccagcactttgtgaggctgaggcgagcggatcacaaggtcaggagatggagaccatcctggctaacacggtgaaaccctgtctctactaaaaatacaaaaaaattagctgggcatggtggcaggcacctgtagtcccagctacccgggaggctgaggcagaagaatggcatgatcctgagagacggagcttgcagtgagccgaaattgtgccactgcactccagtgtgggcaacagagcgagactccatctcaaaaaaaaaaaagcaaatgaccacagagacagtctcagagaggcaatgggagtcctgggagcaggttattaggaagcgtaaaggtctcagcttccatgcgtcgtgggatgggagactcgggagttatgtgcagtggagagacagaatctaataggctgtcactggttgatctttagagagaatacatagtctctaaatactttcctttatttactataaaagggaaaagagtaagtcaacaacagagaaagcttcagtctccacctaatcaaggggtcaaggtgaccatgaccttggatgggacaagccatggtcagcgccacctgtgattcagagatgagaatatgcattaccac

SEQ ID NO: 126845 - DNA, 367 bp, Homo sapiens
aaatgtccaggatcgggaaatttatagaaacagaaagtagattagtgattgctgggggtactggggtgtgacagctggagtatgaggtttcttttttctttaatgagatcaaaatcatataacataaaatttattattttacccattttaaaatatacagttcagtggtttttattacatttgaaatgttcaaccattactactatctcagaacatgagccgggtgtggtggcacgtgcctataatctcagctactcgggaggctgaggcaggagaatcgcttgaacctgggaggtggaggttgcagtgagccaagatcgtgccactgcactccagcctcctgggcaacagagcaagactccatctc

SEQ ID NO: 126846 - DNA, 266 bp, Homo sapiens
gatgagtctgtatacatacataaattaaaataaatgttgagatcctaagtaaaaaatagcttacactatagcataaactggcaataaaacctatcattttgtaatctctatctttatccataatggaaaataaacaaatctatgaccttaaccatttatatgacctcccacaatacgtttttgaagatcatcaaaagatgcaataagagacctttcttgcagagataagttgctaatcttaataagtgttcccagaaagagaatac

SEQ ID NO: 126847 - DNA, 227 bp, Homo sapiens
tgcaggtataaatgtggagagatgtcctatggagcccacctttgccaccctaaataaatatgtcaacatataggaaagtaaaactgagagaaaaagacatatttctgaaatggttatttgaacactagctctatcgtgcacaattcttttatgagaatgaacaaatttctctttaggcttaaaccaacttgagttagtttgctgtttcttgcatccccagattttat

SEQ ID NO: 126848 - DNA, 734 bp, Homo sapiens
caccagcacccagcatagaatggtcagggccccacacaacccagggagtggagggcaatgaccagcacttaatgtatgttttaaaacttccagtgttttgtgtgaggcaggcttttcaagagtagacttttcccagaggaagaaaaggcgagcttccagctacaacaaaccgtatcctaggaatctcgattcacacgaaacgacaatgaagaatggaaagtctggtgttttaaacaaatggacagatataaagtgagcatagctttagtcattacgcccagcctcctgaattgagacggacaagaataaacctgacttcccccacaaataaatctgcagacgtcacttattcattctcggatgttctattgctcacgatcttcgtcgagtggagagaagttaggctctcacgttaatccagttctaactcatgagtcaaactgagactgcaacaaaagaacgccccttttttcttttacatgattttccctttcccctgagtatacttcctgaaccaagaagaaaacaatcaacaggaggggagactggacttctccttcccgagggaaaaaggctgcatgggaaaaacacatcccagcgggaaggggtgctccaacggagctgagcgtgactcagagactgggggctggctctttggaaaggtcggctcccaaagagttccagagcagcctggttccacaacacgcttttaaaaagtgccctgtgaaaagtca

SEQ ID NO: 126849 - DNA, 599 bp, Homo sapiens
tgtggtggcgcacacctgtagtcccagctactcaggaggctgaggtgggagaatcgcctgaacctgggaggtgaaggttgcagtgagctgagatcacaccactgcactccagtctgggtgacaaagtgagaccctgtctcaaaacaaaaacaaacaaaaaaacccaatgaagtctttagttctttccctgtcttactatcaccactatttcagacattatttcatgtctgtgcattactgtaagtcttctggctgatccctttttctcaatccaaaacatcctgtctaatatcaccaaactaattttaaaagtaccatccttctggccaggcgcagtggctcacgtctgtaaacccagcactttgggaggccaaggtgggcagatcacaaagtcaggagttcgagatcagcctggccaatatggtgaaaccccatctctactaaaaatacaaaaattcaccgcgtgtggtggcgcacacctgtagtcccagctacttgggaggctgagacaggagaattgcttgaacccaggaggtggaggttgcagtgagctgagatcgagccactgcattcctgcctgggcgacagagcgagattct

SEQ ID NO: 126850 - DNA, 444 bp, Homo sapiens
gcgaaacagttttcaaaacagaaagatggaagtgacattatcaaattaagtgcacactgaaaacttttatgacaattgtatcgagggggtacatgtatttttcaatagatattgattggctgctatagtaaggatttttgctgggctctgagaatcattttctaagtttgaggatgctaactaaatcatacgtaagttgtatgtgataaatatggggcagaaataggtatgcactctaaaagtagtaatagcttctggtttaaagaagtgggagatcataacaagttggaatatctggaaatatttaagaaaatgctttagcatgaagtattattttgactatcatttcagagaatgaggatgaatagagaataagtgagtagggtagaaagggacaaggtaagagggccaagaggcagaattaaaattaagtcaggggaataa

SEQ ID NO: 126851 - DNA, 881 bp, Homo sapiens
ttaaaatatttaaaactttattttgaaataatttcaaaatcacagcagtttgaagggtacaacaaagaacattttgccacattttctctttcattcgttccctcctcttctccctcacccctgtttcttcctatcctctctgaaccatgaaccatttgaggattatttgtatacatcatgctcgtttatccgtaagatgttttagtgaacatttcccaagaacagggacagcctctcacatgcccatggtacagttctcaaattcaggaaatgtgtaatattctctgatcagcccaggagttgctaatttgtagttcctgtttcaaatttgccaactgtcccaataatgattttgaaagccgttgtttttctggtccaggatccaatccaggatcaagcgctgcctttagttgtcctctctgcagcctcctttcgtttggagcaggtcctcagcctttctgtctttcatgacattgatgtttgtgaagagtacagtccagtttctgttgtagaacgtccttgaagttggtcccggaatatttgtttaaagatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcatgttagagagccttggaatgtcctgcctttttacgtttaattaaaattaaataaaatatacaaaattcaaagaacaaaaatt

SEQ ID NO: 126852 - DNA, 1582 bp, Homo sapiens
ttaaaatatttaaaactttattttgaaataatttcaaaatcacagcagtttgaagggtacaacaaagaacattttgccacattttctctttcattcgttccctcctcttctccctcacccctgtttcttcctatcctctctgaaccatgaaccatttgaggattatttgtatacatcatgctcgtttatccgtaagatgttttagtgaacatttcccaagaacagggacagcctctcacatgcccatggtacagttctcaaattcaggaaatgtgtaatattctctgatcagcccaggagttgctaatttgtagttcctgtttcaaatttgccaactgtcccaataatgattttgaaagccgttgtttttctggtccaggatccaatccaggatcaagcgctgcctttagttgtcctctctgcagcctcctttcgtttggagcaggtcctcagcctttctgtctttcatgacattgatgtttgtgaagagtacagtccagtttctgttgtagaacgtccttgaagttggtcccggaatatttgtttaaagtgagttgggaaaccacattcacatgtcttttggttatgtgtgtatttgtcaaacagccagccttgtgctgcgtgctgtgatggggagcattactcaacagagcctggccctgaccttggggatgtagtttgggtttgtggggaaagcagctaccgccaggtgggctttacggacccctgtgtgtctcatgactagaggcactgacgcttggataaatacatactggatggatgcaggatgagtccgcattctagaagtgtgcagaggtacagaagtggccctgctccctgtccagcacccagtcatcagctttccctggcttcccgaggcaccctgacgttcacactccaaacacaaagtcttctctcaggaatctcgagtgagctgcagtctgggttctagccctgccctagcagggattctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccgcaggccccgatcctgcctgggacgaggttcaacagaagtaggatggtttcatcatgacctggcaggaaaaccaccagacctggaattttgcttttacaactgtttaacttctgtttcatacaggatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcatgttagagagccttggaatgtcctgcctttttacgtttaattaaaattaaataaaatatacaaaattcaaagaacaaaaatt

SEQ ID NO: 126853 - DNA, 445 bp, Homo sapiens
acttgtgaatcctgtatgtgtgggtatgaatttggcctggaggatgagccctgtttaaagaaaatcaaataacgcttgcccagctggaaaaatccatgacttctgtgctaataattttttccacggatcaccccatttaatcctacggcagcagagtaaggcaggcaacgtccctatggaggaaacaagctcagagatgctgcctgatttattcaagctcacagtcatagggggcaaagtcggactgaaattcttacacacttgcaccttgctacagttttaacttttgggaaaatgctttggggtgcagagccgcaggttccattggaccagcgccccccaatcagtgctgtgcctctgagcagcttggcgtggggcacagcccccaggcgagtggccctggggtttctgcatcatctgacagaagtgccgcagcggctccagg

SEQ ID NO: 126854 - DNA, 256 bp, Homo sapiens
gactcctgatgcagagagcttacatctttgcattcttcctccttggtgtattagcctgagttgcctgtctccagctggatttagaagcttgactaaccctgtcaggggccaattttctttgaacatttatttgtatctttgagtaattgtattttctgtagcgggttttctgacttaatttaattgtatttctgtttctgcctgttgggctggctcttgcatgcaggagttaggatctcagctgctgtggtgccct

SEQ ID NO: 126855 - DNA, 202 bp, Homo sapiens
tataagcttaaacatttttaaaattggtctcagtaacatatattaagctgaagtggggaatagtctctgaacattagaaacattagaaagttatggcttgtttctaatatgcaagttagacagaaaatacaagctccataatcttatattgcggaagcaacatttgttttaagtcctggaatccacggcctccatttcctca

SEQ ID NO: 126856 - DNA, 385 bp, Homo sapiens
tatgggggatagccgagtaaaatacttgaattctaccaatatcaacatcttggttgtgatattacactacagttttaaaaaatattaccactggggtaactgataaaagtatgcaagatgtttatctgtactgtttcttataatgacatgcaaatcaacctacagttcaatcagtatttcaaaaaccccaaaaccagcaaggcacagtagctcacaactgtaatccagcactttgggaggccgaggtgggaggatcatttaagcctaggagtttgagaccagcctggacaacatggcgaaaccccgactctactaaaaatatgaaacttagcctgtagtcccagctactcaggagactgaggcaggagaattgcttgttccgctg

SEQ ID NO: 126857 - DNA, 349 bp, Homo sapiens
taggaactcctcttataggtcattttattttgttatttttttacttcttcatgttttagtctacctttcagaatatcttattttgatagtcaaggaaaatgttaagaaccaggtttaagagggactgtagaaagggcatttttatatttaaaaatgaggggatcaaggtaattataaaagacattattatttacttgctaattttattataaaattcactcattctactttgcaaatacttatatcctctaagcaaacaagaaaataaaaattccatatgctgacttttgaattcatatttgaaataactcttacttcttagggggaggagggaacagtgatagagttg

SEQ ID NO: 126858 - DNA, 408 bp, Homo sapiens
tttttgcattagactctccatgggctccatagactctcctgtaccttacgactaggcacaggagcgtttccccggtgaaatggagaagaggacacttggtcttttcaactttactaggagggctcctttcttcccagtccaaacatatgaagctcatttctgccacccttcctagaaaactggttcctgacagagacatgtggaaaggttactacatgaagagctgggactggaatacaggttttctatgttcacctggggatagcttttccatcatccctcctgagtctgtgaggtatcccagtttttaagccagaactttgaaaccagaagtaaatggttaagtttatctgtctatgcctatgtgtattctagccaaataaaccatgacacttaaaacaatttcaa

SEQ ID NO: 126859 - DNA, 414 bp, Homo sapiens
atgctgatgcacatgggggaaagcgcttcttatagagccatcagatctcaggaaaactcactatcaagagaacagcatggaggtaccgctccatgattcagttgcctcccactgctgtagtagttcatcacatgtgttattgtaacacatgtagttacagtaactacaattcaaggtgagatctgggtggggatatagccaaatcatatcacctatatatgagatgggttttttatatatatacatatcaatgataaagtttaatttataaattaggcaatgtaagagattaacaataagtaataagtaattattagaaaagcattattaagtaaaataagggttatctgaacataagcactgccataccacaacagcagatctgataattgagccgcctgactaatgggtgag

SEQ ID NO: 126860 - DNA, 482 bp, Homo sapiens
tcccacacagaaaacaagaaaaacaaattattcccaaattcatcttgcctcaagaagaaactgctgaaacgtccccaaggtgattttaaaaggcacctcttctctcaaattattcaggagcaaatttggttttaagaaacaactaacttctacagcccataagagatcaaatgtactaagtgaatatactgttacttaatttaagcaccagaaaatcccaaacatacaccaaactgaatgaggtacattctatagaacagcttggaacacaggacaggatttaccattccaaaaggaagagtccctcccagtcactgaacttctaacgcacacattccagagaaccaattgcaccacatacaataagaaaaacctttgaaactgggccaatgtaccaagcacagcttcagccagaacaaatgctcagcatttagacttgctaaccagcagcaaaaagcaacaggaaaaggcttacacttgga

SEQ ID NO: 126861 - DNA, 529 bp, Homo sapiens
cccagagtgctaggattataggcatgagccaccgcacccggcccgagtagagcttctgaatacaagggaccccatagttgtatgaggcaatacagattgagtatcccttctttgaaatgcttggggtcagaagtatttaggattttggtttaaaaaattttttaaaaaccatttgcattatacttacttgcttaatatacacctcaaattccaaaattcaaactccgaaatgctacaatgagcatttcctttaaacattggcattcaaaaagttttagattttgtagcgtttggtattcagattctcagatttgggatgctcaacctgtaatagcaacctaagataggaaaattggtttaattgtcaagtaaacatttaccctacttgacatttgttttagaggtcagtcactgcttcatgtgcttgttaaaggtaattactatgcatggtgtttttgtctataagtacatgtattatcttagactgtgatatactagtataaaaattgcatgcctgtttgctttgata

SEQ ID NO: 126862 - DNA, 528 bp, Homo sapiens
ctatgatcacaccactacactccagcctgggtgacagcataagaccctgttttaaaaagaaaaaaaaaaaaaaagttcaagatagcatggtttgattacaaaattttggtatgctgagatagtaatacttgctcaataaaaccagatgaattgattaactggaacaacctcatgcctctaaatacgtctccttcccatagcaatagaagaatttgcaggtaaatctagaaagggggaaaatcataaagggcccaacagaaatatcagaattgatacaaatagtttctgccattcttaaaatgaataagtgaagggagaatgccagttagtactggtcaatatactcaatatatagacacacacttttctgtgtctgatgaatgtcattactaaaattttaattagaatacaagcccccccaatgcatcccaaatagatttgtgtgctaatggggtcagaaggtgctagacaaagaataagcacagtagttttcaactgggggtgagtcttcccctactcccccagggt

SEQ ID NO: 126863 - DNA, 561 bp, Homo sapiens
accttactaattttacttcttctttttttttattaatagagacaggatctcactctgtcacccaggctggagtacaggggcacaatcacaacacactacaaaagccttaacttccggggctcaaggagtcctctcaccttagcccctcggatagctgggactacaggcacccgccaccacactgggctaatcgtttttttgtatttttagtagagacggggtttcaccgtgttggccaggatggtctcgatctcttgacctcgtgatccgcctgcctcggcctcccaaagtgctgggattataggcgtgagccactgcacccggccaaaaaattttaatctcatatatgaaagctagtctgcttagtatcttacaaagcagtgagagaaaaagatgtgctactgagtaataaaatgatcaaaggcaaagagtacctacagtcttttatttatataaagtcaaagaacaagcaaaattaagtcaaaaattgactgccatgaggcaaggcagttgattggaaaagagcatgagtaaactttctggagtgagaaatgttctgta

SEQ ID NO: 126864 - DNA, 662 bp, Homo sapiens
acttcctctcctcccacctcccttccttccttcctttctttctttcgcttttgagacgaggtcctactctgtcaccgaggctggagtgatgtgatcgcagctcactgcagcctcgacttcctgggatcaagcaatcctcctgcctcagcctcctgagtatgctgggattatatgcatgagccaccatgcccagctaatttttgtattttctgtagagatgaggtttttccatgttgcccaggcttctatctgtttttcacagcagctataccacttttcattttacattcccatcagaaattctctacatccttgccaattctcctcctcctctttcttctctttttcttcttctttctccttctttttttgataatagccatcctcttgggtatgaagtgaaaatccactgtgctttttatcttttaagggggaagtcaaggcctgagaaacactgatacgtgcctctgcattgcagagccccttgggcccaggctttctagccccatcctggcttccattctctgtcctaaacccctttgtctccagtccatcaagagagggcaggggcgaggtccactgactgttaggggccctgccttccctcctgtcacagcagcagagtggctgtgacctggcagaggtgttgggagggtggatgt

SEQ ID NO: 126865 - DNA, 583 bp, Homo sapiens
tagagatggggtttcaccatgttggccaggctggactcgaactcctgaccttgtgatccacccacctcagactcccaaagtgctgggattatatgcatgagccaccatgcccagctaatttttgtattttctgtagagatgaggtttttccatgttgcccaggcttctatctgtttttcacagcagctataccacttttcattttacattcccatcagaaattctctacatccttgccaattctcctcctcctctttcttctctttttcttcttctttctccttctttttttgataatagccatcctcttgggtatgaagtgaaaatccactgtgctttttatcttttaagggggaagtcaaggcctgagaaacactgatacgtgcctctgcattgcagagccccttgggcccaggctttctagccccatcctggcttccattctctgtcctaaacccctttgtctccagtccatcaagagagggcaggggcgaggtccactgactgttaggggccctgccttccctcctgtcacagcagcagagtggctgtgacctggcagaggtgttgggagggtggatgt

SEQ ID NO: 126866 - DNA, 339 bp, Homo sapiens
agagacagagaccagagtctgactggtaagaaattcttacctttttgctggcatgtcaggcttctgagttctttctccctgagtggccctagtggccctgcttaactgtatgcagacaaacacattgctgtgaattaagaatattcacaaatagtttacaaattttggaaaaattaggcagagagagaaatatgactcaaattctatttatgaaagtatgctcaacacacttaacatatcaggaagcttaactccaaaaagctagtttaagattaaaaagccggtgtgttccattaattcctgaaagcctgacaaaggtagcctaggaatttcagctaa

SEQ ID NO: 126867 - DNA, 596 bp, Homo sapiens
ttctccacttggatgcccacaagtatctcacatttaacacgtgtaaggtgcaagtccatgccctttcccaactccctcagtttctccccaggcagtataaatgctccatcatccatctagctgctcaagtggctgacgtaggagacaactttgatcttccctttccctcagcctccacatccagtccattagcaggtgctgttgatcccaggtccaaacagagccacaagctgcaggtttctgtgcaggtctctccgtctccattgccacacatcagtcatgtctccaacccctttcatgaagactgttgcaacagtcctgtttactgtcaccattagataccttcaatacaaccatcccacagttgccaaggggatcttgttaaaatgtaaatctggccaggcgcagtggctcacgcctgtaatcctagctctttaggaggccaaggtgggtggatcacgtcaagagatcaagaccatcctggccaacatggtgaaaccccatctctactaaaaatacaaaaattagctgggcgtggtggcacacgcctgtagtcccaactactagggaagctgaggcaggagaatctcttgaac

SEQ ID NO: 126868 - DNA, 334 bp, Homo sapiens
gtagctgggattacaggcgcccgcccctatgcctggctaattttcgtatttttagtagagccggggtttcaccatgttggtcaggttggtctcgaactcctgagctcgtgatctgcccgcttcggcccctcaaagtgctgggattacagtcatgagccactgcgcccagcccctaatttttcttaactgtaagagggagcagtccttaccttacaaggatgttacgaggatttaaaaaaaggcaaagaccacaatccacttcagaatcccttggggccacatgtgttttggtatttaaaattatttggatttcagaaaggcaatacagtgcata

SEQ ID NO: 126869 - DNA, 190 bp, Homo sapiens
ccaagcgccaccaaagcgggtgatccagatgcgctgtggctttgcgggcggtgtgggtcaccagagaaagaggaccaggcggagaaggcttaatccgggggatgagacacaggggagccgaccagaggagggggacccagaacggaaggagagtcaggctgggaaacaaggtaggagaagagggtctgtc

SEQ ID NO: 126870 - DNA, 102 bp, Homo sapiens
aggacccctgctgtgccagtactagcctttaagtttctaggtcaaggggaggtccaggatcccagaggagcagcccaagtggccaaggaaatttcagggagc

SEQ ID NO: 126871 - DNA, 670 bp, Homo sapiens
ttaccgaaatgcttaattaacagtttaccagcatcaagagtgtaggtgggcaagaaacttgtatcagaattcacttctgttcaagccaggaggtgagtgacattcataaatccgtcaaatacctggccttgcatccaaggactattcattttccttaagtgtttaagtggttctttgagaggatgtgttgactttatcaattcaggccacatcataattagctaatttaaagaaaaaacaggggtggtatctatatatgtttgtaccaaattgagttttaatataatcctggttctctgagggtgatatggctaataattaagttatccccattaggttatactttcggaagctgctgttgcctgctgcctattccattaaaaactaactttatcactaattttaacatgaaacagatccatttggagaaaaatccattatgaatgagacagagttggctgttgaataacattggtgtaggctcaagtctggaataaatgtgatatagatgggacgatattggacaaatgcaatttatttcattattcagcaacaaggtattccaaatgtctctgctaatgaatacatgaaaacagattacatataatgtgcacactgtgagtcgcatttgcagaattatttttgccacctctagcactatctgaaacca

SEQ ID NO: 126872 - DNA, 124 bp, Homo sapiens
cttaaaatactcctgagcctcagtgatgaaatcagaatgttaaattatggtggtttaaaagtccctctatgagatacatagaaagacaaattgtcctagacaccttagtaaattgtctgatcta

SEQ ID NO: 126873 - DNA, 532 bp, Homo sapiens
ctaatcctagaagaactccattggcctcccttgggccatgcactcccactgtcttgagcagctggcaggaaaataaatcaataaaaaccatgaattggtaccactataaattcatgcctccaattttaaccaggccctcaacatttcccaaaaaccgtgttttcctctaattaacttactttcccatgagacaatttgaaacattttctactgtattcaaatttcagacatccctttcttttctcttccttccagtaaatgactctgccttctaataaaagagaaaatgtaagacagtagaggaaaaaccacctcaagttctcaccactaaatctacaaaccccggtatataaagcacaattttctcctcctctcttacctgatgggaggaacagtgccactttcaatgctttagagctcatgtcctttcactttttcaggaacctgtccaatttactctctcttccacatcctcagcctcactctttttaccagcatctccctaccagcatgtaaacaatgtagatcctct

SEQ ID NO: 126874 - DNA, 413 bp, Homo sapiens
catccctgcagccgcccttcatccccagtggacctgctgttcttcaaagtgtacaggctgccagtgtggacctgcaaagatgcagtcagtactgctgggttgatctggggagcccctgggtttactgcctgcctggcatcccaggttcagactttcagactctggtagtcaacgtggagcattacccctcttccttcatctagcttcctcttcctgacacccacacacttggccattctacatttgaaatgtctgctgtcgttcttggagcctctgttttcctacctgtaaaatggggtgattggactaaatgcttcttgttgatctaagaccgttggcataaagaaatgaatatgaggcagggtgcggtggctcatgcctgtaattctaggactttgggaggccaaggcggg

SEQ ID NO: 126875 - DNA, 99 bp, Homo sapiens
gaagttttgcagtcctaactcattatctgtgggattagcgacacactgggaaggcaatagccaatacctacagaaggcagagggtaaattgagcttgca

SEQ ID NO: 126876 - DNA, 627 bp, Homo sapiens
tcctgggttcacagctgctaataacttgctttgggacctggaaaaagaatcatttctcttcccacgggttggctttcacagctggaatagaaagggtaattagactgttgtctggataaggcaggaaagaaaattggagccgtgctctccttagcccaataatctaaacacaaaatatgatattggctcaaatgatttgaaaaactcctccaaatttttattttgtgtgtatgttggagacttgattgaacagacaaagtggtcgtcaaagaaaaattgtcaaagcaaaacaaataaaaatgcctgtgaggggataaaacagtgaaaataattggccgagagaagttccaagttagtaagtttctcagagaaagcgagaagagaacgccaagttgtcttggctctgtaatattagttataatataaatttgactaaatttctataagatgttaaatatcactgaaacgtcttaatggagttaatgaggtgataagatagggtacaaaaatgccagctaggtcacacatgaaaagttcatcatcaaagtaggcaaaatataattatattcattctctagcctaggtaatcaattcattagaatcaggtgcctctgaacacaggtgcaa

SEQ ID NO: 126877 - DNA, 787 bp, Homo sapiens
catttcacacaggggcaggacagacccagtgtggagcttccgggtgcccagagtattatgtctcctagctatgatgtgtgacaacaccatggggtatcccccatcagtgacaagcaccaaacccagagtgtccagagatgttatggggtacaggtcacatagacatgactgagcccccatgtgcctaaccttagtctctagcccctccagagtcaagctgatgccacacggcccaaggtgccacactaagtcacatggtcagcatagatcctctctaggaggattttaaaagttgtttacatcctacattcattagggaagacctgggtgttcacctctgtatgactctgctcctttaggaaaccttccgtgacatatttcatgagagctattcatttctgccagcactctgtgctggaaaagcccatccagcctgcacatcccgcacatgtaccttggaacttaaaattttaaaaaaaagaaagcataagaaaaaaagaatgagaagtgaagtgggtgaataaggatgggggagaggtaggatttttgcagagggactagttggtgcaaagacaggcaagagaaacaaacagaaagggagtacttggaaatgggcagatgacacaacaatgggatgcttttctccagaaaataaaatggaaacctgaatttgacccctgtatagaccctaccatcatctaccaaatggcaccactgacatggtatagaatcatccaacagcttactgtttattctggaagaaatgagcatgacttctatttcccct

SEQ ID NO: 126878 - DNA, 1067 bp, Homo sapiens
  misc_feature (660)..(660): n is a, c, g, or t
  misc_feature (662)..(663): n is a, c, g, or t
acagttctaggcacctgaaacttcttcttttgcttgtagtaaatatggtgtctttctcaggactctgccctttgtttatttatatatctggtctggtttttgttttctagagatagttctctactctccatagtgtctgctttctcattgcctgagtttgtacatggcttgccatagcttctctaggcccaattttaggccatcagtagatttaaaaatttttttttctcttgacaccaattaccttagttgcaatttcccatttataattgcaacttgagcctacaaatttacaaatacaatgaggtaactttccactgtggttaaatattatagattattggctgctggtaaacccatgaattgcctgcctttggattagatattcagaccaggtccatttaacaattcagacatttttttaaacaatacttttttgagagtcttccatgtgccaggccctaatcaaagctcttgagatacattgatgaccaaaaagaagcattatccccattcttactccttataatctagggtccaggacaggggagatatgcactgtattaatgaaataatctgtactgaatgtaaaattccaaactgaagcattttatatgaaggaaacattctactaagaatggaagcccagaacgttccagntnnctacacatgctcctggaattttatgggaaaataaaaagtctgtcagaatggatcttttgagaagattccagaagtatgttggccaataagagaaaatgagcaagtggatgccagaagccatttcttccattgttgtgctcagtttgcagtgatactactgcagagcttgaaaggcaagtactggcttctcttcctcttgttcttccacccagaaaaaccatccttatcctcatattcctcctcccctccttctcctgcctcctccgtctcactgaatcaaggtgccaagggcaccaggaccatccatactcccagcctcaccagctacaaggcacaaaatggaagttcaagcaaagccaccccatccacagcaaaagaaaccttttaaaggtcaaatcctatta

SEQ ID NO: 126879 - DNA, 420 bp, Homo sapiens
agaaatgactcagcctgagcactcagatgcaacttccacgttttatggactgaaggtgctttcataacagctggtgatgatgagccagaggcgggctataaacagagcggtgatctggtcctgaacactcaggtctcagcccccacccacaagcagggcctctgaggctgtggcttctccacactggtgctgctttgtgctggcaaatagcacaggcccccaaaatgacctggaggctccttaactgaggaggcagatgagtgacagggccagacctgcagcctcaagggcctggctgtgccctccctagctcccttgggcctgggagccttccatgaacctgtggcctgggaccaagagcatggggggcctagtgatgtgcctggtggggagcggggagtgctgccagcaatgacagtc

SEQ ID NO: 126880 - DNA, 283 bp, Homo sapiens
ttttctaactttaaagggaggaaaagcaaaacaaaaacaagaaccttgatgatgaagcatctgtcatgacatacagagccagaaaaaagtgcaatgtttctctttgagaaccacagctatgagaggagtgtggcttctggggcagtgtaggagaggtacaatcctgaaacttcaaactctttcttcactgtcaaggctaaaataccatgggtgtgtgggcaggtgcatgctggtagatatatatcatttcctggagggcctgctatcactggaatatagagtt

SEQ ID NO: 126881 - DNA, 426 bp, Homo sapiens
ggcagctcaggtttgggggtatctgcacaaggatggctgaggtcaagggccactcgtgaagatcttgccactcaacgtggcccatggagcacagcatgggcatggtcacctgggtgcttgttaggaatgcaggctcccaggcccccagaacctactgaatgagagcctgcctgctggcaagacccccagggactggaacacatggcaaagccggggaagccctgcaccttggagtgtttcagagtcttctccagaatgtgaggggaacactggtgcacccgggatgagccagaggacccatagaggtgcgtcactcactggacacccttcaccatcatcatcatcccacgcagacatggtgcctcgttctgtgggtctggggaaggctgatgtctcagctcaggctgctgaaacaaacacaatcga

SEQ ID NO: 126882 - DNA, 537 bp, Homo sapiens
cactatgttgcccaggctggtctcaaactcctagcctcaagtgattctctctcgcctcagtgtgccaaagtgctaggattacaggtgtgagccacaacacttaaatgcactttttacttaatgatattttcaatttatcatgagtttactgggacataactccattgttaagtcaaggagcatctgtagttctccaactatgtcttgttggtagacatttaagacattaccaattttttgctactacaaacaattctgtggatgtcttcatgtgtacatgtgtagaagtttctccagatcaatggcttttgtatatttttttcttaccatggctcagacttagaaatatgctttagatcataaccccatacacataaaattgaaacaaatctcatgaagaaaaaacacttaatgatgctacatgcaattgcgccagttaccaatttattgcccctcaaaactaaactcacctttctttgccctggttagtaatacctgagttggggcctgtgatggttactattatgtgtcaacttg

SEQ ID NO: 126883 - DNA, 255 bp, Homo sapiens
cctagacatgtcctagtgctgagctgggcttggagccagtggacttgggggcacgctacctactgagacacaaatggaggtggctaagggagtgcttgtactaccccttccccaaccccagggaacgcagctcctgactccaaaagagacccttccttcctcttggggagaggagggagaagagtaaagaggactttgtcttgcattgaagtcctctttgatgagtggggattcctagctcccagaaaccatttt

SEQ ID NO: 126884 - DNA, 368 bp, Homo sapiens
ttttttttaaaaatatgtgatactggtgcttgacaaaatacagatttaactggagaactatagagctgtggctagagacctaagagggactttgaaaattaccaggcgatggccgggcgcagtggctcacacctgtaatcccagaactttgagaggccgaggtggatggatcacctgaggtcaggagttccagaccagcctgacaacatggagaaactccgtctctacaggcacatgcctgtaatcccagctacttggcaggctgaggcaggagaatcgtttgaacccaggaggcggaggttgcggtgagccgaggagatggcaccattgcactccagcctgggcaacaagagcgaaactcttgactc

SEQ ID NO: 126885 - DNA, 589 bp, Homo sapiens
ggcttcacttctttgcatggcaatgcctttctccctgttttcaggtttccacatcctgtgtaccatccattctttcagggagcatctactgaggacttataatatgtccaacactataaaaggtcaaggagatacaaagatgaataaggagtggaccttactctcaaaggaccaggaggctgagagacaaagaaaagatgatgattttgatgatggtgatgatgatgatgatgtgcagggaatatgcacaatgataatagatctatacagaatattaagagcagagagagggacacatagtctgtgttccaagtctcagcttaatacccctctgctttaagtttcttctaactcctctgtagtcaaaataaccttttcttgtctccttgagtttccttagcacaaatttactactttttttaatacataggtgcatacatatatatttatatctctctcctgttagacttctaattctggaaaaggatatacagattaaattagtagttttcaaccagaggcagttttctctcctacggaacatttgacaatatctcggagacaattttggttgtcataactgagaggg

SEQ ID NO: 126886 - DNA, 170 bp, Homo sapiens
ctatccatgtcaacaagtgcggtgctaagctttaaaaaattcaaagagaataagacccgaggccctcaggggtgcacaggtaaacaaacaagtaacagaacaggcaccatggctgaagcccatgctggacaccaaaacagggagtggacaaggccacatggggaagctag

SEQ ID NO: 126887 - DNA, 753 bp, Homo sapiens
gggcagaatttggaaacaggaatccaggctgacagatgaagttgtcctggattctatctcaatctggggaattcaaaaagtgggtcacacagagaccataaagaatcacacagtgcagccatatttgcaggcagcagtttgtcattgaggtagtggaagaaaagatggaatttacaattataaacagtctcatagccattttttacattgcttagaaagatgtaaaagctaaacaaactcacatacaaaaactcaggttaaagaaaaattcctgctcgcctgaaatatatccctgatctcttctttgtaagtgtttcagaaaaaaacttatttccttcaaaggtaagtaatttagaaggaaactagcacaaaagtaaaagcacaggcaataaaagcaaaaactggcaaatagggttagatcaaaatgaaaagtttctgtacaacaaaaaaacaacagagtgaagaaacaacctatagattagaagaaaatatgtgcaagccatacatctgataagggattaatatccaaaatatataagtaactgaaacaactctatagagagaaaacaaataattcaattttttaaaataggcaaatgacctgaacggacatttctcaaaagaagacaaacaaatggccaacaggtacatgaaaaatgctcaacatcattaacccttgaggaaatgcaagttaaaactacaatgagatatctcacacctgtctgtatggctattacaaaaaagacaaaagat

SEQ ID NO: 126888 - DNA, 267 bp, Homo sapiens
atcttggccaggctggtcttgaactcctgaccttgtgatccgcctgcctcggcctcccaaagtgctgggattacagacgtgagccaccgcacccagccaggactacccctctctttaaggacccttcccagaagtcacacacgatacttccaggtaaatcttagtcactctgtcacccctagctgctagagtggctggaaaatgtagcccttattttgggtggttatgtgaccagccaaaagtaagggatggtacgactcatgaaga

SEQ ID NO: 126889 - DNA, 119 bp, Homo sapiens
gggaggggactgaaagtactagtggggagaaattaaaggggattcaaacattttaccttatatactgattgtttgaaacttttacaacaaatatctattctaaagtatttacctgcctt

SEQ ID NO: 126890 - DNA, 208 bp, Homo sapiens
ggtctacatttttagctgtgtggctttaggccatttccttgacctctctgtgcctgggtttcctcatctgtaaaatggagaggatcatagcgtctatctcgtagggtggctgtgataatcaaatgacttaatagtaaagtgcttaggtcagtgcctgccacatgagtacttttaaatgtggctgttatttttgattcatcccacgaat

SEQ ID NO: 126891 - DNA, 436 bp, Homo sapiens
gctcatattccatggcatggatggaccgcactttgtggattcatttgtgtattaatggacagtgccgttgtttccggctttgggctgttgtgagtaatcctgctgtgaatgtggatgtgagggtgtccacccacatccctggatatgtccctggggcggaatcgccacatcgaccgtaattctcttatctcttggctgtttgattacagccatcccagtggatgtgagtggatctcaatgtggttttagcatgcatctccctaacaactagtgatgttgaacatcttttaatggcttattggccatttgtatatcaacttgagcaaaacagacatttcaagtcccttgcccatttctgaagtgggctgtttgtattttttgttgttgaattctaagagttctttatatattctgaatactactcccttatcagcta

SEQ ID NO: 126892 - DNA, 908 bp, Homo sapiens
accaacatttcctcaatacccactttctacaaccccagacccagtcagtcaccattctgctctctgcttctatgagttcaactctcctagagtccacatttaagtgagatcatgtagtttttgtgtttctgtgcctggcttatttcacttaacataatatcttcaaggtttatccatgtgattgcaaatggcaagactcccttttttaaggctgaatagcatccattcatctgttgatgaacacttaggttgaatccatatcttggttattgtgaacagtgctcaatgaacataggggtgcagatatcccaccaacatactttcctttgctggatcatatggtagatctgttttttgaggaaccttcatactgcttttcacactaacttacattcccagcaaccgtatataacagttcctttactttccacacttattcatctttttgataatagccatcctaataggtgtcaggtgatatcttattagagttttaatttgaatttccctgatgattaatgatgttgagcatgtttttttcatatacctgtttggtcatttatatgtgtttttttgagaaatatctattcaggttcttttgcactccagcctgggagacagagcgagactctgccaaaaaaaaacaaacaaaaccacacaaactttttgcgcgccgataggccctctaaaaagctttttaaacgccttggttaggggccgcgagccccacgagtgtgaacgacgacaccggcgcaagaagcgggtcaccaacagggaccacgtagcagaacaagacggcgagagatcccacacataaaactgtcccgggggacaccacgagtctgcgaaaacccagagggactcaaggcacaaggggacgtacaacgggctcaacgacataatgtagt

SEQ ID NO: 126893 - DNA, 565 bp, Homo sapiens
tctgtaaacttaacttgttaactaaaggggacaaatgcgagtggtttccaagtgaaaattacatagctccagggtgttacagaaaatctgttttaactaagtcatgtgttgaatcgtatcttcgtacctttctgtgctgtattttactcttaccgtacagtgcctcgcagtgattgaaatggatttgtatttgtcttcaatcgttgtgacctaaggaattatgctcagttgtataaccttgtccataatatctaagtaagatttcatgcgtaggactgctttctttgatagttgcaataaattacccaaaattttgattgttatagagttaggtttagtatagtcgtggtatccaagtagaatattggtgattctgaaaacaattatatatagaacttaagtctatgtaacagaattttattctttcataatatatcaattctatgtgaattgggtcttgttgctttgatatttatttacagttacagtacatgagttataatactgattattttctgtatgattttctcttactaagttcctctgtttgccacaagaagttttt

SEQ ID NO: 126894 - DNA, 684 bp, Homo sapiens
  misc_feature (667)..(667): n is a, c, g, or t
ataaacagaagaaattctcttattgtcttcaatttttatttaaaaacctattatacaggccaggcgcgatggctcatgcctgtaatcccaaagtgctggaattacaggtgtgagccaccgtgcctggcctgatttgagactttttaatgtattcacggtaggttagagtacaaggtgcatcattttagactgtcttagataaagaaattctgtattggataatatccttttccataaaatctgtcgttgctgctacacagtaagtcctcctcatcatcgtaggttcttggaaactgcgactttaagcaaaacaaggtacaacaaaaccaattttaccgtaggctaatggatataaacaagagttcaagttcatatgcatatttctggtcatagaaacatcaccaaactatcaaaaaaagaccaaaaacacttctaataataaaaacgaaatcacaaacaccacattgtgggggggcccccacggcacccggagaaaaaagttttgtagaacccatgtgtgggggccgggccccgaagttagctggcaagtgtcaaagaccgcttgcgagagacaccgggtccggaacaggcgggctttcaccataaaaggccggggaacggggtcggaaaaatcagggagttgggaggcaaggtcacaggatcaggncgaaagaccccggggga

SEQ ID NO: 126895 - DNA, 665 bp, Homo sapiens
  misc_feature (648)..(648): n is a, c, g, or t
cgggatttcaccatcttggccaggctggtcttgaactcctgaccttgtgatccacccgactcagcctcccaaagtgctggaattacaggtgtgagccaccgtgcctggcctgatttgagactttttaatgtattcacggtaggttagagtacaaggtgcatcattttagactgtcttagataaagaaattctgtattggataatatccttttccataaaatctgtcgttgctgctacacagtaagtcctcctcatcatcgtaggttcttggaaactgcgactttaagcaaaacaaggtacaacaaaaccaattttaccgtaggctaatggatataaacaagagttcaagttcatatgcatatttctggtcatagaaacatcaccaaactatcaaaaaaagaccaaaaacacttctaataataaaaacgaaatcacaaacaccacattgtgggggggcccccacggcacccggagaaaaaagttttgtagaacccatgtgtgggggccgggccccgaagttagctggcaagtgtcaaagaccgcttgcgagagacaccgggtccggaacaggcgggctttcaccataaaaggccggggaacggggtcggaaaaatcagggagttgggaggcaaggtcacaggatcaggncgaaagaccccggggga

SEQ ID NO: 126896 - DNA, 701 bp, Homo sapiens
cattggaaacgggctatggcagaaaagtcagagagggtgtgttaagaaagtacgcctgcatgtataaatcaaagtctgagtttgagtgacgcgtacacaaacagtggtggtttcggtggcaggttgagaactcgccattgtaaagtaagagagccattcccttagctggtgatttctccttgtgtgtttctgagcacttttattgcattcacacatctactagtttttgtacgaagagtgcctcagatcattacactgcggctgtataagagacctggtttggagggatttgaaggacacatggaatagtgaattcatgtccaaagaggcaccgggctttctgaaggaagtattcgtctgagcttttgatgatgggggcatgagagttggatatttgtgagttttctagtgaatgctagtgaactcagaccagggattgcagattcagatgtctgtaggccatggtaatcatgtatgtagataaagccagagaggtgagacactgttaagttcaaggcaaaacacacgtgtgtgtgtatgccagaatctgcatagagtagaacaatcttgtgaccttgtaacattgcattattccatgtaggttcttgcgcgtgagtgtgtatgtgtgtacgtgtgtgttgccttgaacttggcactatttcatctttccttttataaacaaagtatatgagagtttccaa

SEQ ID NO: 126897 - DNA, 392 bp, Homo sapiens
ggtattaatagcattttacaaatgaggaaacagactcagaaaagttgagtaactggctcaagtcacatagctagtagtagagctaagtttagattcctgtgtctatgtgattccataatatgtgtttttctaccatgtcatgctgccaccagcctctttgacctgcttactgtaggctgtggcagagaacttcatcctttcggagcctcagttttcccatctctaaaatgagggttattctgtatttcctcatgtggatgttatgaggatagtgaaaagaaatgtaaaagcaacatagtgagaccttaaaaatatgtgatagagctgggcatggtgactcatgcctgtagttcctagcactttgggttactgaggtgggtggatcactgtca

SEQ ID NO: 126898 - DNA, 302 bp, Homo sapiens
ctaatacaatattagagtaatgtaataactcactcacagtgggcatacacttaagttttcaagtattagaagcatcaaatatatcaactttggaaaaccaaatagttaaagggcattttcaatgaagaggaatcattgtgcaatttaaaaggcaggggcttcacttctctaagcttccatttcttcaacagtaaggataattatatgttgccctagtaatatggctcttggcagggcaaggactgggagcctgggaggccaggggagctctgatatgtagcatttcccatttctgcagtgta

SEQ ID NO: 126899 - DNA, 230 bp, Homo sapiens
tctcacgtgcacactagagtcagctcaaaggatcttctattccccgctgattccgccatgggaattctctcatataccttttagaagaggttccatgataaactgaggcacagggagatgatatgacttgcctgagtcacatagctattaagtggcagtagtaccattctgacgctagggtcttactatgaaacttctgtggcagtttgggtgaatgatgatgtaatctt

SEQ ID NO: 126900 - DNA, 518 bp, Homo sapiens
caaataaataaataaataaaagtgtataaatttgtttcatttctgcagttgcactagttacatttctagcactcggtagctctaccggctgccatactgaacaatctgcattggcagattaagaagtttcatcatcacagaaagttcaactgggcagtgctgtttcggaaggtcccttgggcactgggcctctgctgctcattagcggaccctttctttgttggctttttttcctttccctgcctccctctcttacccatgcttcctggcatctcctcccatgtaaaagttctgcacctacagcattgtcttaaggtaagaagaacctcagcgagtgcattgagtgatattggtgtgaggtgggggcagctggggtggctccaaggcacagtggccctgccagctgttcccacccaaaaccatcaccatgaaggagctgagggactgtgttcctgccgtcacctctccaaaagtgacaggtaaagggatgggcagagattgcacaggaaggtcaacaa

SEQ ID NO: 126901 - DNA, 386 bp, Homo sapiens
agcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttg

SEQ ID NO: 126902 - DNA, 384 bp, Homo sapiens
ggtggctgggtgaggagttctgggatgatcacaaagactgtttaagacatcttctcaaactttaaggagcacacaaatcacctgggtattgtggcaaatgcagattctactgcagcagacctggagtctcatttctgacaagctcccagggggtaccaaggctctccatcctccaatcacactcactccgaacggcaatgatgaaggccatgacaaggagtttggattttattttaagtgaggcaggaaagaagctattgaagggcttttgaaaagtgagtaataggaacccagttatattttgggttttttgtttttgtttttgttttttgacacggagtctcactctgtctcccaggctggagtgcagtggcacgaccttgg

SEQ ID NO: 126903 - DNA, 719 bp, Homo sapiens
gattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttc

SEQ ID NO: 126904 - DNA, 615 bp, Homo sapiens
caatgatttacagttttcatgcatgctttttgcctccttggttaagtttattactaagcattttattctttttgatgctattgtatatggaattttttttatttcttttttgaattgttcattgttagtgtatagaaatgctaatttttgtgtgttgatttcgcatcttgcaacatcactgaatttgtttattaattctaacagctttttttggtggaatctttggaggtttctacatataaaataatgtcaatggagataattttacttcttcctttccagtttggatgacttttatttctttttgttgccaattgctctgactagaactttcagttctatgttgaatacaagtggtaaaagtggatatccttgtcttattcctgatttcagaggaaaagcttttagtttttagccattgagtctgataataggtgtggaattttttatatatgatctctattatgtcacactttaaaaaaatctatgaaagtatcaaaagatggataaatatttacgtatttatacataaatataaataaacatttatatcatttgggggaaaagaatcttaataaccaaagccaaaaattataagggaaagaaaaagatgat

SEQ ID NO: 126905 - DNA, 389 bp, Homo sapiens
tcggacctctccctactgtatcctaccagcagtggcttggcagcggggcaaggagggctcatgggtctccgtgtgcttctcaggccctgctggtaggatttgttcatcttgccatgacctttgcggtgcccctgggatgcattcccagttgtacttagtagaggaaaaggtgtttgagggtgtagggcccccaaagttcgaggaggcatgaaaggacggagctgggggatgggagggttgaaaaggacaacctcctccttcttctgagcctctaattccttttggctgcgcgtggaggctcgcacatgtaatcccagagttttgggaggcccaggtagaggatcacataaggccaggagtttgagaccagcctaggcaacatggtgaga

SEQ ID NO: 126906 - DNA, 420 bp, Homo sapiens
taatcgagctcggtcccgggttcctccctatgtcactcagagtaaaagctaaagcctaccaatggtcccaagaggtctcacagttcccctctgaccacaccttgtacaactctcttcctcattgatcccagctgcagtagtctctgctgtcctttaactcatcaaacatattgtcacctgcgggcctttgccagggtctatgtagctaatttcctcaccttctcccaagtgtgatgccaccttcttaatagggcctacctccctccaaacctggcactcctgattagtttatcctgtgttgactatcttttttttttttggggcatttacgacccttttttttttaaccttccttttttttaggacttttccccttctttccccctttgggattcccgttccacttgggcggggacccgg

SEQ ID NO: 126907 - DNA, 427 bp, Homo sapiens
ttgtttatgaaaattcaacattgtaattaaaagctatggaaaaatctggatttgagagcatagggaaggtctgaacctttgcctataatactttcagtaagaactttctttttctagatcaagatttgagaccctgccgggcgcggtggctcacgcctgtaatcccagcactttggaaggccaaggcgggcggatcacgaggtcaggagatcgagaccatcctggctaacacggtgaaaccccgtctctactaaaaatacaaaaaaattagccgggcatggtggcaggcgcctgtagtcccggctactcgggaggctgaggcgagagaatggcttgaatcggggaggcagagcttgcagtgagccgagattgcgccactgcactccagcctgggcaacaaacagcaagactccgtctcaaaaaaaaa

SEQ ID NO: 126908 - DNA, 688 bp, Homo sapiens
aacaaggcagaggatgaaggatgggtcttgggagggcaaacagaataacctacacacctccttattactatatggccagttcttgtttgtttacctggtacatagaaaatgtttaaagatatttgttgggtataagaatgaatagcatagacattaaatgtaattaatgtaagcaagattaggctgcatttcttattcttttaggaaattattttacttcaacaacttgtcttgttgctgaatatgattgtgagagtcttttagctatttatattaaatgtttcagaaaccacattttgaattcctgtgaagaacactaagaagtatagtaattggggatgcaattgtgagagagatcatattggtatgaaagaaaaaatgaggtggctcatttgaacatgtttgttgggtagataagtgaagaagatgagtcacaaattgtaattcatgacatgcagttacaacacgatgactcagcttatcactggcataggtattgggtggagtgtcagctggggcaaaacagtaggagatcatgtggctatggtattgattacgatggcgatgatgatgacaaagattgtgaggtgggctgaccatctctgtgttgtaaaacttatttaaaaaaagataagcttggtactcttaaaacaaagcatggagagactatcagaaagttttaatgaat

SEQ ID NO: 126909 - DNA, 607 bp, Homo sapiens
gatgagtaaatgggaccaatggacaccaacagtctcctcctaaatggatagcaagaaattgccaggtccagattccatgtggcactgagggcttccagaaggacaggactgtaagaaacttattaatagatgagttgtcagaagcctcagaaagcgagcgagggagggaagagtgagggaggctgagaggaaaaagagcagaaaagtaactaggaataaaaaacaaaaggggtccagtcctggggactcatggctgtaattccaacactcagagagactcaggagggagggtcacttgagctcatgagttgaagaccagcctgggcaacatagtgagactctgtctcatttaaaaaaaaaaaaaaaaaaaaaaaggagaaggtagtgaaaaagaatccatgtataaaatgacaaacagtagtacaaaatttagattttcttcaacatcttcccatatcttccccctttagaatacacacatttttgagtctctcccatctttaaaaaccctaccccttttgaacctgttgccttatttccagccaagctgttgaaagagaagccaggatctgcaggtctccacactttcccacctggccatggtgcc

SEQ ID NO: 126910 - DNA, 1178 bp, Homo sapiens
ggtgctgaaggaaaagggtagagacttttcaccatatactctttatatctcttgaactttgtgccatagttaaaaacaaatgaagaaataaaattcagattttagaaacctatcttatgggattatcatgaggattaaatgagtcatgtatataatctaatgcattgtctggcatgtagttaagtatataatacttactaaatatgatacttactagccgttgtttgtcccttcccctccagttccataattgctgtttggagggttcacaggatttattttcttcacctaggccaaggattgttaacctgaatggatcaatgaacctttgaaattgcaaattttgtataagcatatgcttattccagactttccagattctagagagaagagggtctgtgactttaatcagatttgctaaggaagggaaggtcccatggccctaaaaagttaaaacacactaacctaagctgttttgctattttatgtttctttccaccagaaaatactctgctgtcagatcgttttctctttacagctaggaagagactctggctgacttttattcctcataacttttatcttttctaaatatatcatgtctaggcaagtaatttaaactttctaggtctcaacttcttaactgtaaaaagaagtgattgatctggacaaattcaaaggttcccttcatcttgaaaatgttttgattctatctaggtttactctgtatgggctttaaaaattagaaatattgtcataaaccaagaaaaacccttatgctaagaataatctttaggtagagacctaaatcttgactgagggataaaattggaggtttgtatatacaaatataagaacttatgtcaggccgggcatggtggcttatgtctgtaatcccagcacttgggaaggctgaggcgagagaatcacctgaggtcagttcgagactagcctggccaacatggtgaaaccccatctctaccaaaaaaaaaaaaaaaaaaaacccacaaaaattagccaggcgtggtggcacatgcctgtaatcccagctactcaggaggctgagtgaggcaggagaattgcttgaacccgggaagcggaggttgtagtgagctgagatggcatcattgcattccagcctgggcaacaatgcaagactctgtttcaaaaaaaaaaaa

SEQ ID NO: 126911 - DNA, 322 bp, Homo sapiens
gttagccaggatggtctcaatcttctgacctcgtgatccacccgcctcggcttcccaaagtgctgggattacaagcatgtgccaccgcgcccggcctacccttttcattttatctgaattttacatgtctgaatataacttggttattatctgaatataactcagttatatttccaaaggcaggcactactatcatctgcaatctgcagatcatgaaactgagccgtaaagaggtgaaggaactgcccagagtcacacactttggaaacagcagaaacgggcttcaagcccaggcgatctgcccttagttactgtgtcacac

SEQ ID NO: 126912 - DNA, 682 bp, Homo sapiens
gatagaaaacgtttggcttctataataagaggatatgcttaggtcctaattcctttagagaaagttatccattaatactgataataaaggggggaaaggcataagccaaaggaattgttttaaagttagaaatgaaaagctaaatgccacatttcttgcttcacagtataaacttccacttcaaaataagcttcgtgtaagcaccttgaaaagggaaatacatggttaatcatcaaaacaagtatattatcatagtaaaaacagaactagaacaggcagtatcaaactccctcggagctaagaaaaacagaattagatatttaaaatcacaaggaaataaatttaggcattctgtagttttataaaagttgtcctacatgttagactgattaatatcctgtaagaatagatgagtgctatagtttgcaatattaacgaattagctggcgtcaggtgtttgaattttacaagttttaaagcttaccaagctatggtgatttgttggctaaagtcaatgatgacaaaaggtaatggccattctaaggttacacagattccaatctctgtatgtgcagcatgtatgtatatagatccacacctcttcaaatgcttaacaagaggaagtgccatgtgtcagcagaagtaatcatatacacaaaccaatttttataagccaattaaa

SEQ ID NO: 126913 - DNA, 302 bp, Homo sapiens
caccatgttggccaggctggtctcaaattcccagcctcaagtgatctgcctgccttggcctcccaaagtgctgagattacaggtgtgagccaccacacctggccaaatctgcagttcttgaaggagggcccagagcaccacagttaaatagaagtataatgtgggctacgtatatattttaaaatttttctagtagctgcattatttatttatttattttttttttgagacagagtctcgctttgtcgccgaggctggagtgcagtggcgtgagccaccgtgcctggctgtagctgcatttt

SEQ ID NO: 126914 - DNA, 265 bp, Homo sapiens
taagtgataagattgtgatttaaaataccttattcacagaagaggtgaagtacattttttagataaactgaattttcatactgcaaagctattggaaaagttaaattgagttataaaattttaaaggggagcacgtggccattgaaaatcaagccttgttttgccgtgtactgaatatggctttcttgaaaaatattttaaaatagagcacttccacacgcttcaaaacatggtcagttcttggtcatatgaagaattggaggat

SEQ ID NO: 126915 - DNA, 354 bp, Homo sapiens
tgggaggccgagacaggaggatcacttgaggccgggagtttgagaccagtctgggcaacatagcaagaccccatctctaaaaaaaaaaaacaaaaaacaaacaaaaaaaaggcttagctaatgctgagacagagagacactgttcctcccagtctgcaaggcttcagatgcagaaaataacatatacttaatccagtcagaaagccttcctggtagtggcaagactgaagcaggatatcgggggatttacacaaccccagcccaccagcctcaaaccggaagcccaaagcccagggaagctcctgagtgccacctccagcctccctgtgaggggctgacgccgataccaacctt

SEQ ID NO: 126916 - DNA, 495 bp, Homo sapiens
agattttcagaaatttaaaactcctaatgaagaaacacaaacctgcacgtctcacgccaccacttaaggcagcggctctcaagcaggggcgattctactgggaggagggatgctgatggcaccagagggtgggaagcagggatctgacgcttagcaccgcaggtgccaaggacggcctcctccccacaagggctccgggaggccacaccagagggtgggaggcaggggtgacgctcagcactgcaggcaccgaggacagcctcctcccaggaggaaaaaacaaagacgggaaaaaacaaaggctccccacaagggctccagggggccacaccagagggtgggaggcaggggtgacactcagcaccgcaggcaccgaggacggcctcccacaaaggctcctctgggccagagcatccgtagtgccaaggggaaaagcccggacacaaaggatccagtgttttcaacgttgctcagggtatctccacacagaaactc

SEQ ID NO: 126917 - DNA, 272 bp, Homo sapiens
gcaaagagcttggctaaactgtatccatgcccaagggctttgtggaaggctgaagttgagagtgatgaactagggtatctggcaggcagaagacatttctaagcagcaaaatgctgaggctgctgtgtggttgcttctaactgcttaagatgatctcacagagaaaagaaacagagtggaaacatttggaaaattctcagcctggccatgtggtagagaatgaaagagcattttcaggagatgaatccaagggcgtggataagccacttctt

SEQ ID NO: 126918 - DNA, 684 bp, Homo sapiens
gcttacaaaaacatattaaaaaacagaaatgcctggtttgtaaatacttccagaggaagttttggattcctcgtcttcagaacgttttagtctgtaacttttcagaattataatcctggaaggaagaaagaatacacttaggaaactccttctaagtttccttttaaattttctatacttctaatttttagagtaaggaagagtcaagttgatataatgagaatggaagtttgcaaagtagttgtcttcttagtggaaatacttaatatggaacctgtagagttgccttatattcgcattgcaattacaaattgaatatattaaatttaaaaagatttttgttcattgggcaatgattaccaaattaaatataatttatatttactttgaaaatagactttgttttagcttattttaagtatttttcttataatctttatcttttaaattatgtaaaactaaagaactggagacttaggagataatcagcagaagagatacagaattctaatagtgcttttcagtgaaattctagcagcattgtggttttataatgaaataaaagaacaaacctttaaaaacccagttttctactaactcgctctatattttttcaaactttaaaataagatttttttgtgtattgtacttgaaatctttaagttaaatctttttaaaatgacc

SEQ ID NO: 126919 - DNA, 425 bp, Homo sapiens
aggaggctgaggcaggagaatcgcttgaacctgggaggcaggggttgcagtgagcagagatcataccattgcactccagtctgggcaacagagcaagactctgtctcaaaaaataaataaataaatcacactaatgtaaagataatagtaataggggaacttgggatatatgggaactctgtgtactgtctttgcaagttttctgtaaatctaaaactattctaaaataaagcttatttttaaaaagtctattataagccaggtgtagtggctaatgcctacaatccaagcattttgggaggccaaagtaggaagatcacttgagcctaggattttgagaccagcctggccaacataggaagaccctttctctacaaaacaaaaaattagccaggcgtggtggtgcacacctgtgatcccagcta

SEQ ID NO: 126920 - DNA, 480 bp, Homo sapiens
gattgtgccactgtactccagcctggcgacagagtgagaccccatcttgaaaataaataaataaataaaaaataaatgttagcggaacaagtgaaattagggttggtaaaaacgagtgttgagctgtttctcacatcacacgcaaaaaattagcctgaagcgaatcataaacctaaaagtaaaagcggagactataatgtttgtacaactgtgctgtttgatatggtaaccactagccacatgtggctactgagcacttgaaatgtcctacatttagtgagaaaataatataaaaatctaagtaattaatatttaaaattgattacatgtttccatgtaacggcataatactcatcaatatataataacaatatataatacatgcaatagcttgaataaattttgaaaacatcttgagtcaaagaagccagatgcaaaagaatacatgctctgtagtttcacttatatgaagttcaagaa

SEQ ID NO: 126921 - DNA, 766 bp, Homo sapiens
ccagatctaatcatttaagaacatggaagtcgtaagaggaaacatcaggaaagtagagaaagatatttgagtagatttgatggatactggattttatgatattcaatactaacctctaagttgtattttttaatataaataataataaaaggaatgagaaacctcttctagaaaaaagaatgctttggataatatttatgcaaaattttccaaatcaaacaactgctgaaaagtattatgattttctgtaattgtaaacagtttacaatttgctcttttttgactttggcacattaccactatatatttttaatttaatcatcctgtctcctattctaagacctacttttatcattttataaaacatggcaaattttttggcacctgaagtccttacacatttttcatcttttcactgatgactttataaaatgtagaaaaatacagaagtaatgaagtgatttatttatttcaatatttaacccaacttattttaattttgttatttaagtctgtaacagtggatgagatctcctaaaaatagaatgaatatttgtcaggtatttacagatcactgctcctgtcctcaagaagtttaccaactagtagggaagactgacataaatgatttcaaatgaacatatttggtactatagttgggatgtggacaggtagtgtggaaacttaaggagaggcacctagctcccctctgggctgctgtgagtcaatagagaaaattgtgcaggtgttggcaagccaaataaga

SEQ ID NO: 126922 - DNA, 517 bp, Homo sapiens
aaaccaggctgccactgaatgagccaggtgattcctcggctgttggagctggaagggccagacaagctttcctggtctagcctgggcatttgaggaatccggaagctgaaacccagagaggtggagtgactcaccccagggctcagatcccatgaggtgcttagccaaagccagcagcccccctggcaacctcttaactcatcttcttggtttgtttttttctctataacagcaccccaaatgaactttagtgcctgtcatttagagtagaatgctgtctagcttaaaaccctccacagcttcctgtctcactcaggagacagtcttcactgtgaggcctgcggccatggccacccccatgcccacacccacttctccaggtcccctttgaacccacctccccctgtgcattgggctcttgctactccgccttgcccctctctgtctctagaacacgcctgcaggccctgcctctgggcctttgaccctgcccccctctctgcccagtgtgctctcg

SEQ ID NO: 126923 - DNA, 951 bp, Homo sapiens
ttgtgccactgcactccagcctagttgacagagtgagaccctgtctcaaaaaataaaaatatcctaactttagtttgtgttccttgctgttctcttgtccttagatatacctcactaaagcagtactgttggcactgtgcgcaaaagtgaaataactgtttttactgtggttattttgccactttggttattaatattattagttttccatttatttttattcagtttattgttttcagtttatccaatttataaagggcttttttccctttataaattacagggagaaaatgagaacccctgtgcatggctggtgggaatgtgaaatggtgtagccactatggaaaacagtatggcagttcctcagacattaaacacagagttagcatgtgatctgcagttccacctctgcgtatatacccaaaagaactcaaagcagggacacgaacagatatttgcatacctgtgttcacagcagcattattcaccatggggaaaagggggaagcaacccaaatgttcattgacagatgaatagataagcaacgtgagatgtctatataacagaatattatttaacctcaaaaaggaaggaaattctgacccatgctacaaaatggatgaacctgaggactttatgctaagtaaaagaagccagatgcaaaaagacaaacactagaatttcactcataggaggtaccagtcaagttcacagaaagtagaatggtggttattggggggtgtggggtatgaattctggggaatgaatcgtggggttagtgtttaatgggaacaatctcagtctgggaaggtagaaaaagtcctggggatggatggtggtgctgataacacaacagtgtgaatatatttaatgctgctgaactgtacacttaaaaatggttaagatggtaaatgtcatgtatattttaccacaataaaaaacatgaaaaac

SEQ ID NO: 126924 - DNA, 886 bp, Homo sapiens
tcactccatggtcccacacccctcattcactggcatacaaccagcaatcttcctgtccctacctccccacacatgtgtacacacataaggagcaatggcaaaggagaaagggaaagagttaatgttctagactttccacattcacaactcacatccccccatatacagatgctccactttagaatggggatgccggacatcccccatccctctctgtcgtatcactgagacgcctaccacacagtattatattaaatgtccctccccatccttccacaagtgcattcagtgttttcaaatgaagccttcactggtgcattccatgtagattccatttctggccttctgcatctccctggtactcaaagaattctccctgtcataatgcccctggcattctataatgtgtcaaccctggaccagctttttatgtaacccagagctcctcaggaaggactgttcctctacttgtccatccccctcccctggctctcttactggaagttgtgcctgtcttaatgtcctgcattactccatgatacagagacaccttcgtgcacaggggccactacctacataggctctgtcactgacccgatcatctctctgtcatcactaatatcgccaatgctgtctacatcactacccctgcctctttagcctgatacccttgtacatgtccccagtgacggcgtgaacatacaggccatctctggatggctatatctcactgcctgttcccactacccctccatagccaccaacctcaatgctatcacttctctctcacacagattacctattagccctcatggatttcagcaaccctgcctcctcttcacaaagctgtacgacagcctgcttggccatgacttaactgccccta

SEQ ID NO: 126925 - DNA, 209 bp, Homo sapiens
ttttggtaatttgctctaacagccacaggaaagtaacatacatgcctacctgggtccagttgtgtcctgtgactcctgctttcctgggacaggcaggctgctccgtgcctcctggccatcctactgggtgctggacgctgtaggctgctccatgcctgttggccattccctttggtgctggacagcactcacattgtgaaatccactgg

SEQ ID NO: 126926 - DNA, 580 bp, Homo sapiens
ttcctttctgattttgccgtcgtctcatttggttcaaaacatcaaactgcagcatatatggagttgtaaagggtccattaatatagatgttctagtcaccagctaatgcagatggaaagggaaatacagggccacagaaggagattgaaaagcaccggcctaagcaactttggaaaatggacacacccatattcacaccaccacaaccgaagaatagagtgttcctatcacccggaaaagttccttcattctcttttgcagccaatcaccctcattcaacccctggctctcagcaaccactgatctaatttgagttgccatagattattttgcttattttggaatttcatctcagggaaccatactgtgtgcattctttcatgtctggcttcttttgattagcttagtttgtttttttgtttgtttgtttagactcatccaagagtagtggctaatcttatattttatttatttttatcactgagtaatatctccttatatgaatatattaataagtcaacatttaataatgcattcactttttgatgggtgtttaaattgtttccaatgtggggcaatt

SEQ ID NO: 126927 - DNA, 129 bp, Homo sapiens
gcaccttacccatacgaatgcattcaatcctcacaacaacccagtgagttagggaatattatccccattttacaaaatagtaaaatgaggcagagagagagcttaggaactagtgaaaagtcacacagc

SEQ ID NO: 126928 - DNA, 474 bp, Homo sapiens
tggagggcttgggggactatgaagagtacctttaataaaaggtctatctaggagtccagtaatactgcagatactgcagtgtgtgtgtgtgtgtgtgtgtgtgtgtgtgtgtgtgtgtctgtgtgtgtgtgctctaagagcaaactgtagctgcttggtgggttgggctggagctggaacctggaccacggcactcccctcattctccatctgtgtcattttcgtcctttttcttgccaatggcttagtttaagcccctgcagcctgaaggctttaggtgagacttctgagaaagcttttttccagtaaggcccaagcttgagcagagacacaaaagggcacccagtggagctgcttgtgagggtgtggctggagctcagctcatttctgcctgagactagggaatggccaagttgggagcatcaataccctccctcgcttcaccagcccagactcgcccatggttcacagaca

SEQ ID NO: 126929 - DNA, 479 bp, Homo sapiens
aacgcttaaaacatcacttaatctgctaatacactttaatatacttaaagagtatcatgaaaacaaatttcagctgtatgtaactgtaagtaataagaaaaaaaaatttaaaatgccaatcatcgttatgaattaccctggaatttaacccaaattctctagttattccataacagtctggaattttgaaaagcagagagtcttttttgtttttaatatgaattctaatgtgacttttatcaagttctttaatgtttttgagccttggtttaatcttctgtgtatctacatagtacacagcatacatacagtacataggcactataataggttttaggtgaggtagtgcatgtaaaacattttgaaaagctgcttatacaccgtaaatgtatacttaacattggtgaatagtagcttttttttttttttttttagctaccattaactcttaatttttcttgagacggagtctcgctctg

SEQ ID NO: 126930 - DNA, 671 bp, Homo sapiens
ggatattttgtttcatttttctaattcctttttctctttgtatttccatcttggaaatttatattggcatatcttcaagctcactgattctttccttggctaggtccagtctattgatgtgcccatcaaaggaattctttatttctcttatggtgtttctgatttctagcatttccttttgattttttttcttagagtgtccatctgcctgcttgcttcacctatccatttttgcatattgtccactttttccattagagcccttagcatattaacagtagttaatctaaagtcctgatctgataatttcaaaatatctgccatatctaagtcaggttctgatgctcactctgtcccttcaaactgtgttttattttttagtatgccttgtaatttttttgtttaaagctagacatgatgcaatggataaaagtaacttggtactggttccagtggtaggcttctgctccagtaagctgtgattttctgtatttgcttatagctccaatttttggagtagcagtttgccctgtgacctcaatgccttgatagacctaagaagagttgtttagtttcagcttgttcagattttttcttattgtgaggacagaggcaacaacttccaagctccttctgtgttggactaagagttcttacttatttgttatttg

SEQ ID NO: 126931 - DNA, 529 bp, Homo sapiens
gctcaagtggtcctccttcctcggcctcccaaagtgtcgggattataggcttgagccatcacacctggccaaaaatgtatattcttgggtcccactcagatctgttaaataagaatctttagtggtgctcaggaaatgtttgcataaatgctgaattaataaaaagcctcggaaaataggatttgcaaatgacagaactttttgttatatgtattcacataaagctaaaaagtgtttagtgtttaaaagctaggcacaaagggggataaataataaacatatacttggtagaaatttatacttgagggtaaatctttaactgcaaactttttattcagcttgttaatgacaagattttttaaaagttaacagctcattaagatcatatagtaacctaataagtttttctactggtttttattcatacaagcacttttagccaaagatttgaatgttggaaatattcgactttatttttcagagttcatgagtcattcacaaacatttattaaataccttctatttgcca

SEQ ID NO: 126932 - DNA, 391 bp, Homo sapiens
tctggaaccagactgcctggctctgagagttcagcaccctcagctcctagctgtgctgccttttgtaagtcactcaacttctctgtgccttagttctcttctttgtaaaacagggaaataatactacctacctcacagtgaaaatgacatgactttttgatgaacgcaacccagagaagtgcccagcacagagttaactgtctgcgttagcctttatcattagctatagttttattatatttcatttcccctttatgcctcatcctcaattccattccctttcttctcaaaatcgcccattgtgctttgaatccatgtccatacttgtcctctaacgtatgtaaatatatagtgtttgttgttttgtgaatgctttcaaaagattttttag

SEQ ID NO: 126933 - DNA, 897 bp, Homo sapiens
gtcatctacttaccgtggctatgaatttgtctattctagacgtttcatcagtgtgtgtgatgcataatgttatgtgtcattagcacttaactaacccaacacttggttgggccacagcgtccagacatttggttaaacattattattgtggatgtttctgtgaaggtattttttggatgagattaacatttcaattagtagacttggagtaaagcgaattcatctccacagtgcagatgagcctcgtccgatcagttcacagcttgagagaaaaagactggtctccccagaaggacgtctgcagctcttcccagcgtccccagcctgtccacctgccccagtcaatcatggccttgccctcctccacagtcacgtgagcccattccttaagacaaatctcccagactgaatttatttacaatagatatgagaaactactgtacggttacaacggagagtcaatttatattcagttgtgtgtgtgtgtagtgagatcgagtcttgtctgtgcccaggctagatgtgcagctgcacaaatctcggttttacctgaacctcgcctccgggttccaagcgattcttaattgtctcagctcccgagtactgggaccaaaggccgcatgcaataaaacgtgataattgagtattcaaaaagcggatgcgtccaccgggtcagcagttggccgacatctgaactcgtgattgggcactggctcccaaagtgtgggattacagggggccacactggcccggcaattcatttaacaaacttcaccctgcagaggcggggcgccacaggcgcgaacaattggcacgcagatccggaaagggtggctcggtaacaaagagacaacgcaaggtctgctagctggcggaacccacacgccaaggggagta

SEQ ID NO: 126934 - DNA, 875 bp, Homo sapiens
gagccaagatcgcaccactgccctccagcctgggcaatagagcaagactccatctcacaaaataaaaagccaaaaaaagctctcgacagttctgttccccgcctgaggtgtttgtctcaggatcccggcctggctgtgggccacagatggcaaaaaccaaggtccgtctattactgggcatccagggtttcataatctctacgacctccatgcctggaactccacacattgcgcatgccccagaaacgcttgcccaacggaccccaatccaccatttctgaatgcatttttcatgacttgctgaatgtgtcttgttaatccaattagattgtaaactccgggagtgcagggacaacgttgaccttcctattactcccctcacccccgcccagctctggtctgggcacacagtgaccctcaagggtagcacaaagacttgaggcaagaaaaacacctgtagaaggaaaaggctggatactgggagcgcctctgtctgctttgctgccatcctcttcttcaacaacaaaggacacgctaattctatgcagcaaaagtttccaaacacgttagcctaagaatttcgagtcatgcaaaaaataaattcccagagtcacagggttaaaaaaaatcagattccagggccccatccttgttgttcctgagtcagactccccagtcaaactgccagagaacctcttctttgaacaaacacttcaggcaactttcccaggataaagcaagtttcagaaactctcacacagcttcttaggtatctcagatatggctcttgccctccagatgtttacaaatgaaaacaagaaatctggttccaacaagcaaaagcccagagagacctcaaacacaaagatgcaaat

SEQ ID NO: 126935 - DNA, 288 bp, Homo sapiens
ttcgagaccagcctggtcaacatagtgaaaccccatctctattttgtataaaaatataaagtaattaaaacttaaaaaaggaggaatgaaaattatgtttactcaactatgaaaaaaatgctcaggaggaaggaactagatcacaatactaatatgttgacttggttacaacgatggggatattgtggctggaccatatttgttttcctttttctacgaataagcatgtaagataaatttctgggctgggtgcagtggctcacacctgtaatcccagcactttgggag

SEQ ID NO: 126936 - DNA, 277 bp, Homo sapiens
ctcctgggttcaagggattctctggcctcagcctcctgagtagctgggattacaggtacacgcaaccacgcctggctaatttttgtattttttaatagagatgtggtttcaccatgttggccaggctggtcttgaatgcctgatctcaggtagtccacctaccttggcctcccaaagtgctgagattacaggcgtgagccactgtgcccagcccatctaacattttttttcagaattaattggaaaaagacacctagttttgttgttgttgttgctg

SEQ ID NO: 126937 - DNA, 457 bp, Homo sapiens
cagtaacttagtggcccagggttgcctgagaagggctttggactccttagatgagaggtaaagcctgaatcccaaattgcactgtgcgatattagactctgaagatttagcaagaggcgtgtttgggtgaatgattatcttttgtcttttctagtgaatcattttcatgtgtcatcaaccatgtttcttacctggtagatatgaaactgcacctttctgtagaaaatctatttaatgattagccagggggccaagggataattgaaaatcatccagttggcatcgggactccagggttttagtttcaactctgctgccaactaattcagtgttacttgggtaaacgactaccctttctcaggtcttagtttccatgtctgtgaaaaacaaatatttgccgtaaaaacagtgatgtctaaactgtgtttaaaatgggcccaaattttcttcaacgtgc

SEQ ID NO: 126938 - DNA, 274 bp, Homo sapiens
tggaaagccagataactattactctgtatgatagtgcagggaacgttctgtgtgtggttgtgttatgttgacattccatccagtgtgccactccgtataattccgtctgacgtgccactccatataattgggatgctgtctgttcacttagctgatagaggtgggattcagagactgtggtgtctgtgatgctgtgatcctagacatggtaagtgcgtaatacctctagatgctgatagattaagctatgattgaatttatagtttccagaatg

SEQ ID NO: 126939 - DNA, 369 bp, Homo sapiens
ttcacccatttagtttctgccagtctctgaaagcatttgcctctggccatagagaatgattttggataagaccaccagcacagggcagaaatgtgcagagtgtatacagtggggaccaaagtaaaagagatgccagaggtaatggagaacaaagggcatagatgccacaataggatcagaatggtgccgaaaggtggcaatggggagggagagatgctccaagggtcaaatttcagagattacatctggataaaagcatggaaactgcagattgaaaagttgtttgcagtctttgatagagcaatggaagcaatgatgagcgatcaactcattttaaggaaagaggaggtgttgagatgccgaagtgag

SEQ ID NO: 126940 - DNA, 190 bp, Homo sapiens
agtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatca

SEQ ID NO: 126941 - DNA, 350 bp, Homo sapiens
taagatgttgacaggaaggaaggaaagggtgaaagaaagacagagagggaggaggagagaagacagagagacccacaggacacaagagacagacacacagggaatcacagagagagacagtctaggccaaagctccctggagatcccacagcgtggggacaaaagcctgtggtcccggctgcctagaggcacagtatgagtgaatgcagttagacatcaggaagaccttccagagagtgaaggatggacacagacaccttctaaccatctaataatggggcaggggataaagttctgagtggggaattaacaatcctgagtctttttcccaacgtctctgcttacccggt

SEQ ID NO: 126942 - DNA, 503 bp, Homo sapiens
cctcccaaagtgctgggattacaggcgtgagccacggtgcccagtcttgttttgttttttgagatagggccttgctctgtcgttcaggctggagtgcagtggtgcaatctcgggtcactgcaacctccgcctcctgggttcaagcgagtctgtcacctcagccccccgagtagctgagattacaggcacccaccagcaggcctggctaatttttgtatttttagtagagatggggtttcaccacgttagccaggctggtctcaactcctggcttcaagtgatctgcccgtcttggcctcccaaagtgctaggattacaggtataagccaccgtacccggcctaaggaaaggtgtaggtctttctacacctgacttgcctatgcctaccttttcttacatcatttctcctgcctagaatgcctcctgttcaaaaccattaatccatacccctgccactcttttcaaaacaaattcaaaattcatctcttgttaggcttctttgt

SEQ ID NO: 126943 - DNA, 265 bp, Homo sapiens
ccagaagggccctgagcatggcacgtgccctctggaagctctccgtcctttcatctgtggcgaaggcatagctgatcccacacgctgcccacttgctcctgcgaagcctcctaccctggagccgctcaggcccagcccacagccactctcaccactgcggtgatcccagggactgggaacaggtctctttctgtaacaccagggcttagtgctttggtgctactcttacttctttatttgacttaattaattccaactctccagc

SEQ ID NO: 126944 - DNA, 297 bp, Homo sapiens
actttgaaaaaatgagaaatcctcgagaaatcagctctttatgaagtttagaataagaccatcctatcctttaggtctgtttcaaagcagatgttagttttgatgctaaatatatcaactccttttactgaacaccatcaacaacaaagccactgctcacagcccgcttctcagactttccagtacttcctaagtgccttcacttttcctccgtagagaagaacagacattggtgatgacctgacattcagaacgtggccacacaagccacggtcagccgtgggttgaccgttgctt

SEQ ID NO: 126945 - DNA, 112 bp, Homo sapiens
aaggtatcctaatcaacattgctgtcgacaatgtgtgaggatacttgttcacagcaatcagccacactaagtattatatattatctacagccatttttcctttttaggtaat

SEQ ID NO: 126946 - DNA, 635 bp, Homo sapiens
  misc_feature (613)..(613): n is a, c, g, or t
  misc_feature (635)..(635): n is a, c, g, or t
gatctagaggatcccgctgccgctactactactgttaacctgctgaggcagctgtcactgaacaatcccggtgctcccctcacttcatcctttattgtctgagtgaacgggaagctatttgggccttccgagataacataggtgtttggttctcagatctcgtgtaagaaattcattttaacacacgctgagtctgctgacaccctttctctgctcatcattttagcagctctacctcatttactgtaggccatcattcctcgccaagtattggatttttttcttttcagagagacaggggtctcattatattgcctaggctagtttccaactcctgggctcaagcagtcctcccatctcagcttcctgagtagctgggaccacagatgtgtgccaccacgcccagctaatttttatttttgtagagactgggtctcactatgttgcccaggctggtctcgggctcctgggctcaggcgatccttctgcatcagcctcccagagtgctgggattataggcatgagccactgtgcacagcccactagggtgtcttgagccacagagaactgtggcattgactaataaaccttggtgttcttaacaaaaactttnagccacaggatagggtttgatn

SEQ ID NO: 126947 - DNA, 397 bp, Homo sapiens
ctactcctttgagctctccagacccacatatctaactattcactcaaattggaaactgaggtgtcaccatgcatacctccttttccatcaattctcacaatccactgagtactcaatcttctaatattctgctaatatctatttactctattcccaaagatcacctttaggaatctccagatattttaaatgtttttttggaggacaggagcatagcttcttacagattcccaaaggagtccattatccctaaaaagtcaagaaccattgctaatctttcccctccaattcctcctccaccctgtcagaatggtccatctaaaatgcaagtgtgaattcgacattgccctgcttaaaatcctttaacggccttcagaatagagaatgagctccctag

SEQ ID NO: 126948 - DNA, 460 bp, Homo sapiens
cagggctgggggaatcacactacttgatttcaaaaagctataaatttactaggacagtgtggtattggtgtaaagacagagatacagattagtgaaacagaagacagtccaggaattgatcatgtatgtaagttaattcatttcaacaaatgtgtcaaggtaatttaatagggaaaggaaggacagtcttttcaataaatggtgcttgaaaaatatgcaaaatgaaacaaaacaaaattaaaggaacctagacttttaccttacactacatataaaacttaactcaaagcagatcacatacctaaatacatgggctaaaactataaaacttctcaaagcaaacaggagaaaatcttcatgaccttaaattagacaaggatttcctagacagaatgcaaaaagcatgaaccataaaattaaaaactggtaaaatggatttcatcccactgtggaactttta

SEQ ID NO: 126949 - DNA, 409 bp, Homo sapiens
atatgtaagattgttatttatttgtaattttcattctgtttctcttggtttggattctcatcctatgcaactatggctctttgcagttataatcaatatgcagctagtgcataattgaaaatttccgggctgggcacagtggcttattcctacaatcccagcactgtgggaggctgaggagggcggatcacctgaggtcaggacttcaagagcagcctgaccaacatggagaaaccccgtctctactaaaaatacaaaattagccaggcatggtggagcacgcctgtaatccttgctactcaggaggctgaggcaggagaatcgcttgaacctaggaggctgaggttgcagtgagccaagttcgtaccactgcactccagcctgggcaacaagagcgaaactccgtctc

SEQ ID NO: 126950 - DNA, 319 bp, Homo sapiens
ctgtcaccaaaggtatgtttttacttttcacatgagctcttgccctttgtagtacaataatttaggaaacttttctgcaaaaccattgattctccagctgtagtttctctacactcttacaatgagacatggtaagttagcagaagatggtttgggtctaaagccgtgaaattcacaaaggcatgtagtgagtggcatgcattataatcatcgacctctcactttgactctatctggctttctgagaatgacatctcgcctgtccctggggcttatccatcagcatttcttgcattgtgatcttttattattttgaaat

SEQ ID NO: 126951 - DNA, 181 bp, Homo sapiens
cttggactcacagtgcagcctaggacttcactgactgttataaactgatagcatcccccttccaaagaagaccttcctagtcctgtaagcactgatcctaagctgcttttccaatgctactttgccattgggtgaagcaaaatgtcagataagcttactagcaaatgtgcctctgagcaca

SEQ ID NO: 126952 - DNA, 305 bp, Homo sapiens
tctgctcaaagctggggatctccagatgaagatgatgtggtcagtggagaaaggccagtcaactaacacaagttttagacttccagtttggaaatactgtgacgggatactctgacagaccctcctgctaccacaggaataaagaacacgaattaagaacatacacgcaaacaaaacgctttgaaaagctggttctacctatgcaggtggtaagggggaagccagggcctcctcaggggcagatgccaacagcggcggtggggtgaggagcagcccgggcgtaagcaagcgggaccacaccgaag

SEQ ID NO: 126953 - DNA, 537 bp, Homo sapiens
caattatctaagcttccactttaaaaagctagagaaagaaaagcaaagtatgcccaaaataagtagaacacttttttaatattttacctgaagtgatatacatttagaaaaaaatagtacgttgaaggacgaaaataataaaaatatggcaaaaatcaataaatagaaaacaagcagtaaagtcaataaaactaagagctggatcttttcaaagatgaataaaattgataaacccaagtgaaacaaataaagaaaaagagagagaaaacacaaataccaacattgtcagtgaaagaaggggatatcattaacacaacttaccaaaactaaaacaaaagagataaaaaatctaatagcccaatatctattaaagaagcagaatacattatcaaaataacttatcataaagaaaactccaggctcacattgttttattaatgaaatctatcaagcatttaaagaagaaatagtgctaatcttacccaaacactttgaaaaatagtaaaggagggaatatgttatatggaccagcataag

SEQ ID NO: 126954 - DNA, 375 bp, Homo sapiens
cctcttctcttgaaggccagtgtttgttaattagtgagtgttgaattgctccccgggtttagtaggcatcttgtggttaatggagacagatggtcttcccttgatagatgcttctggaaagttaacattccagcagtgacggttacattcctgtcaggcaggacttcaggaagagaggaactccgcaccgtttgatcaggattcccaggtgtgactttgcaggtgaagaaatttgattttatcaattcatttagggtggatggagattgtgagactgagtaaagctatccaagccaagcaagcttacatgagattcaattctccagtgtattagttggcagtggaagatgtgctgtagccagctgtagacttatt

SEQ ID NO: 126955 - DNA, 212 bp, Homo sapiens
tacagtacctccctgggtagagtcttatacagctgagcagataccagttgctactggcctcccctggcagtagtataacagcacaaaaattcaattgaccattaaactggtaggtcaataaaagttgaatgtaggaataaatgatgacattagcttaggctgagtgcagtggctcacccctgtaatcccaacattttgggaggtcaagggga

SEQ ID NO: 126956 - DNA, 987 bp, Homo sapiens
ggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgc

SEQ ID NO: 126957 - DNA, 825 bp, Homo sapiens
ggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcatcgataaacaccggtgtttatcgatgccactcccaaggtccggggagtggctatcggaggtagtatcaggctaggacgtgttcttcatagataagtggaggagaaatgctgtaagaattcacctgatgagtattcaaaaaacaaggtggcatcgtatagggagggacatgtggatgggtatggcaggttgttaccgtagaggtcgttctgtccattgatctagggatggtaagagtggtatggatggtgagtgtttagtaaggtaacgtcgtgactcatatagagagagatg

SEQ ID NO: 126958 - DNA, 1080 bp, Homo sapiens
ttccacctcggcctcccaaaatccagggattacaggcatgagccaccatccctggcctgaaataaataaataatgcataaatgtcatttttaaatttatgatgacaaattctaaagagaaaagtaaaaggaaagcaggaatagaatgtattgaggggaaggggttgagtgttcacagatggcttcatacagaaggtgacatttgagtaagggcttgaaagaagtgaaggagtgagccatacacatatatgagaagagcattctaggcatagtgaatcacagtgtacatgtcctgagacagaagcttgcctgaggaatggtgagggtgggtccttattttgtggtgctttatggaagtgcttttcaaacttcaatgtgcacatgaattaccttgggggtttctattaaaatttagactctaatttcataggtctggggtagggcctaattctaataagctcccaggtgctgctgctgctgctggtctttgtaggacttcagcatttacactgagcaaaataggaagtctttggagcgtttgggcagggtgacatgatctgatttatattttgacattttcatttctttggctgctgagtagatagtggtggattgggcaaggacaaaagcagaaatactagtttggagcctattactgtaatcaaggtgagagaaaatgtggtttgtgctagagagtagcagtgactgtggtaacatgatctgattctggatatatttttcaagtagagtcagcaggttttgctgatagattggatatgtgctgtgaaagaaaggaaagagttaaggtttttgtattgagtttctggaagaatgcagttgtcatttattgagatggagaagactgaaagaaagagaaacaagtttgcaggagaagtaacagaagctcagttttagacataaattaaacatgcctattaagacttagagatgttggccaggcgcagtggctcacgcctgtaatcccagtgctttgggaggccgaggcgggcagatcacctgaggtcaggagttcaagaccagcctggcgaatgtcgtgaaaccccatctctactaaaaaaaa

SEQ ID NO: 126959 - DNA, 624 bp, Homo sapiens
atattaaaaaattaagtcaacaatatacacaaatggtaatgcacaaagaccaagtggagtttatgctgggaaagcaaggtgtattgaagtaatacaacatccccaatttaaagagcaaaagcatacaaacacttcacaaaataaagtaaataaatggccaacttgaactaactgacatttagagaacacatcattggtaaacagaaaaatacacactatttttaagtgcacatgaaatatatactgagatcaattatgttataaaacaagtctcaataaattaaaaatattcaaaccattcaatatatgttttctaaatacaattactaacttagaaatcagtagatatatacctggaaaatcttccaatatttgaaatccaactaatgcacttctaaataaaatcaagaaatcaacaaaaaatgaaaataaaagtagaaagtattttgatttaaaatgtgaaccaaagctaaagcattgcttagaataagctgatatcaataaacacatataaaaggaaaaaaatcaatttcataggttttctttcaccttaataaactagaaattgagtaaattaaaagcaaagtaaacattagaaagtaataaagatgggaaattattaaa

SEQ ID NO: 126960 - DNA, 209 bp, Homo sapiens
atgacatggacacagggagacaacacggaatgagtggagacggatggcatgaaatcaatactggcacaccagaacatggctttgcttggccacatgtgatctttacccctgatcgtgagtgtggctgaggtcctctcctgcccacacacgcacgagtactccccggcatctgccacagacaggccacgaatctgcagctcacacctggt

SEQ ID NO: 126961 - DNA, 254 bp, Homo sapiens
cagagtagtgtagtaaaaagatcttcaggtttgaagttagacatatttttcaaacccagttctggtatattccgagataagagtatgtaatttacaggtattatgatgattgaaagaagtagctagcaatattcctagcacatggcaggcgatgggaatgagaggatggttgtgtcctttggcctgaccctccactgtcttgccaaggcttgaggtccttataattctacagtgtagagtcactcgcgtgctgc

SEQ ID NO: 126962 - DNA, 183 bp, Homo sapiens
ttttcaccctttgtatttgctctgatctagtccttatatccagaatgcccttcctgccatctgcagctactgaactcctacctctccagaaagcccagttcagatgctccctcctccacacagtcttgccagattgctcctccagagtcctccccacttctgaatctgttggccatcttgact

SEQ ID NO: 126963 - DNA, 270 bp, Homo sapiens
gcccctctttatcattaatgcaggggtcatctgaagacatagcaggctgagtttggagtgggatggatggagcgggagacataagaccaagctgtggtggctggaggctggatgaggggcacagtgatgacaggcaaggccacctcctaccacccggtgaaaggtgaaggctgggcctcctgttctcaggaggtagctgccaagcggggacccgagtctgccggccttctgagcaaggagctcaccgctgctgagaccctcaatccaagc

SEQ ID NO: 126964 - DNA, 250 bp, Homo sapiens
gaaaaatagcccttttctaccccagaaaagtttttcatcttccttaacaagaggcaataactgagtcaagaccatcaaaacttgcagctcttgccctaccccgcatcaaattgcagcatattgagagatgataaatatgtaaaacatgaagccagagaggcaaagacgtcagctcaacattttactgttactttcagatagcatcaaaacttggcacatgatgttgtggacagaaccgcaggctatattt

SEQ ID NO: 126965 - DNA, 485 bp, Homo sapiens
tatacaatgagagaaaatacttacaaatcatatatctgataaagggtctagtattgagatcatacaaaaactcttccaactctagaataaaaagcaaattttaaaacgggcaatggatttgaataggcatttctcagaagaaaatatacagatagccagttacacatgaaaagatgctcaacatcattgtcattaaggaaatgcagggctgggtggggtggctcatacctttaatcccagcagtttggaaagttaataccggaggatagtttgaggccaggagttcaagaccaacctgggcaacatacggagaccccctatctctacaaagaagaattttaaaaatgtagccaggcacggtggtatgatcatgccacagcctgggcaacatagtgagaccctgtctctttaaaaagcaaacaaaaaaaggaaatgtgtatcctaaccacaatgagatattacttcacgctcattaggaaggatgg

SEQ ID NO: 126966 - DNA, 281 bp, Homo sapiens
cagaaagaaatgcaagggagttgtctaggttactagaaaagccaatgtcttcctgagaaggagggagggggagagagagagaaaagaaaggaagaaaagaaagaaagcccagatttacatctttctagaatgggttcaaccatgctctgccctgagaacagacgcagaaattaaaattgtgtcctgtagtccctgcctgtgacagtcctttcagtttataactggattcacacaggtttacacagcacatcttctgaatgacagaaatctaaggtgaatat

SEQ ID NO: 126967 - DNA, 202 bp, Homo sapiens
gggatgacatcacacaccacaactcacacgagaggatggcagccatcagaccccacccacgctgagctaaccgctgagtcaagcagagcccccgctcctctacttcagtatcatcaacggcctttgggatcctatgtattttattttacgtatttaaagcaaattgtaaggctgggtccacagacttcaccaggctgccaca

SEQ ID NO: 126968 - DNA, 628 bp, Homo sapiens
tgtggtggctcacatctgtaatcccagtactttgggaggctgaggcgagtggattgcctgagctcaggagttcaagaccagcctgggcaacaaggtgaaaccccgtctctactaaaatacaaaatatatatacatattagctgggcggggtggcacgtgcctatagtcccagctactcaggaggctgaggcaagaggatcacttgagcccaagagattgaggctgcagtgaactgtgactgtgccactacaccccagcctaggcgattgagactctgtctccaaaaagaatttaaatttaaaagtcactgattttaaaataaattattcaataggttcacagggcttattctggatagagtcaacaggatgttctggctgaaaaagtgaaattgaaacagagtagaaagtgaggagctagctatgtaaaattctaaggagagcattctagagcatgggcaaaggcatcagacgggtcttggttaaagaatggagaggtgtgtcacaggcagcccaaaggagagagtgatgggcgataagatgacagatttcttgattagcatctgaaaccggtccaaatctatctaaaattagcccttctttaggttgtttttaaagaatccctaaaa

SEQ ID NO: 126969 - DNA, 736 bp, Homo sapiens
  misc_feature (656)..(656): n is a, c, g, or t
aaggtctctcagtacggggaatcttggttgcggtggcatcggttcttctccttattttgacccacactggcatgccacctgaagtcccgataacagcctgatttctcactaaacactccatcgaaccatttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacatagggggaaggggctgagaggcagaggtgaggcaatgcttttgggtgtgcatggnctcttgtgactgtgtcgtgtgactggggggtatccggggggctgctgtggtctgctgcctcaagtctgagggttatgaga

SEQ ID NO: 126970 - DNA, 424 bp, Homo sapiens
ttgtatttttagtagagacggggtttcaccatgttggtcaagctggtctcgaactactgacctcaagtgatacacctgtctcagcccccaaagtgctgggattacaggcgtgagccatcgcacgcggctgctcacttagtttaggtactttccactgtttatgtcttaaaactaacgatgacatctggactttggactagaaacgtcaagctgatgaagtcgtttgttcttgtgtgcttctgtgatgatccatggaggagcttaagtctaaagattgccattttgctatagctttcaggaagagaaaataaaaagtaaaatacaaattgaagcatgttctcagtttacagtcataattctagctgagcattagcggacagaatgttaatactttggaatccaccaaggccatttctgcatctgc

SEQ ID NO: 126971 - DNA, 521 bp, Homo sapiens
tcgtagaggaagagtcttgcgatgttgtcaaggctggtatgaactcctggcctcaagccatcctcttgccttggtctcacaaaatgctaggattataggtatgaaccacagtgcctggccaattctaggtttttatgatcaagtacattaaatatcacctcgtttgttttgatcctttttactagtctgttgaaaactttttgaatcctgacaaagcaaataggggagtaccttcttaaattttatgccataagcatctcacaaaagtcctggcctaaccttctttctttaccatttaatttttccagaactaaaagattcatgatgccaagtttgtaaatactgttttaattatcaactcatgttggtaatgactaatgataacagctgtctttaaaatacagtcttctatttctcatatgttattatgaggaaggtgttagcctcattttacagataaggaaaatgaggcttagaaagattaagtaacttcatttatattttcatttgttcaataatat

SEQ ID NO: 126972 - DNA, 661 bp, Homo sapiens
ggggaaaggcaggagctagattcatggctccatactggaacgatattgagctattgaagggtttaaaagagggatagcatcatcagttttgtgtctagaaagtttgctttatgtttatatagatgtatggaagagaattgacggtggtgaactaaaggtgggaaaatcagcaaagactcttggggtggttgaagaaaagaacgacagaagtcactcgggatagtaatagttggtatggagactagagaatggatgtgaaagatgctcaggatgttgaattgactacaaaggtcaccacttagaagtggagagtaagagagggtaggcttgggaaggctcttgggattctgatgttggccgtgcagtagaggatgggcttggtgtgtaggagatgctttcacttttcacttctttctccacctttaccctggtaaaaggtagctcccactgttcttgttctaaagggttttgtggtcctctctgcttccctttattgcagcacctgacctgtggtataataaccgcctgtgtacttgttctttcctgcacttgtaagctctttgaggattagctgtggtcagtgctggccacaaagaggcaagctaaactgtggatggattgaatgaataaggaccaagactgggatagagaagcagatttt

SEQ ID NO: 126973 - DNA, 372 bp, Homo sapiens
ctcttggaatgtattgcctagtggacaatatagacaaacaattgtcagttccattgtattgtacatatctttcagatgcattctggagagtaccaggattctccagaagtgccttggaggtcagtgcacagctaccaaggaggctgaacacgtgtagcttcagcttctccaccccttcttcaacagaatagctccacatgtattatcacacttcttcttcacatatgtgtgttcatcataagagttttacttgagaaaatgtattttgcaatttaagtgtgaagttctaaagagtgtgatatgcgctttaatggaggaaatgcacttgagagataggaactggaggaactggtttcaagaagcaggaactgg

SEQ ID NO: 126974 - DNA, 167 bp, Homo sapiens
cagaatgtatttaacctgtgtacaactgataagctttcggttcacagtcttttgcaagtataatgatgcaatgaataaccttgtacacaaaccattttgcacacacaagagtaaaggaaaccttttaagcaaaatgtatctaccagcccagtgcagtggctcctgtc

SEQ ID NO: 126975 - DNA, 318 bp, Homo sapiens
tgaatgttgattaagcatactcccaggctttgaaattctgaaagcagtgtcagaataatggatgttgagcaaatgtcaagcatttgttaatttctctgttatttggagtttatctaccatgatcaatcaaataaactagtgcttctctcttgtggcatgtgtcattgatatggtgattaggtggctagagagaccttctgctttttttccaggtaacagattataaacgagtagacagagcttttcagttaaagatttgtttatggcttggtttagtagaaatttgtatattaactgaatactttggtggcagtgtga

SEQ ID NO: 126976 - DNA, 373 bp, Homo sapiens
actgggaagaaaggcatcgttctcaaactaaaaaacaagtttgattaaatcttgtgatacttctaggcctaagtaactctgccatgggcttgcagattttttagacttttcttgttgatttagacacagcattgtctaacctactgacttaggaatcctttccatatgttaataggatttgactcaagagctaaaaggaaagcaaatagaaatgggtgtgagagataaagatgagagacgaggacagaacacaaaggagcaccttccctacctgcaaaaaacagatgagcacaggtggtctgaatgagggcagagaacctatagggggcagggaagcaaacttccaaagtctggagagctgctgagtgaccag

SEQ ID NO: 126977 - DNA, 226 bp, Homo sapiens
tgatccgcccgcctctcctgccgaagtgctgggattacaggcgtgagtcaccgcgcccggccaacaagtggatttttaaaggaaaaaagaggcagttgctaaattcctcgccaacaatttacattaaaatacataagcgatttattggcttgttctttgtatcacaaattccacaaatttagaaacgtgattgtaatgagtgaagcaggtattcagggactacatg

SEQ ID NO: 126978 - DNA, 536 bp, Homo sapiens
gtaaatggaactgttttcatgatttccttttcagattgttcattgttagtgtatggaaatgtaagtcatttttctgtgttgattttttttatcctgctagtttgctgaattcatttattaattttaagtctttttgtgtgtgtgtgtgtgaaaactttagaattatctacatataatatcacctgggatcagaaataatttcacttcttcctttccaatttggccagggcaattaggcaggagaaggaaataaagggtattcaactaggaaaagaggaagtcaaattgtccctttttgcagatgacatgattgtatatctagaaaaccccaatgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaactttattctctttgaagagaataaaatatctaggaatccaacttacaagggacgtgaaggac

SEQ ID NO: 126979 - DNA, 193 bp, Homo sapiens
tgcggcaacctggcaacgtccttaaatgaccccctccacactctgccaggccctgggtgtctccaccagcatacaggctgtgtagaaagcagctctcctagtgaccagggtcactgctgcagtttcagtgtttctccacaaaatatggccctcgaagaggctgctcagcttacagaaacctggcaggtggcct

SEQ ID NO: 126980 - DNA, 390 bp, Homo sapiens
aaatggggtgctgctataacaaacacctaaaaatgcagaaatgggcaatgggcagaggctaaaagaattttgagaagcataatagaaaaagtctaggtggtcttgacatactgttaatagaaatacgatgttaatgtctctcccagtgtgggctcagaacgaagtgagaagcatggtagatgacacattatcaccttagaaaatatgtgaattatcatgaacatactattgctagacgcatggagcttaaatttgctgctgatgaggacttggatgggaagaaaggtgaaacatgttatcaaaaactagaggaaggggatccttgctatatacaggcagaaagcttagctgaattaagtccagcagttacgtggaaagcagaccttgtaa

SEQ ID NO: 126981 - DNA, 413 bp, Homo sapiens
  misc_feature (1)..(1): n is a, c, g, or t
nagttgcagtagcgcgatcttgactcaccgcaacctccgcctcccgggttcaagcaattctcctgcctcggcctcccaaagtgctgggattacaggtgtgagcaactgcacctggcctagcacatttttagcagaaaaatgagccccatattccttagctgtcacctcctaatcctccacagatttacctagtctgcgcatttcacaaaaatggatcatgtgtaatacatggtcctttgtaactggtttcgttcacatagcatgtttgcaggctcattcatattgtagcctgtatcagtacttgatttttgttcattgttaaatggtatcccattgtatggatgtaccacatcttgtttatccatttgtcattgatggacatttgggctgtttctacttttggctactatgaa

SEQ ID NO: 126982 - DNA, 353 bp, Homo sapiens
ctgacaccccattaggctcagcaaattacctgggctgtactgctgcaaagcttcacagacagcccccattacttcagtcaagcccagatttcttcctcatctgttacctatctcggcgtaattctcgtaaaagcacacgtgctttccctgccaatcgtgtccgactgatctctcaaaccccagcaccttctacaaaacaacaactcttttccttcctaggcatggttagcgtggtcggaattcttacacaagagccaggaccacaccctgtagcctttctgtccaaacaacttgaccttactgttttagcctagccctcatgtctgcgtgcagcagctgctgctgctttaata

SEQ ID NO: 126983 - DNA, 694 bp, Homo sapiens
cgtggtggctcacacctgtaatcctagcactttgggaggccaaggtaggaggatcccttgagcccaggagttggagaccagcctgggcaacacagggagactgtgtctctaaaaaataaaaaatttttaaaaacaccaatatttctatttccacctaaaaatttaagatgcacactctcattgaacaaaacctataatctaaacaatttgagattagtttttgttcactactgtatcccagcatgaaacctaacacataacatctcgaaaacctaatgacaataagaaagcacaaaacttgcatatatacaggctgagtatccctaatctgaaaatccaaaatgctctaaaatgcaaaactctttgagagccgatatgatgctaaaaggaaatgctcattggaacatttcatattttggatttttggattaggaatactgaactagttaagtatatcacaaatattccaaaaccagaaaagaatctgaaatctgaaacacttctggtcccaagcatttcagataagggatacttgacctgtactatgtctgcaattaaatggttatgtgtgaatgtggacaaacattaggaagcaaatgtacacaaatgtaaatagctgatatatagttggtcagttattttcttgggttggagaaggatctctacatcccaccccaccccaaatttctttaac

SEQ ID NO: 126984 - DNA, 217 bp, Homo sapiens
aacatgttaaacatttcagacctcaaattggtgctacatactgtctgccaaccctacatagtttctcttgtaagcgctctcccacactgcatcacaccatcttgtttcttttctctcttcctactgtcaccaccttattattccctggccattgttttctttcctctcgaccatggcaatgctggtattcttctctctggtgtctccttccatgtaa

SEQ ID NO: 126985 - DNA, 179 bp, Homo sapiens
aagttctttctcttttgccatctgcagccctgggtatgcagcaggtgcggatcatacatcccatcccaaacagcttactatatgtgtctgcgcttcagcttacagaggattttagcaattcacagtgagcactgaggtctggttttatgaagaaaactgagctagctaaatgccgtgat

SEQ ID NO: 126986 - DNA, 712 bp, Homo sapiens
actgctggctcacacctgtaatcccagtactttgggaggccaaggtgggaggattgcttgaagccaggagttgaagaccaacctgggcaacatgatgagacccccatctctaccaaaataaattttttttaattagccaggcatagtcaggcattagccagctactcaggaggctaaggtgggaggatcacttgagttcaggagcttgaggctacagcgagctggagtacagtggcaaatgtagttcgctgtaaaaataaatggccaggcacagtggctcacgcatgtaatcccagcactttgggaggccgaggccggcagattacgaggtcaggagatggagaccatcctggctaacacggtgaaaccccgtctctactaaaaatacaaaaaaattagccaggcgtggtggcatgcacctgtaatcacagctgctcgggaggctgagacaggagaatcgcttgaacccgggaggtggaagttgcagtgagctgagagcatgccactgcactccagcctgggaaacagagcaagactccatctcaaaaaactatttagactagaatgtagtaaaagtgtgttcagagactagtttggacacagcactccacaggaatttatcttataaaatacttgatacaggttcaagtataatcactattaacatttttgacaagattttaaaaaatcaaataacccacttatctattag

SEQ ID NO: 126987 - DNA, 398 bp, Homo sapiens
ggtcaagtttggtgtcgaaattcaacaggtaccttcataacagaacctcttagaaaagcttctaatatgacaatgatatcatacgaggggggactggtacttccctcactctgatacacatacacacacatatgtgttaccatcctgagtaacccaggttgggactgcaatgctgggggaacatgtctagcacagagcctgacacttaggagatgaggacagaaggtggctactgcagtctaatgagatcagagcagctgtcttagtatctgatgctttaagtgctccctagatcaaaatacgtgaacacaaagcatctgggggactggggataaaggcaggagagtgcgaaagaatgaaatgttgctctgtcagttcagatcaggagcctgcttcag

SEQ ID NO: 126988 - DNA, 561 bp, Homo sapiens
aaagaggcgggttctaacagacaggcttcaaagataccaagaggcaacgacgtgagagcaactcctgtgtgtgtccccggggacaatctgatgaagaaagcaaatctagccccttatccaaaaggggaaccatggcatgaaataaatctccctggaagcccacagtgcaaactggctgctctctctgatgcatcaacaattccaggaagcagtgagggtggaggttactacccccatcttacagatgggaatgcgggtccagagaggatcgttgcccagctccgaaatcaacacccacagctgattttcatcatatcccagaagcatgctgcaaggagtgtgaatgaaacaccaagtatacagtaagaggaagtgagctgagcttgcaagtgggtggagaagaaacgcactccccaggcagcctcagggcctcagaagccctgcttccacctcccctagcagaccaagcctgggtggggctgggctcagggattcccatgttttcagcacttcatacctgaacccaacctggaagcaaatgctgctccaagacagttatag

SEQ ID NO: 126989 - DNA, 717 bp, Homo sapiens
gcagctatgtgaatgtgagtatcattctagaagtgtgtgtggcacttgctgcagccctgtgtggctgtcctggcactttgttcccggtgtcagggcctctggtgtgtgattgtcgcagcacgtgtggggcagtgtgtgtgggcattcccagcctgacacatggcttgcataaagattgcataaggttataggaaagtgtctctgtcttttacaccgtattgccagtactaatcagtccaaagtttgagaaaatagtaaaagaataacatacatggttgaaatcaagcatttaaaaacattcagtaactttttgaaagaagactctgcttttctgattaaataaataaaagtcttattaatgatttttagtataactatagttcatgtgtgtgttggggggagagtctcgtttaccttcccaaaacaggttggattttaaaatgcaacttttgcaaagtaagtaagtttcagcacaagggcatgttttcatctctgcactttgtcatctgtgtcagtaagcagttaagtggcacagacctgcctggaccccctttggcaggttgttaggatgaattagtgaagtcgtcggtttaaagagcttagggtggtgcctggacagagtgagtgtctaatgattgctaaagtaattttcttagttttactatggaatcataataacccacatagaagactgatattaagagcacagaagaaata

SEQ ID NO: 126990 - DNA, 643 bp, Homo sapiens
cgcagtggctcacgcctgtaatcccagcactttgggaagccaaggcgggtggatcacgaggtcaggagatcgagaccatctggctaacaaggtgaaaccccatctctactaaagaaaaatacaaaaaattagccgggtgtggtggcaggtgcctgtagtcccagctactcaggaggatgaggcaggagaatggcacgaacctgggaggtggagcttgcagtgagccgagattgcaccactgcactccagcctgggcaagagtgtgatactctgtctcaaaaaagaataaaataaaataaaaaagaaatctaaaacataataataaaaaaaataacactatggaaaacaggcagatgtgaaaaagaaccaatcagaacttctagaaatgaaaaatgaaactataaaattaaagactcaatggatgggctaaacagcagacagacacagtggaagagagatttagtgaagtggaagaggagcaaaggaagctatccagaagacacctcagaagataaagagagaggaaatagaaattatgagaaggaaaccagaaggtgctcctgtatctaatggggactccaggggaaaagaggtaggaaagggagccaacagtcagaaagaatggccaaggatggtcttgaat

SEQ ID NO: 126991 - DNA, 170 bp, Homo sapiens
agggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttt

SEQ ID NO: 126992 - DNA, 682 bp, Homo sapiens
cctgtggtatataagtcctgggtctcgggcgtaatggcatgggtatccaccatcttggtttctgttccttgaactcaatggcttctgttcgaagtccctattaaatgtttctttcttaaatactgtatttgtcagcttcttccttcagcatcccaacttcctcagactttggggtacttttgcacagacctagccaccgcaaaacactgtcatagatgcagcaatccactttcacaaaaccccatggacaatgcagagggggagaacagggactgattaaagaaagggacagaaatggcatcactatccaagactgaaaaacaggctgaatggattatcactctgacccaactgcacatttctaatgtcttcatgttttcaattactccatgaattcccttatctgatgctgattatgcacaggactgtgtaagagttaaacaacacctgacactggtgactcacacctgtaatccgagcatcttgggaggctgaagcaggtggataatctgaggtcaggagttcgagaccagcctggccaacacggagaaactccatctccactaaaaatacaaaattacggccaggtgcagtggctcacacctgcaatcccagcacctgggaggccgaggcaggtggatcacctgagatcagaggtctgaaaccagcctgtcaacatggt

SEQ ID NO: 126993 - DNA, 578 bp, Homo sapiens
cagggagggggaaaattgtgcatagggaaacaaggataaaaattccactgaattaccttaagaatctacatagaccataattgtgtaaggccctgcctgcctttgaactgttatatgagatataaattaactctagctttagtcatagtacagtaccttagcctttatcttaattaatacaatgatgtacctacaagccaaattaagaaatagaacatggtcaataccttaaaaacttcatacgtgttctccaattgcatcccctttgtctccaactaagaaaccaaactgaaatttgctattcattgtaggtgtacctagttgattcatatcacaaaataatatgttgtttaatattgcatgtttttgaacaaaaactgactgttttgtgttgattaatatggaaatccttgaaagagaataatttcttaattgtttaatgtttttcccaaagattgtgaaacagcctgattgaaaggtattattgtgctaaacatattaaaaataaaatgcattttctgctttgacattctatcagcttatttaagtaagaattcaccattctcttctgcatctct

SEQ ID NO: 126994 - DNA, 479 bp, Homo sapiens
aggcgcggtggctcacgcctgtaatcccagcactttgggaggccgagggcctgcgtgtccggatgcagtgttcttagggccaaaggtggctgtgtaggaggagtgagaacaggtggaatgtggacacttagggtacgaggccaagagtggagcattgttgtaggattgtggaccacagcagggagtgtgagtgcacggatggggatcacgaggaccctctgattcgtaggattgtggacgacagccgggatgtgggtgcatggatgggatcatgaggaccctctgatttgggtgttagctgtgtggttgctacactctagatcgtgctatgtgatgtttctttggcacctcaggcccccttgttgaggttcagtgatatctgatggagaggaaagggtgttggggtgtttgtgataagtcgctggatagggaagagagggaggcatctagggaccactgtctttaggagtttaatgagg

SEQ ID NO: 126995 - DNA, 847 bp, Homo sapiens
caccttagagttggccctgctgtgtgccaggcactgtgggcaggaggatagaaaggaggatgaagtggatcccagctctcaggcagctggccctctgttgaaagagatgttaaaagcattcactaccctcttcactgccctgagagtgaagagtaacctccaggcactcattcacccatagtcttcctgtacctgtccccagggatcagaccacaagcctctgccatcatctcccagtctcattctccatccacccgttttattgccttccagtgtcgagttgtaacatctacagacaaatataatgcaggaatgttttatttgagcttcattgaaacagaagtttatttaatttatttatttatttatttatttattcattcattcattggagatggaatttcgctcttgttgcccaggctggagtgcaatggcgtgatcttggctcactgtaacctccacctctcgggttcaagcaattctcctgcctcagcctcccaagtagctgggattacaggtgtctgccaccacacctggctcttcttcttcttcttttttttttgtattattagtagagacggggtttccccgttttggccaggctgccctcgaactccagacctcaggtgatctaccagccttggcctcccgaagtgctgggattacaggtgtaatccactgcacctggccaaaacagaagttaatgaaaaatggatcctgaggtagtttggtctttatcctgctacacctctgtcttccaattttactctctctggttggaccacttcctccactaagtgtcttccaaatccagcagttggtctctgagacctgtatgtgtgtgtct

SEQ ID NO: 126996 - DNA, 283 bp, Homo sapiens
tgccatgagcatccttgttcacacatttttaggtacttgagtgagtgtctgtggaataattttgggaagtgaaatctgtggtcagaggtttgtgagttttacatgctacattttcagaagttgagaaatagcagtaggctgaaggcaagtcgccatgcctggaattcatgaacactagttgaaagaactggcgtgagttagtcatgacaggagagatggggaagggagttgcaggtaggagggccatcttcaaattctcaaagtatagtcactccaaaccaaa

SEQ ID NO: 126997 - DNA, 510 bp, Homo sapiens
tgtgtgtccctatatccccagaactgagcccacagcactttgctgggcagttgaacgtcgcagagtccagtgaagcaactaaaagcacatctgaatgtgccccacggccacgttcaaatcccagccctgcatttattagctacacaaccctgggcaagtctcataaccctccatgcctcagtttcctcatctgtaaaatgggataataatagtgatagcaacaggagacagacaagttcctagacagacagggatgggtccccagtgaaacctgaccttcaagccaaggatacttttagagcctgagcacctaactgccagttctggatagagtccacgaccggagtgagaatttccatccccgtcttacccactctctttcaactggttccttctgaatgatgccctttatccaatcgaacggtgctttttccaagcccatccatggacctatcagcatgcactcccccattcaaagcccataaaaaccctggacttaccctcacagat

SEQ ID NO: 126998 - DNA, 272 bp, Homo sapiens
caagaacccaggtaattcaaatacatatgaaaggctgagaatcacgggcctggaacctgggttctaaacttgaatgcacactggagtttgctgagggacttaacaaaaacctggtgcctgagtccaaccccagagattctgaatgaattggtggtgaatggggcctgagtggggggatttttaaaaagcaccccaggtgaatccactgtgctgctaaggtcggaacctattcaaaagcctaggttctcatccttggtggcacagtggaatct

SEQ ID NO: 126999 - DNA, 459 bp, Homo sapiens
gataaaattctggactattttcaataatttggaagattaatgagagaaaaggtaaaatgtactgtaaatgaactgacatttgttcagtggattatggctaatgaataatgcttagtggctaacagaggatgtattctgaaaagaaatagaatttgttttaaggaaaaattgtgggaggaagcaataattatatttctcaagacagaaaaaggaaactcaaaaatgctttccatattgaataaaagcatatcttattatgcaaaagtaataacagtactagctgataattattaagtgcttaccacataccaagtactcactgctctaagcactttatgtattaaatcatttgatactcacaacaaccaggtagggtattattaacctcattttacagatgaagaaactgaggcacagaatgcttaaatgaatatgaataaggttatgtaatcagtaggt

SEQ ID NO: 127000 - DNA, 454 bp, Homo sapiens
tactttaaacatctttgttcagaggcggttttgttttattagataaaacccaccttgtagtttattcataagggttaaataatttgcgcaaatgaaaatgcctgaaccctgtagcagagacatgctgggtactgctcagtgtgactaagtgttcttctctttcttccttcatagactttttagcactttctccagagtaatactgagctcaatgttttgcatggagaatgcagctagaaggtatagccatactatttactttggtccccaagtagaggccactgttccttcaattttagcagaattcattttgctctgattgtagctcttttcaaactgatgacttctcctttttaatgactcaaactagatcctgttgagacattttataatgcgttagtaccagtttgttttggtgcaaaaagattttgtttttgagagtacaacctgccgg

SEQ ID NO: 127001 - DNA, 180 bp, Homo sapiens
gtagcagtttggacaggcaccatgaaggacatctgttgtatagtgttagcaaagaatgccagtttacatgcttaccagtagtgaatgagaagaatatgtgtttctgcaccttcatcaatagtagatattatttttcttgttggctcaatttctgtcagtgaatgaagagaagaaaaaaaa

SEQ ID NO: 127002 - DNA, 414 bp, Homo sapiens
cctattcaaattactgctatggtttctgtctcctgactggaccctaactgataaactaataaagttgagaaacctcaaactgtcctatcatctatactatatgacccagcaagtccacccttcaatacacagccatcaggaatggatacatgtgcattaaccaagacatgtacaagaatgttcacagtagcaatattcacaacagcaaaaaaactgaaaataacctaagtgtcaatcaatagtagaatggataaactgtggtatgctcatacaatagaatactatcagcaatgagcatgaacaacaaccaaagtaactacatggatgacactcacaaataaacattgagtgaaagaagacaagcacatagtttgatttcatttgtacgaagatcaaagagaggcaaaaataatg

SEQ ID NO: 127003 - DNA, 389 bp, Homo sapiens
ttatttttccccacccttccaccattgtttccaatatctctactattaacccaatgccctcactactgaaaatggcaactgagacactaggtaaaagaggttggtgctcaacaaattatcttttaactttctagtttgaagtacttttaaatatagaaaaattgcaagcatcatataagaattcttatataccatttgctcagattcaccaattgttattattttgccctatttgctttatacttttctatataattataattattttgttctgaaacacttgtggttgaataagccatacccctttccccctctccttttcgtcaaccttttattgtgaaaatattcaaatacagagaaaagttaaaagaattgcacattgaacaccc

SEQ ID NO: 127004 - DNA, 174 bp, Homo sapiens
tatacgtatacttttttgtatctgttttctttcagtgaagattctgtctgtattatttactcatgttgggtgtagttgtttttttcatcgtcgtataatactccattgtgtgaatgtatcagtatatcctttattatttattgtagataagcctttgggttttcagttttttac

SEQ ID NO: 127005 - DNA, 691 bp, Homo sapiens
ggcacagtcaaactaaagcatagtttcttgtacatgccagaatgcccaatcccttcactgggacaggacttgttaactaagttaattgccacagtaacctttgctttgggaaaattgaggtgccaccagaacaagcttgtgcactcccaaatgccctttatgaccacagagcagaaaaacacaccatcaatattatggagaacatcttaaagcagataagcccagatgcttgggctgatgggaggctgggaagggctaagactgcttgtgttaaggccattcttgcattgctataaagaaatacctgagactaggtatttataaagaaatgagctttaatgggctcagtgttctgcaggttgtacaggaagcatagtgctggcatttgctcagcttctggggaggcctcagggagcttttactcatgatggaaggcaaagcaggagcaggcacatcatatggcaaaagcaggagcaagagagagatggaggagagagggtgccacacaattttaaacaaccagatcttgtgagaacccacaaatctcatgtccttctcatactgtgaaatacaataatctcatcccaatagtcctccaaagtcttaacacattccagcattaatgaaactgcctttgcaaaattataactgaagaaattatgacagtgaaagaaatcagacctaaccaacc

SEQ ID NO: 127006 - DNA, 342 bp, Homo sapiens
atttcccctaccacaaggttgtacaaacattccctcaattaattttcttgggagtttacttttttgtatttttaaatatgtaaatgtctttgaaaatggatacactgcccaacgcctttcctactactgtgctctggacatgccaccctcacacagctgggcaatatggccagcctggtggagtgaaataggaattcaactttcattttgttccagatggatagccaaacatggttgattgaactggaaatctaagttcctaaataccctcaaacctctttctgaattctgttgtgttagtaagatttcttttttttttttttttttttgagacggagtttc

SEQ ID NO: 127007 - DNA, 232 bp, Homo sapiens
gagaaagagactttctcctaagtctaaaccaggaggctagactttctgatccctaaggtctcatcctaggcctgaccatctgttctactagagaacacttgggtgtaggttaaaactgggcaacaggttaaaatccattttctcacgttcaaagggcagaggtctctcagctgcaaatcggataaattctgagacaagatattatgggctgtgtactcgctggagcaaatgc

SEQ ID NO: 127008 - DNA, 755 bp, Homo sapiens
ggattggtccttaatttatcttaatgaattgagtcctgttgatcagctttttataaaatgaacaaaaatcagcaaaacttggctaagttttggctaagccttttgacgattttaactacttttagccaacttcaaactaataatactgtataacaaaccgaagcctagagtaaggaacatcatcgtggtagattttgttttaaacaccatgtggactttagtttggaaaaagagatctgagacttctctttttccttaattgctcaccaggattttcaaatgtgattcttttgctccttctttctgtttcctggagatccccaacctttctttccatactgctggcaaccagtgttctcctgttctaatcattcagctgctggtgtcgtagtgtcctgaaattcagtgtttccatgtgccttacaattatgaggtactctagttctatgaggttcctcataattgtaaggcacatggaaaagcagatgaggtgctgactcaagaagtgaataccttggggcctctgaaccccaggcctgcctgactacctcaggggctgaaggatcaataccttcagtgttgatgagtgaaactgggatctttttttttcttttagctttagaaaaaggcctttgacgggcggatcacgaggtcaagagattgggaccatcctagccaacatggtgaaaccccgtctctactaaaaatacaaaaattagctgggtgtgatggcacacgccttagtcccagatact

SEQ ID NO: 127009 - DNA, 463 bp, Homo sapiens
tggcttggaggtggggtttcaccagggacctgccctatctgtctaggcatttggctgcctcctatcattatcaatatgtggtcacaaacatttattgaaataaagcctgatttgtggtttgaggcatctttcagcatttcctaaaaagaataagcttgcctaaaatctgaactacatgaagtggttagtttattgttgtttttcacactttcaatctagtagtggttagattaatggaaattaaggattctcgcttactgaatctgactggatggggagataaagaatgttatccatgggtaaaagaaattacagggttcttcttactttgaacattcatcttcaagaaatagcctcatttgctttaggcttttgccttaaatatttaggagaaaaacacacacgtggcatgcccatgcacacacacacattcactcacacgcactcacatgcacacactgtt

SEQ ID NO: 127010 - DNA, 758 bp, Homo sapiens
gcagaagaggaagagagaagctacctgaaagaatatgacctttagaaggagagtttaaacacttcctaaataaactaattcagatattggatcaaactgagtttttaacccactttgatgctgaaataattgggtttcactgtgagtgggagtacagaagaaagccagatgtgatgtaggccaattaaagacattacattttttttgacatatcccaggtcaaaattagactttctaggtgttttttaatctaggtagtataatctagaattatacttacctaggtgatcggtgaatgtgggaagctaggaggtgatgtgacttctgtcttttgtagtctctacgataaaatagtttggggattttaatttcatttggctttctcatgggtagtttccactcttgtcttttccttttctttttttttcattctgagctctcagactcttcacagatattcctaattctctacaactgtaggagtatagagatgacattttgcatcgcaggatgtcttatactattaaaatgtctcttatttccaagcaaagtagattcagaaattcccagtgtttcaactgtttcaaggagtggggacatgtgttattctgactgaattttgattcaacaaatctttaaggacctatgtgttagccactgggccgaatacttcccagatggtctcatctcaatataacagccccgtgacgaccttattagccacctgaatttcagataaagaacttgagaggtgaatg

SEQ ID NO: 127011 - DNA, 255 bp, Homo sapiens
cggtacctgcattgtgtatggcatttttcaaataacaataggctatgctgctattggcatgaaagttaaaagaaaaatgccatacacacttcaagatacacccacgttctaattcctggaacctataaatgtgaccttatttgaggattaaaaatgtgcaaatgcaattaagttaatgatcttaagagatcatcctagatcttccaggtggataaattcgatcacaagtgtccttgtaagagaactagagggaga

SEQ ID NO: 127012 - DNA, 153 bp, Homo sapiens
aacttggctccctggtctggcacagctgagagtgcccttgaatggggtggctgcatcacaacccgacatgctgggcgtcagttccagtggacaggaatggcaggatcagctggtgatttgtgagagtggttgtcaataatttctgtgatggaa

SEQ ID NO: 127013 - DNA, 300 bp, Homo sapiens
agtgcctcctggtaatgtatgcccagtgggaaaagttaatggaagtctgtagtaaccataaacagagtgaaatatccagggttcagaactctcagaaatcaaggtttggatcacttcaccaggtaaagaactctggacaactgagcaacatggatgtggcggtggaggcagacagaacactatataacgtacatacctcccccaacattcaaaactactgttcacaatggaattgcctgcccctgagaaaaagtggtaactcaggcaatcccaggacacggtatcatggcacatacctat

SEQ ID NO: 127014 - DNA, 160 bp, Homo sapiens
tttcatcaccccaaaaagtcactccctatttctctacaatcccacctagccctaggcaaccactcatctttctctctatataggtttgcctatttggacatttcatatagatggaatcatatgatatgtggtctttaataactggcttctttcacttagc

SEQ ID NO: 127015 - DNA, 307 bp, Homo sapiens
tagctgactctagaggatacacagctgctaactcaggggcgagctgctaactcaggggcgagctgctaactcaggggcagctgcagcatggagccaggagacctgccacccaggtggctggaacgcagctgatacagtttggatatttaaccctgcccaaatctcaagttgaaatctaattcccaatgttggaggtggggcctggcaggaggtgtctgggtctcagggcgggtccctcgtggcttggtgctgtccttgcaatagtgagtgagttctccggagctctggttaagtgcgtggcagctcc

SEQ ID NO: 127016 - DNA, 422 bp, Homo sapiens
gggctatgatattgtggtacactgagagcacatgtcactacaaaaaacaaaaaccaaaacaaaaaaacacctcccccagaatacttctataataattcttcagttaaagatgaattaacagttagttacctccaagaccatcaacataatagaaacagttattatgcaaagctttatttgaaccatgttaatgtcttcctatagttagattgaattcagcttcagtatggtttagattgaagaaaagtcattttggtcaacaagactaaagagagagttaaaatttaggttggcgaggtctggtagtgaatacctagaaagcagagaacataaagagattgcaaagggtcctcaaatcaattccagtatcttacttattttagtttatcttttaaaaaaagttctggccctgtggaaataaa

SEQ ID NO: 127017 - DNA, 402 bp, Homo sapiens
ctcaggagacttattttggtcttcggccaccacagggcatttccttccaacctaattcaagctaaaacgatcttcagagataagaatttaaacaggttcagccgggtgcggtggctcatgcctgtaatcccagtactttgggaggccgaggcgggcggatcacgaggtcaggagatcgagaccatcctggctaacatggtgaaaccctgtctctactgaaaatacaaaaaactagcagggtgtggtggcgggtgcctgtagtcccagctactcaggaggctgaggcaggagaatggcgtgaacccgggaggtggagcttgcagtgagccgagatggtgccactgcactccagcctgggtgacagagtgagactctgtctcaaaaaaaaaaaaaaaaaaaaaa

SEQ ID NO: 127018 - DNA, 500 bp, Homo sapiens
cccccgtcggcacccaccccagcttttcacttttcattctgaagcattaatacccatttaatgggtgggtactaggggtaatacttggatgcgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttggctgactgtggcaggaagatcgcttgagcgtaggagtttgagactagcctggacaacatagggagacccccatctctacaaaaaaaataaaaaattagctaggtgtggtgatgcacacctatagtcccagctactcagaaggctgaggcaggaggattgctggagcccaggagggtggagctgtgatctgtgatcat

SEQ ID NO: 127019 - DNA, 155 bp, Homo sapiens
gacagggccaggaaaaaaaggaatgggatagctatttcttccctcttcttctgcagtggaaaacagtatgagcacattaacttgggtacagagtaaaattaaccaacagccccaatggctgctttttcccactccctcaaagcccaggccataag

SEQ ID NO: 127020 - DNA, 786 bp, Homo sapiens
gatcaaatcatagcagttctttgggagtggtgctttttggagagttctaaacccattttgtcccccaatctctagtgactgctggatttcatagctgccatgcttgttgtaatgcttttggttctcaagctaccacaaaggtaaggagatgggtgtggctattggataaattaaaatgccacagagcttgctgtttctttgagattcagcagtttttattgattaaatgctccttagttgttgcaagcatttggctgatttctagagttctgaaaaagttgattttgacaaatttgccagtgttcttagtgctttaatggaggaatggagttttagaaatctctgttattctggcagtgtttctcttcatttgtcatgctttatttttctttctttccttttaactaatagattttattttttagagcagctttgggtttacagaaaaattgagcaaaaatagagttctcatatgctttctcaccttccattagatacagtttctcctatgattaacatcttgcatgattgtattataattgatgagtcaatattgatattttattattaactaaaattcatagtttatattagggttcactctgttttgtatatcctatgggccttgacaaatgtataatgccataccattacagtatcatacagaatagtttcactacccttcaaattctgtgtgttccacttattcatccctcccttcttttcctgaactcctggtaaatactgatctttttgctgtttctacagttttgccttttccagaat

SEQ ID NO: 127021 - DNA, 704 bp, Homo sapiens
gtatacctcacttctttgagtgacagcaccccagagatccccttctccactctcactctttgtagttaaggtgaggttggattctctcctctctgcacccctcaacccccctacccccagcactaaggacccaggctcagccaatcagaatatctctcatgcccatcatgggctctaggatgggagcatgatggaagagtggccattgaggatcagttccaagacttttgtgagaaatgcgggggaagagaccctctcttttcctatagggattgctcactgtgcaaatatgccagcctggaacagctggggcctccatgtgcacagtggagaatcagagaatcaggtcaccccacaggaaagcaggaccataatggggtactaggcagagacctagcctcctggccatgcacctctgagctgtgtggactgattcttttttgcttaagcatgcttttgttttcatttcatttatttatttattttcagacacagtcttgctctgttgtccaggctggactgcagtggtgtgatttcaatctcagctcactgcaacctctgcctccccggttcaagtgagtcttctgcctcagcctcctgagtagctgaaactacaggcatgtgccaccacgccaggctaatttttgtatttttagtagagatagggtttcaccatattggccaggctggtcttgaactcctga

SEQ ID NO: 127022 - DNA, 459 bp, Homo sapiens
tccatgcaagacccaacggcactaagatttttgcctgtcttttccactggaagtttcatagttttagattttacatttgtctctgtctggccatccttacacagccacaatactgtattgtttactatagcatgatggtaagtcagttaagtaatatgagtcttccagcttcattctttttcaaaattgctttggtttttctacacgttttttctgtgaactttagaatcagcttgtcagtgtctacaagccctctgggattttgactggaattgcattgaatgtatgaaacaatctggaggacagctgacattttaacaatactgagtcttctgattcacacacccataggtcagtgatgggagcaaggctcaggctaaagcagattcagggtgtctttctgtgtggaacgtttaggaaaagtatgtttgcatgccactgtctcctgaccaaaccctt

SEQ ID NO: 127023 - DNA, 398 bp, Homo sapiens
acacatttctcaaaatctgtctccaccattgagtgatggataattctttgtgtgtgtgggcagggggagggtatgtatttctctgtataagggccctgcactgccctattggatttaaataaataatccttctcacaatgttagacataaacgtcaagtactatgcttgggaccaggcttatagagacaaataagagaaatgtaatttcaattacatatgtctaactttgttctagaagggattagagttgatggttttaaaataacttataaaggataaggactataatagatgtatatgtggagaggtctagctgcatagaacatgtatcttttattcagcatagagatctgaataccattacaaataccaataattaggaggacatggggaggaa

SEQ ID NO: 127024 - DNA, 646 bp, Homo sapiens
tcagttttcccttctataaactgcctatacattctttgtccaatagtgggtttggagtgtttcattgtcatggatttacaggagttgtttatatgttgtggacacaaattctttttcctaaatttctacccagtccatagttgttttttctattgtgtcttttgtcaaacagaggtttataagaccattttaatcaatcagatttgtccttttttcccttttgttacttgggctttttgcattttatttaaaagcactttctctagctatatattttaaagagattctcttgtgttttatttcaaaagttagaaagttttgattttcatataggtcatcaatctattttgaaagtgtgtgtagggggtattatatggcgatctaattttatcttttgatggagacagccagttgtcttaccactgtttattgcattattcattacctatctgccacttccatgacttgcattgtcacttctttcatatgtcaaggttttgtgaatataggggtttctgtggctctctattttgtaccattatcatacagctttgatagcttccaactaacaagactagatttctagtagagtgaatgtctgtgcctttttcttcctctttctcttctcttcttcagtgtcatcatc

SEQ ID NO: 127025 - DNA, 590 bp, Homo sapiens
  misc_feature (86)..(86): n is a, c, g, or t
aggtggtcctggtctccctggagctccaactggacccatctgtcccacatgcccagggcgcccgggaggtccctggaaaccgaccnatccaggctctccaggttcaccccgatatctgtcgcgctcctctttaggcagtgcataaggctcaccttttttcccttttgttacttgggctttttgcattttatttaaaagcactttctctagctatatattttaaagagattctcttgtgttttatttcaaaagttagaaagttttgattttcatataggtcatcaatctattttgaaagtgtgtgtagggggtattatatggcgatctaattttatcttttgatggagacagccagttgtcttaccactgtttattgcattattcattacctatctgccacttccatgacttgcattgtcacttctttcatatgtcaaggttttgtgaatataggggtttctgtggctctctattttgtaccattatcatacagctttgatagcttccaactaacaagactagatttctagtagagtgaatgtctgtgcctttttcttcctctttctcttctcttcttcagtgtcatcatc

SEQ ID NO: 127026 - DNA, 575 bp, Homo sapiens
tgagctgagatcgcaccactgtactctagcctgggtgacagtgagacccagtctcaaaagcaaaacaaaacaccccacaaagtatataattcagacttaacatcctgactcttgtttttactccaaggcaatgaagcaatgatgtggacgatgcgtgtcctaatccggagcgcctcccaggctaggaatccaagccaggttatggcttaaatggagaccgatggagctgctagctgagatcgcccacattggcctctgcagactcccttgttttccctaatgtgtgtcaacacatctattaaggggaaaggactgctcggtatcaatgatttccacttggaaatgtcaccatgacaactgaggaggtgctggaagcaggcactttgttaattctgtcttaacccatcccaggcaacttcaaaactttttctctggagagaaataggcttatttaggaaaggcgtctctcattgatcctcagctacatccactgaagtgaataatttacttctttggcaggtttagaaaattagatgcatacaatctaatatcccttctttgtacattttcatgtg

SEQ ID NO: 127027 - DNA, 356 bp, Homo sapiens
tcttgatcccttgctacctaaggtcttactgtggagcatactcataccatctacaactgggggaaaaaaaataacaaaatcccaaagcaaaacacttgaaaatagacttaacttatattattagcattatttttgcttagttttgttttcttaaaaaacaaattggatctttatattctttttactctaccccctaatctccccatacagctacatgaagaaattggaaaaatagaaaatacgtaaagcttttatgacacagcagagaaagttgatttgtaacagcctaaagccaagggagtgccacctttctctggagctagtccagctgctttagaaccagagccttcatactg

SEQ ID NO: 127028 - DNA, 429 bp, Homo sapiens
aatgactactctgctgggtgtggtggctcacgcctgctatctcagtactttgggaggccgaggcgggcagatcaccttaggtcaggagttcgagactaggctggccaacatggtgaaaccccgtctctattaaaaatacaaaaaattagccaggtgtggtggcacgcgcctgtgatcccaggtactcaggaggctgaggcgggaaaatcacttgaacctgggaggcggaggttgcagtgagccgagattgtgccactgtactccagcctggcaacagagactccgtctcaaacaatatacacacatgactactcattttcccccaaaacatttcctcctcttttatttcttctcttagtgatccacctagtttcccaagccagaaacctgggaggcatcacacatttctactctctccattatataaaa

SEQ ID NO: 127029 - DNA, 323 bp, Homo sapiens
aaaggaaagaatgggtgtgagggcgaagaaacaggaaatgggagaaactcttggattcctgtaaatggagattatctatgaagatgttcactgtggcattgtttacagcagcaaaaatctagaagcaatctagaagaccatcaacagaatgcataaataaatatgccacggcttcttcatacaatggatctcatatacagaaagtaagcaaactaaaaaggcaagttgcacaagaaggcccaagtaatgatactatttatatgaaactttacaatctaggaaacatggccactctgcagacaccggcgccgtcgggaaacctg

SEQ ID NO: 127030 - DNA, 667 bp, Homo sapiens
agacacaaaagatcacatatcatatgattccatttatatgaaatatccaggacagggaaatgtatagagaagaaaaagtagatcagtggttgcctagggttggtgctgattgggaggtgggggatgacaggaaatgagaagttaaagctgcatggttcaatatttttttgcggggtgaggtaaatattctataattgattgccacattggttacacaactctttgagtatatttaaaaaacactgatatttagaatactttaaatgaatgaattatgtgatttgtgaattatatcataatttagctgtttaaaaaattctaattactagaaccagaaatcaaagtcatgtttaacaactcactattatgaggccttgattttgaaagctaccaattttagaattgaatctactctgaaactgttcagagtagattctacttgtttgattaatacttgttgcatctccttcggcatgaaatgaaacctttaaaattcagttgtaaaataaaaaaaaatcagtgaggttgtccaacctctgtctcacagcacatcatttaaatttagccatctgttgttgttcttcatcagtctctcctctttttttgaacaacttcctttgtaatcacaaatttgagagggggaaggtaacccttttcttcattctca

SEQ ID NO: 127031 - DNA, 599 bp, Homo sapiens
atctctacatccatccatccatccatctatgtatccatccatccatctattcatctatctctccatccatccatccagccagccagccagccagctggacagccaggcagccagacagcctgtcagtttattggtcatatagttgatgctaatgccatgtgtctaaaatttttagtaagggagtctgatttattattatcattattattttcaatttgcttttcagctattgactgaggttgcggcaattgaccagactaccctgtgggctgataaaacctgaaacttgtctatttggttgagattaccatttgtctgtccctcagtggctggtctttacatgtcaagaggatggtaaaaactgccataagggactgaacacagtgcctcacgcctgtaatcccagcactgtgagaggctgaggtgggaggatagcttgagccaggagtttgagaccagcctgggcaacgtagtaagagccagtctctaaaaaaatttttaaaaattagctgggtgtggtggcatgcatttgtagtctcagctgctccaggaggctgaggcaggaagactgcatgagcccaggagtttgaggctgtggt

SEQ ID NO: 127032 - DNA, 780 bp, Homo sapiens
cattctatttagtcactctaagttaaaagtccacaattttcctcaatacagagacaaaatagtgttgtctttaaagctccagcctggtagaaagccgaaagaagtcgtgaggtacattcagtttactttttctttcctttatttttttaaacctaaaggaagatggttgtaatgttttatactaccgaagagtgaaaggatatgcagtaaacatgtttattgctgtcttttttgtaaactggattgctcatttatgagatcctgacctatttcttgagatcttctgtgtgctgtttgttgaaatgaatttttacatggctaaaacgcttaagaaaaaaagctaaaattgagtgtattgagagagtatctgctggttcaccacacttcagatgttgtgtcagcaacaatactttctctcaccctgttctcacacaggcaatcacaccatcacgggaaactccaaggttgggaatatacctgaaaagtggaaagaattcgggaagaatactgctgcacagatatgagactgaacaaaatgacttttaatagcccttcaaaatctcagactcttggtctagataatacgaactcctagataccatttggcaacgtttatttaaaaaaattcagttgataacattttgtgtatatacatcttctagataattattttaattcttcacctcaccttgtcaaatgtattctaacttaagtttgatatttcatctgaatttccttccctgcacaaaaattcagatgcggatatgaattgttttgccc

SEQ ID NO: 127033 - DNA, 255 bp, Homo sapiens
gaaaggaagagatgttgatggtttgaatacctgaggatgtttagataatgattgtggtcagaatgcatccagaattctaatttgtgtcctgatgtgaatgtgaccatgtttgtttgtttgtttgtttttgttttccctttggcttgtgttctgggatttgatctctcgttagagactcttactagttctttgagttgtgtatttctttctatatcatatcggtgctcttatttcctatttttcagtagagaattt

SEQ ID NO: 127034 - DNA, 145 bp, Homo sapiens
agtgctgggattacaagcatgagccaccacgcctggcccagatacttcatagacatgaagtctggggatgtttcctccttgctaaaatgaggttaacttagacaacacttcagtgatattattataagggagtgtgtatgtgtgt

SEQ ID NO: 127035 - DNA, 353 bp, Homo sapiens
gtagctgggattacaggtgtccgccaccacacccgggtaattttcgtatttttagtagaggtgggggggtttcaccatgttggtcaggctggtctgtaactcctgacctcacgtgatctgcctgcctcggcctcccaaagtgctggaattaacaggcgtgagccgctgcattccggcctcctttacatttttatccgttacctttaccgttgtcatagaagcaagggtgtcaggcctcaggtatgcagtatagtctgtggacccatcagcataagtgtcacctgggagctcattagaactatcaggattcatcccagtcttactgacccagaatcttattttaataagatccc

SEQ ID NO: 127036 - DNA, 463 bp, Homo sapiens
ccaccgcaggaggcacttgaaggcatgcaaagctccacctctccacctacctcctagggccctgggtggcactcctctgctcctttcctttcttcttctgttaccgtatcaggtaaggccactttctactcttagttgaaatttacagttggtagccatggggaaccattagagtctctggtctttgattccctgggagagggtgggtctgacagtggccttcccacctgtgtgatgaggacagctgatttctgtctcctttgttctcagcctcacatggggtcacagggaaaaggaaaacacataaaagatccccagggctcagatttggggttgcactgtttttagtccagagccagctgtccttggcatccgtcaggcagaggggtgaggtgattgctggtgtttgtgacactacaggttgagtgtccctttgatatttgcttggggaccctttccagaa

SEQ ID NO: 127037 - DNA, 692 bp, Homo sapiens
ttcagttcacaggcacaactgactcttctattgggatgattaactatattgtgcataagtgagagtcagctgggggaaaagcagagcatcttgttcagactttttgaggggagaacgtattgttaacacctctaccctccacacatttagtgctgatccccaaaagcaagagtgtcacaaagaaagttttaaaaggataccaagattctcttaaaggagcttatcaggtttactcaattctaagaaaagattctggcacacatctttgattacgaaattaattttagctaaaggtctcccattacactcagctccttatgcagcttccacactgcaactgctgccaatctcaaactccaggtggggcagtcagggggctgctaggtcagtgggaagcatgggaagtgacacaagtacagagttcaagaaacagacttcaataacttgctacaaagcagagttgtgtgaacagtcttgcacagtgattttttgctcactgtgtgatatgaatctattattttattgtttggcaaaacctttatctggtaataataattttcagttttttgttgcccacttttgctttcaaaagtgttccaacttgcatgttatatggttaccctatttatgaaggaatcagaacacctccctgcactggtcaatcagcctgaaactctcctgccggtctctta

SEQ ID NO: 127038 - DNA, 227 bp, Homo sapiens
ggtagagtttcaaaaatatgtattgagaacctactatgtgtcacactctaaggatacagtggttatccctaacaaggtccctaaccctcaagaagcttacatggtagtgcgggagaaaagacactaagcaagtaaacaaatacgtttcagggagcaccaatgtttctgaaaaagcagagtaatgggataaagggtgactgaagtgctggagtattttagatagcatg

SEQ ID NO: 127039 - DNA, 620 bp, Homo sapiens
ctgtctgtgcggccagaacacgccgtcagaactcgcggaaccagctctctccccaaaccccacactgcccggccccaagagacccaagcggaagcgggaagcagcggcgcttgttcattctggtgtcaatacgctgcaggcgctccggtttctccaagatcagcacagaagatctcaccgatcccacacaaggctgctaagtgatccagagggtggcgcagtgtggaactctatctttacccatgtttaataaagactaacaagttaaaaaaatacggctgggcgcagtggctcacacctgtaatcccagcactttgggaggccgaggtgggtggatcacccaaggtccggagtttaagacaagcttggccaaccatggccgacatggtgagaccctgtctctactaaaaatacaaaaattagccgggcgtggtggcaggcacttgtaatcccagctactcaggaggctgaggcaggagaatagcttgaacccgggaggtggaggttgcagtgagccaagattgtgccaccgcactccagcgtgggtgacaaaatgagactgtgcctcaaaaataaataaataaagaagaataaaagaagatgtcttgctgagactgcct

SEQ ID NO: 127040 - DNA, 380 bp, Homo sapiens
cccttaaaaccatccagacttccccatctcccattcctctaagaaggagtgtatataagcatctgtaccccattgggatatggggcagtcatccctgcattctcccccttgcacactaataaatttatatgccatttctcctcttaatctgccttttgtgagttaattttcaacaaacttttagagagcaaaggggatgttttcccttggcccctacaatggactcaactacactgccttattacgggctgaaatgtgatatgaatggtatatattatcttcaaacaaaaggtttgagatgtgactgcttttgagtttcttctttcttccttttcatcaagtttgccttttcagtctttttttttgagacggagtcctgc

SEQ ID NO: 127041 - DNA, 186 bp, Homo sapiens
ttccttctcacactacagcacaaacagtaatgggagtgactaccctcttctggatttcctggctgacatatgggttctttcagtactttcactgtaaattttttatgttgtattccctattgtcctttttttgtacaaactcagagatttcagaagatgctgtgctcttcacgtgtcctctgagat

SEQ ID NO: 127042 - DNA, 565 bp, Homo sapiens
ggtcatagctgactcttgaggataaaactgcgtcagcgagagagggtttattaggagaatcagctcatgcaattatgaaggctgagaagtctcatgacaggcactctgcaagctggagaccctggatgatagcagcatggctcggttcaagtccaaaagcctcagaaccaggcaacctgatggtgtaattcgtagtctaagatctaaggcctgaggactgaggtgaccaccactagtattagatcctggagtcccaaagccaaagagcctggagttatgatgtacaagaacaggagaaggagaaggtcccagctcaaagagagagaggaagaaaaaaatgcttttccctccttttttgttctatccaggccccgaactaatcggatagtgcctatcaaactgagggtggatctttttcattaagttcattgactcacatgcctgtctgctctggaaacactctcacagacccacccagaagtaatgctttgccagttctctaagtattcctcaatccaatcaagtggacatctaaaattaatcatcacatgccctgatgaagggg

SEQ ID NO: 127043 - DNA, 362 bp, Homo sapiens
cttaaaaaaaaaatatggaccaggagtggtggctcacacctataatcccagcactttgggaccctgaggtgggtggattacttgagcccaggagtttgagaccagcctgggcaacatggtaaaaacccgtctctaccaaaaatacaaaaattagccaggcaggtgtggtggtatatgcctatagtcccagctacttgggaggctgaggtaggaggatggtttgagcccaggaggtggaggttgcagcgagctgagatcgtgctactgcactccagcatgcagatgacatgacagagccagatgccatctcaaacaaacaaacaaacaaacaaacaaacccccataactcagttccagtaaat

SEQ ID NO: 127044 - DNA, 295 bp, Homo sapiens
ttgagccatgtggtatcagctcagccttctcagagacaggagcctgagatctgccatgtgggtggtcgactatgtcaatgtgatggagccccagtaaaatctctgtaccccagggcttgactgaacttctctggttgacaataccctatgtgtattgtcacatgtttttgccagaaaagtaaagttgtccatactccctggggagaggacaactagaagctccacaaggaaatgttcttggaccctgccccatgtccctttacccttggctgattttaacctgcaacacttccct

SEQ ID NO: 127045 - DNA, 519 bp, Homo sapiens
ataggtttcttgatttagttaagaaccttatttttagcatcacaaaatttgtattattcctgcaaaatcaaatcatttcatctcctatgttgagctttttacaatttacagtagcatttacaataatatgagacgttttacctgtgacaaaataaacttccacaagctttattttgatcccatgagataaatgaaaaaaaatattatttgaattaattgattttctgtttaaaacacctggtaatactaacataaaactggaataatttaactcttggtgaagtttttttcttctgctaatgaagctaatacattaaagtcatcgtttcacttttcatatatgcacaaaaaaacctgagttcaaaaataagcaaaatcaatttggaacaacagacatttcatccaaaagaaatgtctcctagagtgctatgttagtaaaccttctgcagctgcgtatgttaaatcatcttccttaacatagtcttgcatcattattaacatttgaagtagttgctgttg

SEQ ID NO: 127046 - DNA, 514 bp, Homo sapiens
aagacaaggaagagagctgtccctggctcggctcctgccctgagtgactgttgactcacagttctctctccaaggggacatgggcctgtcctaatgctgccttaggggcttggctccagctggccctggggtctgcaggtcaccacctgcctctgtgcctggctttgaatttcctaacatccagagtgccctgggagtacagtgtccagcccgttgtgtgcagtaaacgtggtgttcataaccgggagctgggcagaagaggaacgacagagtccccctgcggaccctgggggctctgtatcctgaagttcaagcctagctcaccctgctgtgggcccagccctgcctgcactgacagatggcaccagcagggggcgcagcgctccgccgccacagttctctgtccccacctcagtgcagtcagccctggaccccccaccacttgccccccatagcacacagagccacgggccttcccagcccccacccctggcccttggtcactctcacctgc

SEQ ID NO: 127047 - DNA, 318 bp, Homo sapiens
ctgagcacagaggctgctctgctggtgggggtggggtcacttctctcagccccagactgtcagctctcaggattatccacctcggctcctggttgcagcaactgctgtggcagtatgtggagcgagcacctctggctcccaacttctcctgactgagctggccactcgcttccttctcctctgtgcctcaggcgcttgctgagacttctctgttggactctagtgctctctcctggatgttctattcgaggtgtgcttatctcttcataattttgggtcttctttctggagagggtgagtgtccaatgtctctagtca

SEQ ID NO: 127048 - DNA, 126 bp, Homo sapiens
cctcccatactctcgtcagtcatgccgcctctgttttacaggcgaagaaactgaggcctgcagcagtacagccaggactcaagcaaaggctgctggactctggacacttaagctatcaaccaccag

SEQ ID NO: 127049 - DNA, 263 bp, Homo sapiens
ggattacaggtgtgagccaccgcacccagcccacttccctgttgattctgtctctctggaagaaccctcactaataaactttacttgaccttcaaaataataatgctcaaaagacaccctcatttggggtgccagagtctggcatttgttctctaccagtgcctggtagcaaatctgaagctgtgtaatgcttaaatggagaatagtcattttcagaggagggtatatctttgctctaaaccccttggagtctgtgctgtgac

SEQ ID NO: 127050 - DNA, 713 bp, Homo sapiens
gagagaaaaggcacatctttgtcaggaagttaccaggaatgaaagaagaaagggtgaataaaaatacataacaatttgaagtgcagttagaagagagatgacagtcactggaattggagaattatgtcctagagtctagaaagttgtcactgtagattgtgaagttgtgacagtgaagatggacaggtagagatgatactgtgagcccagtgctgaaaccatctaggaaggtgtctgtaagtgaacaaatggaccttatgaagataggtcatgtcctatggtctggtaatggtgttggggcagcagagcccctaccaaattccttatgctaaagtgttgggattacaggcatgagccaccacgcccagccccgtttgcttttttatgaaaagaatcactaccaatattttaacatgttacttgggacatatttcagcagctaggataacacataataggggaatcactgggaaattttatcatcttacctatacatgcgataaaaatctattaaagtcagctctatatcttggagcagaccttgggggaaaattagtgcagagctgggatttgaaggatggtgggaattggacacatttgagcattttctcagtggttcttgcatttcttcctaatttatcaggcctcctgatgtgagaaaagtaactacttaatgagagatccaaaataaagaagcagccatctgggtagtt

SEQ ID NO: 127051 - DNA, 133 bp, Homo sapiens
ctgctacttcctttagaaattattttgttgaagtaaaggactctggttctctaaaacagagatcaaataaagggagacattgctaaaaggatacatttgggggctttccctagaggggaactccctttctgga

SEQ ID NO: 127052 - DNA, 432 bp, Homo sapiens
gcttcccaagtagctgggactacaggcatgcaccaccatgcctggctaatttttgtatttttagtagagatggggtttcactatgttggccaagctggtctcgaactcctgacctcaggcgatctgccctcctgggcctcccaaagtgctgggattacaggcataagccaccttgcctggcccacactgaatataaaatgaatagatgagtaccccaaaagcttcgcccagacctagctggcagagtagggtaaaagaatagttgactgtgtgcactggggcggcatcagccttactgtccacagcagggatggagacagcagtgctcctggcagccagcagctcctgcgggtggaaggtggtaaagcagtaaagtgaagaaggcggaccctgaagccagactgcctgggttcaaatcctggccccaccact

SEQ ID NO: 127053 - DNA, 545 bp, Homo sapiens
cctgcttcaccatggattcacacctgcacgtcacttatgcatcaaagtcttcactgaccccaaaatacgactctctagattctcttcctgctcctttgggcctcttccttggtggtctcagcctcctcagtgttgccccagggtgagccttgttatcacggtcccttgcccatggtgtcctggtgcacgcccaccctctcctgccgttgacatgccaacaaatcccaaagctcccttgtcagctcagcatcgaccgaggtccagcccagagagctactccctcctggatgtcccacataggctaatatagcaacccccaacatccccagcactttctttatctgtcctgacccacctgcaagttttcccctccaggcttgaaccaggcatggataaaggtgtttaggctgttgctcaagactctgagaaatccgccatcttgctaaatacagagaaagccaccctgcttggccctgagccagagtcctcatccctgagataaactccataccctgacccctcatggcagacatgcctgggtggga

SEQ ID NO: 127054 - DNA, 397 bp, Homo sapiens
agaaaagtaaaggaggtgcaattatagcacacagatttaaaaaacaaagcaaaataaaacatttaatgttagtaagatgatagtatagtataatagttcaaagcaaggatattaaacccagactgcctgggttcaaattaatccccactttactagctgtgtggccttgggcaagctatttaacctttctgtgcctttgttcttcttctgtaaaatgaagatgatagaacagcacctacttcagagatgtgaggctaaaatgaattcatacatgtaaagcatatagcactcagtgcctggcacataggaagtgctggatgtgtttgctgttcctgcagtgatatggttaaatcatagctccaaaggcagaagtatgctaatttcagtcagtgtgcag

SEQ ID NO: 127055 - DNA, 657 bp, Homo sapiens
acctgattagaacgttgtttttccaaacagcatctttttctcatcggtcactgtatcactctgatcactgccccttgaatcttcttcctcaccctttatttcacccagatgagccagggtttaccgtatgtgggacttcaggtcatggcacaaaatggttctcaacccttttgttgagcaccggtttgctggtgctctttttagacacaaaccctggaataaacgtgccctttccctcaaagggaccccactgtggattcctatccactttgttatcctttttactcttagatctctgcctcaccactttcccaggcagcctctgctttttcatcttactgttctcattttcgcctggtgcgttcgtcagcggctttttatgttaaacttcgcagatgagccacgcctgaagttattcctgtccttctttctctccggtgtattgttgttgacaggtttttatctgttgttttgaattttctgtgacctttggggtgggcagagaaaaaaaaggacaaatgtccaccatcggccggtctgaacgccacatttaatgtgttctttttgagtgttctaacccttccttcttcctgcacacatttaataacagagaaccaaaaaaagcctagttgccttcattcatgaatatttgggaca

SEQ ID NO: 127056 - DNA, 299 bp, Homo sapiens
ttttgtaaaagaacattttgtaaaggacacatgtaagaacatgtgtcctggagaacttgtattcagattcaaccagttaaaactaaactaaattgtttgtagaagtagccctctacaaacttcaatatcaacaaagcaatttaggtgttttgttacattgaatcagtgacactataatgttacttcacaatactgctacgccatgactatcatatgacagcgatataaaagaaagactttttttaacttgtcaatttactttttaaaacatgttttttgcattggtttcatattttacc

SEQ ID NO: 127057 - DNA, 461 bp, Homo sapiens
ggccctaacctcctgggctcaagcgatcctcccactcagcctcctgagtagctgggactacaggcatgagccaccaagcctggctaatttttaaattttttgtagagatgaggtcccacagtgtttcccaggtttttcttgagctcctgggctcaagcaatcctcacctcagcttccgaaagttgtgtacgtattttcatggtgatcgcattgttcttttggctgcctagaaatgcccttttgagatggatttaatacagaggaggaaactagggatccgaaagtttaagtaacttgctcatggtcatagattagtaagtgaaggagccgttattcaaacttgaatctgtctgtttccaaagcccgggctcttgccatgtaatcacatttgctccttgggctgccgacgtgaaacctacttcctttcagtggcctgcctgtgctagctgctatattgcctt

SEQ ID NO: 127058 - DNA, 455 bp, Homo sapiens
aattaagagcctgtatatagaactttgtccatgagcatattttccttgacccatggagtgttttacagaaattcaattccattttttaaaatcatgtatttaaaatgaaaatacagattaacagcttctcttgaaaaactggtagatctgatagctttgaggccacattcccaaacagcaatggtggctggagccaaatggccagcatgaaacaggcattctcctcctctccacagtccccaagactgtcttcctcaccttgagcttatgccggttaccctctatcgtcccacttgccctctttttttcttacagtagaaaaatatttcctcttatcccaaggcctgcttttactcattgccattgtttgccaggcccctgcaggcacttaagtttgtgagtccgctgcagaatgatggagtcaagagaggagctgaaaacacagacctctggct

SEQ ID NO: 127059 - DNA, 692 bp, Homo sapiens
gggtacaatagttatttattgttgcataacagattaccacaaatttagtagtttaaaacaacatacatttttattatggcatgggtttccatgggtcaggaatcggcatagcctagatgggtcttctgtttcagggtctctcacaggaggtagtcaaggtgtcagccagggctggtgtctcatcttagcgcttggctggggaataatctgtttccaaactaacttggttggtgacagaattctcttcttgaagggatgttgaattgaagggcttggtttctcactggctgatggctggaggttgctctgaattcctttccatgtagcttcttcaacatcacaaagctgagaaaggaatagcaagtctcctaggaagatggaaatcacaattttttataatcatggagtggcatcctatcacattttccatagtccgttagttagaagcaaatcaccaggccagtccatactcaggaggaagagattacacaaaggcatgaacaccaggaggctggagtaattggtggccattttacaagtctgtctaccacagacttctttagaaaaaacaatcctaaaatttgtatggcaggcaccacaaaagaccttgagtagccaaagcaatcctgagcaaaaagagcaaagctggaggcagtacacttcttgacttgaaagtatacaaaactattgta

SEQ ID NO: 127060 - DNA, 768 bp, Homo sapiens
gtagtcctcagctaggggtgattcctctttcacaaaccccgagggtatttggcaatatctggagacatgttgactgtcatgactggagggatgttactggcatcttttggggagaggcaggcgttgttgccacacatcctacagcacacaggagcacccccacaataaatccaaccccaaatgccaatggggctgctgctgagaaaccctgctgtagataatggggagtttttgtaaagcctcaatgagctccatttcattccatttttagatttttttggaaatctgaatgtacacaaggaaattattggttaggattgtgaaaaagtaaaaggactaaactgacatttaaaaaattctttgtgaattagatacttgggacattagcctgaggattttaaattaatagttatagtttagcatataagagcagcagctttgagtaggttatttagcctttcttataggaactgaagatgcattttaaatatgaatatgaatagtatctgcttgttcttaggtttgattgttttttcctcaatttccagaatttcacaaagaaaaaaataatatatacacatacacacacatacacacacacacacacacacacacacacacacacacacacccctatatattttttaacagaatagaaataccttaagtatacccatttgggcaactattcccattaacttatcattagaaacattgatgttaatactttccattaataagctggaagtcaaaatgtaccataataaa

SEQ ID NO: 127061 - DNA, 698 bp, Homo sapiens
cagaacaattgtttttttgtaaggtagcatgagcaatatcaaggaaacaagtgggctggtctcaaactcatgacctcaggtgatccacccaggtcggcctcccaaaatgctgggattacaggtgcgagccaccacgcctggcctaatcccctttctttatgtacaaatctcaaacataatatactatttactgttaatatgtctgtgacattgctcataagattatctggcatagaatgtttttgccctattgttttgcctgggaattattgccaggggtgcatatagctcagtaactcaaatcagggcccagtaccacttcatagctgtgtcactttgtgaattgtgtatttagctcctccatccctcctgagaattatggataataatagtatgtgccagttaatgttggtatgaaccaatcgatgagacagtcaaagtaaaacatctgggacatagtcctgaaacattattagcttaaaatggttgagtgaataagtacgggccttgacagctcagctcaggtgtggcattccatttcactttgcctgattttcttccagccctcctcccctttccccagatcccacatcagaactaatgttaccctgtctttccctgaaatgtttttcatacagagagtttagtatacttaccattgatctacttttcttttagttagttggggattatttcag

SEQ ID NO: 127062 - DNA, 355 bp, Homo sapiens
ctccctgtgtccagcctccactcccacccctgcagttcctgctgcccgacccgctgcctacctcatccttcatcccggacggttcctgtaaccacccctcccaactccctagtctcaggatccctgccccctctgggcccttattgaccctactcttcagccagtggtgtcccccttggtccccctactcctggggaccagcccagaagccaccagtggcccccctggctgtctcctcctggtgtgccccgagtcgtggccttagttgagtcccatgtccacgagccgcgagcttagtagtagggaagggcttgtcccaggccctccacagttccggggctgagtatccttccct

SEQ ID NO: 127063 - DNA, 246 bp, Homo sapiens
tgtcatcaccatcatcatcactatcattaccatcaccatcaccaccattatcactgtcatcatcacctttctccatcaccatcatcatcatcatcattatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcacc

SEQ ID NO: 127064 - DNA, 571 bp, Homo sapiens
atctcaagtgtcactttccacggggggataactaccccagtgacaccctcctccagatttggttagcttctcccattccagcctagtttagatggaatcatattaagttgctggcattaatttattatgacctacaaaaccatcaatagtgtacagttctcacaactcccttgtacattgcagccctcatcaaaattgttatgaagtaattgatttgaataatgattaatatctgactccctgatggtttataatctttgtggaagtagacaacatatctatcttgtctactgctatttagcacatactaaataccacctagtaaatatttgtttaatgttacttatttaactgcagagatatactttttacattttctacatttaagatgcacacggaatatgcgatgttgtggagaaaagagctatttgccaaatggttacttgttactttatttttctaaggctttgggcataaaatgccattatggaattactattttattacaatggtatctgtagtactttggccctaatgttcttttttggttatgatgctgcactatgcctgt

SEQ ID NO: 127065 - DNA, 130 bp, Homo sapiens
tcgtttttctctagcttctttgtaactggtaaagacaccatctttagagccttaactggagatcgtattatagtctcattcttttttctccccagttttcaagtcattacttgtaaaaggcttttataag

SEQ ID NO: 127066 - DNA, 530 bp, Homo sapiens
ctgcacagccatgcgcacacatatgcacacaaatgagtatatgtaaaactggtgaaatggaaataagctttgtggtttgtacttaatgtcagtttcttggttttgaaattatactgtaactatgcaagatgtgacctttgcataacatcttgaaaccaggtgatgggtcctcaggggcctccctgattttgttttttaatgcaatttcttatgaatctgtgattatttcaaaatgtttaaaaaaaagtagataagttggaacatggcagcacaagtgagagagattagagaatcacttgcttttttttttctaagacaaaaatctctatcttactcagcattgtgctgaaagccatctttatttatttgtttattcttttcctgacacaggatgtcactgtgtcacccaggctggagtgcagtagtgcagtcttggctcactgcaacttccactccctaggcttcagtgatcctcccacctcagcctcccaagtagctgggaccacaggtgcacaccaccatgcctgact

SEQ ID NO: 127067 - DNA, 697 bp, Homo sapiens
gctgtgattacaggatctttaccgactagcccgacaggcctctttttcctctctggttgtctgtctgcttctctggctgtttgcccaccactctctctctagccatctgtctccccgcctgcctgtctctatcacttttttagcctgcatctctcggtttgtctaccttccaggccctgccacggctccccatcttggtttgcctcttctcttgcccttctgcttgttccttctcttatttgtgcctgttaagttcctccttttcccttgcctccctttagatctctcttgcctgtctaccctgtttgctgctatcccaccgtttcaggcttttctctctttagtcttcatacttaccagctttttcttcctttgcttcttctctgccaacttccatcaatgaggatagtctctctcccctaaacctctcagtaacccctttgcctcaaagtcttatctaacttcttgccacatcccctaccctgccttctctcacgtttgcctttatttcagttatctctttttctgtctttctggttcctcagacagtctgcctgtctcagtctttttgccattttcccagtctctcgctgccttcctgcctttttgctgtctgcttggcaggctcttgctgtccacgtctcttcttgcttttctctcttcttttgtttctttttccagttaacttctaaatagg

SEQ ID NO: 127068 - DNA, 462 bp, Homo sapiens
  misc_feature (35)..(35): n is a, c, g, or t
  misc_feature (49)..(49): n is a, c, g, or t
  misc_feature (56)..(56): n is a, c, g, or t
  misc_feature (63)..(64): n is a, c, g, or t
  misc_feature (66)..(67): n is a, c, g, or t
  misc_feature (74)..(74): n is a, c, g, or t
  misc_feature (76)..(76): n is a, c, g, or t
  misc_feature (91)..(92): n is a, c, g, or t
  misc_feature (96)..(97): n is a, c, g, or t
  misc_feature (100)..(100): n is a, c, g, or t
  misc_feature (109)..(109): n is a, c, g, or t
ggagttcaagaccagactggacaacatagcgagancccatctctacaanaaatacngaatttnntnngtatttntngcagagatggggtcnnggtnngtngcccaaaantataggtggtgacacgcacctgtagtcccaaagtgctgggattacaggcgtgagccaccatgcccggccaactttacaatcttaaaagtttgtttgattaattataacttggtgaagatgtaaatggtgcatattacatctattaacatatctcaaacccaaagaattggtgaaatagggtattaattccatgatgatgataatggctaatacaaagggttttctgtatgccatacctttgttaaattctttacacaatgaataatcttcaccacaaccctataaggtgggttttgttgtatctctggcaattatattgttgtatctctgtgtattagtccctgtggaaaagt

SEQ ID NO: 127069 - DNA, 951 bp, Homo sapiens
aattctagtcagccaagtaaccctccctcggcacccccacctaaacatctgtagtcagccttgggtgttattcatggaaagtccactgcatgcgggtcagcactgctgtccatcggctcaccctgaccccttctggcaggtgtggatgagagtagagcagagctcatggggatgagttaccccaaacctattaagcctccctatccggggcactagtcagacactccagttttacactctttcctagaaaaacaaaacccaaccttgtgccctctgggttctctaatttagcagctactatctgtctgtttttggagtgacaccctgtgcagtttaggatttcagaagctgtcctgcatagaggcagaagggaaaacagcaggtatcttgttaacattctctatggggcaaggcagatgtgcccaagctggaggaaacctgcacaccctccaggctagttatccaaggcttgggaggtttccctcggccttctcctaaggccttggcaggaccctgccaccctaaaatcaactgctgattgcctttttagatttaaatgattaagctctgcttatgggaatcttcttctcttttattttgttaagaaacaaacaacaacaacaaaacccacaccaattcttagcaaaggggaatatcgaattcagattttgaaaaaataagtcatcatgcttcctaaaataagacagcttctccctctaactgctctctctgctctggtattctatctaatcataaacccagctttattattcatttcaactcctgccaaagacatgaggtcggagtcagaggaactccccttaccaccgccaccatcatcatggccagcatcctcgtaagtttatagaaagatgccagagaacctttcctatccatctgcagccctgcttggcccttgcctcagtgaatttaccactatcataatcacag

SEQ ID NO: 127070 - DNA, 433 bp, Homo sapiens
atatgtcaggttattgggtaatgtttaaaaagttgtggaatgaaagagactctttgtcattcaccactaccatcttgtttgtgaaaatacttatgaaaacctttcatcaatttcaaaatatcttcacagaattcatttgaatttacaacctggccagggtttttggatgtttgatagtcgctggttggttaaaatggatgaatgagatccggcattcagtaataataataaaagctattatttgttgttctactgtggttagagactgtgtggagtacagtgcatgcacatatatcatatagctctccctatttgaggagttgagaaaactgatgctcagaaaggtgaaagtttgacatactcaggtcacatacctaatctgtggcacaaactcaaattctgatttgttgggttcagtccaaacacttaagcc

SEQ ID NO: 127071 - DNA, 504 bp, Homo sapiens
aaagatgagggtgttctggtgagacagcttcactttctcaatcggttgaaagcaaccattcacctggtacttcccactcttctgagtaaggctaacccaatgctggtaaacagctatgtttatttttgtttttgtttttacacacaactcacacttctctgaatagccatgtttaaaagcttaactgaagagctattacaaatacaaacccataaagtaatcaggaataagtcatcaatctttccaatatggtatttgggagaaaatatacttaggattacccctgggtttagagattacctttaagccattcagagaagactgtggctctgattaagatccattctcttgtcccctcctttggctgccattttccaatgcaatgataaggtctgacagctggtagaggcagacatctgatgaatgcaaagacttttatttgtccagatgacagaagaatgtgaagaaactggtcatttgaaatctagctccatcatgctctcc

SEQ ID NO: 127072 - DNA, 526 bp, Homo sapiens
gtaacagagtgacaccctgtctccaaaaacaaaaaaagaaaacaaaaataaggagagaggaacacaagtactaaataaacctatagaccaaacagaagatcatgttacttgagccaagctcacgttgttcatctgactataggaggttgctgttctttcttaaaataatttggaaaaaaaaaaaaaaaaaaaaaaaaaaaccttggcgcggcgcgcgcgcccggggccctcgggaaaaggttttaaagaaccatcgcggtggggcgcgcgcggggccccagaagggaaagggagacaggggcaaagagcgcgggtcccaagagggaaaccggggcccgggaacaaggggccggggaatcttctccccaaattaaaaagagcgccggggggcaacacgggagcgcgttcggaaacaaactcccaagaggtggcgagttcggaggcgccaataaggggaactcatacaaaccggggagccaaaggagaacctggaataccaaataagcccggaccgcgggggagcgag

SEQ ID NO: 127073 - DNA, 473 bp, Homo sapiens
ggattacaggcatgagccatcgcatctggcccttggtacagcattttggattctatgagagcgtccttatttaaaccttaaatccagttgagtgacagaccatataatcctttaacaagggggctgctgaaagctgtacatgcagtcctttgttactgtactctttgggacaagtgccacagccatccccacttgtaagggttttgttataaactcccaccaatgcctgggagtgagctattctctatcttgtgtattggtgtcattcagtctcccaaactagaaacgtgggccttaccctgaattgtgacatttcctcacagcatacagccttagaaattgtctttgaagtctgaccctcttctacctccttactgcctgtgccctggcctggcttttcctctcttctcttagatgattgcagtccctcctaatagatatccctacctcttgtctccattgactttgttctc

SEQ ID NO: 127074 - DNA, 247 bp, Homo sapiens
ctaggggttggggggtagggagaaaaagaaggaagagagttaccaaaagtaaacataagacaaaaccctagtggtatagatggaagactatgttccagtaaaccagagagctggttcctccctcgactctgcacagccactgaaagtttaaagattgcaaaagtggtgtggggcaaggaggtagagtcaatcaatgaaactgtgaaaactgtttaagtagcactgctcaaggagaccaggagagaag

SEQ ID NO: 127075 - DNA, 655 bp, Homo sapiens
tgctgggattaaaggcatgagccactgcacccgacccaaccatttttaattatacacttcagtgtctttaagggcattcacatggttgtgcagccatcaccgccatccacctccagaagttcttctccaactgaagctctgcactcattaaacaactccccttcctcccaacctttggcaaccatcatcctgctttctgtctctgaatttgcctactctgcattcctaatgtaagtgaaatcatacatcatgtgtccttctgtgactggtttattttacttagcatgtctttatgcatgtgccaggatttcctttttaaggccaaatgatagttccttgtctctataccacattttgtgtatccagttatcagatagcatttggattgtttctacctctttgcttttgtgaatatcactgttgtgaacatgggtctactgtataaatatctgctcggattcctgccttcaattcttttgggtatatacccagaagtgagattgctagatcctatggtaattctatgtttattttttgaggaaccattatgctgttttccacagtggctacaccgttttatattcccactggcagtgcaaaagtgtttcaactcctctgcagcctcaccaacacttattttctgtttttttttttt

SEQ ID NO: 127076 - DNA, 984 bp, Homo sapiens
ggcggtgcggagactgaggttagaaggcacaggtggcgagatgagccgggtaccagcgttcctgagcgcggcgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccggcaccaaagaaaatgcagagaagtttggcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgtggagccagcagacctgactggagagaactggatgatgagctcatgaaagaagctgtgctgtacgtggattcccaggaggctgccctgaaggagtctggagatgtcctgctgtccgagatctttgctgagctgggagaagtgattaagggagtgaaaccagcccactgtgagaagaccaccgtgtacaagtctttgggaatggcagtggaagacacagttgcagccaaactcatctatgattcctggtcatctggtaaataaaaaca

SEQ ID NO: 127077 - DNA, 922 bp, Homo sapiens
gtgagatatacctttcaccttctgccgtgattgtggggcctcctcagccacgtggaactagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccggcaccaaagaaaatgcagagaagtttggcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgtggagccagcagacctgactggagagaactggatgatgagctcatgaaagaagctgtgctgtacgtggattcccaggaggctgccctgaaggagtctggagatgtcctgctgtccgagatctttgctgagctgggagaagtgattaagggagtgaaaccagcccactgtgagaagaccaccgtgtacaagtctttgggaatggcagtggaagacacagttgcagccaaactcatctatgattcctggtcatctggtaaataaaaaca

SEQ ID NO: 127078 - DNA, 120 bp, Homo sapiens
tgattacaatggattcactaggccaggtcaagtcaatctctttgttttaagtcatctgtttagcaaccttaattccatgtgcaattttaatatctccttgccatgttacctaacatattt

SEQ ID NO: 127079 - DNA, 206 bp, Homo sapiens
ggttattgggctgtgctgagaattaagtgggataacacgtggcagcctttttgaaacagctttgccatcctgcagggcttcataactccccagctgggtccagccttgacatttacatagaactgtcttatccataaaattgcacctggttcccacaacagccctctggggaggtattcctttctccattatgcaaataatgagat

SEQ ID NO: 127080 - DNA, 784 bp, Homo sapiens
ggtttcaccatgttggccagactggtctcgagctcctgacctcaagtgatctgcccgcctcagcctcccaaaatgctgggatcacaggcatgagccaccgcgcccagcctcggcccagcaattcttcttgaagctgtcagtcatcctttgcctcattgaaaatgtcgatttttggctcactctgcctgttttaaggaccttggaaaagtgacaatctcacattgaccaaaactttccatttgctcataagctttaaggacttcttacacgtagtcttgtgtccttgtggtcaaggatgtaggtccctgcttataagccccacctcatgttctcatcactgttgacatcatggctttagctgaagtgtctctttctgttattagttactcataaatgtcgtttattaacaggaggaaggttattcttagaattatttctgatgaggtatttgtatgtgtatagtttaagtcaggggattgtctgtaatccaacgcagtctgaaatagtttttggaggttggcatagtttcatttcaccctgtccaatttgttcagagaagcctggaatttttacatgttagtaaaagaaagaaaatctgcctgatttaaaaattagtggcttttaacaattgtatctatgatatgaaaaggagagatttgttgcaacaaaagactttctattaataaagtatttgagtattttctgtgtagccatgtgggtgtgtacacgataggtaaatgtaaaatatgatccttgcttttaaagaacttgcttatttgggaaa

SEQ ID NO: 127081 - DNA, 554 bp, Homo sapiens
tatcttgactacctttccccagtagcaaacttgaacatataaggatattcttctaggtggctctcttcaatcaggccccaaatgaccagatgtcaaataagccaacataaacttgacagtgatcctggctttgaatgccaaggtcaacacagcattcacccgtgttacatccccattaaactctcttcagttacagtacccaggcagaatttgtgttagacagagtgaaagttgtctgcattgcttaaaacctttcatacttttcattgataatttttcagtctttctactacacaatgttagtacgattgttaagttagaattagatgaaagttattatgtgcaaacttactgtgtggtctaaaatggccaatctcacttctcaaaagaagacatacacatggccaacaaacaggaagaaaatgcttatcattagagaaatgcagatcaaaaccacaatgagataccatctcataccagtcagaatggctattattaaaaagtcaaaaaataacatgctggtgaggttgtggagaaaaaggaacacttataca

SEQ ID NO: 127082 - DNA, 212 bp, Homo sapiens
ggtgggagtttccttttggggtgatggcactgtgaatgtattaaatgtcactaatggtaaatcttatgtctattttaccaaaataaaaaatagatatacataaactttaccacaccaattctattaggatgttattctaatgctgaaatcatgaatgtgacaaagatgttataaaaccggggttgattatgtaagtatcattgctgttatag

SEQ ID NO: 127083 - DNA, 520 bp, Homo sapiens
ggccttgaagccacctcagattcttcaaagagctgaccagctagaacatgaacttagaactactgccctcccaatcacctatttacgctttaaccttcactttctacgattaacagatatttactttacttaatctacttgttagtgtgtataatatctatacatgttgatggcaccaacttgagtatattaaaacacccccttcatctcccttactgatatcagcctcattgaggctcttcttacctctctcttcaatctctgtccaaacaccttccacggggcgtcaacatctccaagttgtcccatcccaacctatcctatgacctgctccaatattctccttccctaaactcccttgcattctgcagcttccatactcaaaacctttaagatctcttgaatgtttctacgataatctccggtcctcttagccagacactcagggccctccacaacctgatgacaacttcatagctccaatccagtccaaccaatccagctccaacccaaccttgtg

SEQ ID NO: 127084 - DNA, 470 bp, Homo sapiens
aaagaaggaaggaaggaggacagacataccttcagcagctacagggaagatgaggcgggctggaaccactcactactgcccttcagaacagtatatggaagcacacgttcattggacaccagcaccattgtggtgacaccggatggtgggcctctcactatccacagttcctggtggttttgggggctgccaaaggcactattaatcatcactccgccccgagctccatcatttcaataacatactgagccaatgtgctcaagatctgcacagagctcctggagcgagccagtcctctccacttagcccttgggtgcctgtttatttcactgagccttctgccctgtgaatgagggcttcctgccaggtatcagccttggcggccaacaggtgggtaatagcacacagggtcatgcagccctttcttcccagagaggtactcatccaaccagtggtttttgatgagaaag

SEQ ID NO: 127085 - DNA, 142 bp, Homo sapiens
ttggtgtcctggtttatttttcagatagcaagtctgtcaaagagaagacacctctggctatgctaagcacatccaacaatgaatgaggatgtgaggtagaccagaccctggaatggttgtgactctctaaggtattgtctga

SEQ ID NO: 127086 - DNA, 297 bp, Homo sapiens
aaagtgaccgtgtagttgaagtgaaagcacatatattaaagccctgcagtggttcaactccatcttaggtttggagaacatggagtcctttgcccccagccacagaagtggtcaaaaggaatgaaggggaagggtggagcacttggcatagccctctgcagaaagcaacgaatttgaaggcagcaaataagtatccatatggatgggggaatgaagagcttcctgtccaaatatccacagtggagttaacagcgggtttggctgactagaggaaagcaggcctcagcccctggtgat

SEQ ID NO: 127087 - DNA, 180 bp, Homo sapiens
agaggggactttttgagggtggtctgagagccgtatcattatttgaaataataccaaccaacatggaatgaaaggcagggtgctaaactgaaaccaaccttaagaagtgggtgatgtttttatcccttcataactgacgagtagacagaggcttggagagttaagtgatttgtttaaggt

SEQ ID NO: 127088 - DNA, 233 bp, Homo sapiens
taaaataattcaacaaaatactttataaccactaaattgtaccataatatattctgtggggctactagtggatgctatttatttattaaaagagcttccatcaatgagcatcactgataactcttttgatgtcataatataggctgccagccactggcagaagctaaaatggaaccaaggattgatcactaagtttctatcagcacttcagactttattcttttccctcatgg

SEQ ID NO: 127089 - DNA, 680 bp, Homo sapiens
gatcttgccgttagtgtgattggaccaataactcagtgtcttcaacatatcatacttatgatgtaccaaacccgcaagagattaaagtatacaaaccagaatgccatgtgatttataatttttctttctatgttaataagtgagattggcttgtagggttttttttgttgttggccaattttgataccagagttttgtataaaatttatgaattttctcctaccctattgccttgtcctcttctccccctctactttttacatttctagttttatcatattgtgtaatccattgtatagtcacatgtaatcaaatgtgccctgtgcatttccgctttggagaatttattgatgttctctgtagccacgtatattatcatttttgtaaatgtcctacagacagtagaaaaggagtattatttgtagagtatataggtattgcattaaattagctttattgatagctgtctaaacctatagattcttgtcctttgcctacttgatttattaagaattaaagagggatacttatatttcctgctacaattacagttctgttactgttgccttattttctaacattgtactctgacacataaaagttcacagagtaaacttcattgtgaattataggtttcatcagttaacaataaactttcatcctgatttttacagatgaaa

SEQ ID NO: 127090 - DNA, 603 bp, Homo sapiens
ggagctgaacccaggagtttgagactagcctgggcattagagcaagctcctgcctccaaaaaaaacacctcttcagtaattaagagagacaacagatggaaataaagatttttaaaaagacaaaagagccagactatcttcaaacaaaaaaaaaaaaaaaaaaaaaaaaattttttggggcgggtcttgggccttagaaaaaggtttttaaacccatttttttggggcgcgccggggccccaataaggtgtagggagacttttgggcataaaggttgggtcccaaaagaagaaaaccggtggatgtggataaggggttgggttttcccacccaattaaaaaaaccgccgggggggaaacacggagggcgtttggaaacaaaatccccgacggggggatttcccggggggacaaaagaagggctctacacaaaggggggttcacagcgaaacgtccgatattctaaaattacggcccgccggggagaaaaaacaccaacggcacataaaaacaaacagcccaccagcaaacaccaagtcaagacaacagatcagagaaacaacgacataaggacgacgaaagaacaaactaaaacataaagaga

SEQ ID NO: 127091 - DNA, 330 bp, Homo sapiens
acacatttgtatatggctggctaggaatggtgactactcaagctgagctagcaagggatagagaatgagagagagagagagagagagagagagagagacagagggagaggagagattggaagatggggacagatgggaggagagctcagagccagggttcacccaccgcccccaggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgagggtac

SEQ ID NO: 127092 - DNA, 410 bp, Homo sapiens
aagcaagtttattaaattctagcaggacactgttttgccaagtttctcagattgaaactgttctctctttgttaaacagtgaaattatcatgtgttagagcagtgttacagacatgcctttgggaatctaaagagaactagaaagagaatcacattcacattacaaaagtcagtgttattttattcattcagttactaaatacccagcaagtggttgagtggagtggatagttcttaggactacaaaggcaaaattaaatataatcctgtttccttgtagagctcatgatctagcagagaagactgacaaggaacaagtaaataaattttaaaaaatcaacttcagtttgtgggaagaaaagaaagcaaagtatgtgcatagagaggagtatattttgagtaggtgtgtg

SEQ ID NO: 127093 - DNA, 723 bp, Homo sapiens
cattttttttaagttaatactatttacaagtgccatacataaatagttattgactgtgcaatacagtggagcctcatttatgtcattcttgacatctatgtgaaagatcttgagactgaaatcttgctatacaataagattattttcatttttcagtgatcaaccctcttgaatgagagtccagcctgttttctagcaatgaagtcttctctgtaatagatccagttacttttagtaaatctggaggagggagaaatctcaattgactgaagaaagttttctaggtctcttgctttcagtagggccaatagtgaggagttaagctctgcttgaaacgtctccataggacacaatttccctgtgaactttgtatcttctctgcataacaaggtggtgttcttggtttaagagttcgtgcttttatctgtagatacattctttcctctaccgcatttccctggctgccctgctgcagaagaatttgctacagagaatttattctaaatgtatttcatgatacctagtttggccctgacattgctatacgcattactatttttacttataggttctttgttcagggtcattgggtttccagtagtccttgaaatggtttagaagctatatgttatttctgcttttcaaacttaaatggtgagaaatattctaaagtacttaggaaacgtgatattgacttccttggaaaacacaaacaagtactca

SEQ ID NO: 127094 - DNA, 319 bp, Homo sapiens
tctgtctcaaaaaacaaaaagaatttcaattgtatccaagtccaatggtaagcttccaagggcataagaagtaagcagtgtgctttgggttgtgttttaagagggtcactgtggccttcctacgaggaaaggatgggaggagggcagatcagaaataggaagcccgttcagagacgttgtagcggtcagaggcagacagcccggtctgagggtggcatcgctagagttggagagagatgatggatgggttaaaatatattttagagctagactcagtgtgaccaggcttcagtgcctgaacaggcttcagttgctgacc

SEQ ID NO: 127095 - DNA, 3609 bp, Homo sapiens
  misc_feature (796)..(796): n is a, c, g, or t
  misc_feature (1620)..(1620): n is a, c, g, or t
  misc_feature (1852)..(1852): n is a, c, g, or t
  misc_feature (2093)..(2093): n is a, c, g, or t
  misc_feature (2512)..(2512): n is a, c, g, or t
  misc_feature (2579)..(2579): n is a, c, g, or t
  misc_feature (2776)..(2776): n is a, c, g, or t
  misc_feature (3044)..(3044): n is a, c, g, or t
  misc_feature (3067)..(3067): n is a, c, g, or t
gggtgcattttgtaacagtcctgttcattatgactgttactccttcattgctatctaaagagcgtgtaggtaggtaaggtcatatggattgggcagaagtggcagtaggagtgggcagtaaggatagaaggaacgtatctcagtgagtgtgcaagttaagtacttggcataatgtaatagtgcctttcatatcctaaggtcaaactgtgggtatctttaaactgtctagaccacacgtgcatacaaatcctcccctggggatctcctgaaatgcacattctgatttgggagctcagggagggggtctgagagactgcatttctaaccagctctcagggtcacttggagtagcaagcacctccaaaactgctggaacctggaacaactgcagggagacctgatctgcccattagaccacatctccctgagggtctgggatgcatgtgtctttgtgcctcctgtaccaagagcagtgcctgctaggaagtggatgctcaaaatgatcttttcaactgaactgaagaggctgctgtcccagagtccgtttacgttagtggccttgggacggcaggggtgtggcgacccagtcatagcctgtacacttatttcggcccagcttggttatcgctttacagccgtctgcagataggatgtgtgaatttggcagcagaggcggggcttctggcaccggcaaggagtgatagctgagggcttggcagtgaggacaaggacagaacacccatggaagagagggaagaactcagtaactactgccatcagggataattagccgagnggcaagcagccctcctcatttcaagaggtctgtgttgtacacccacatgcaactctgtgcctcagtttcctcatttgaaaaatggagaaacttacagttcccctcttgtaggttatattaaggattgaagcttttagcgccttgccaggcttagcacgagagggcaataaacatgagttgcaattaggattggtgtgtaaagggttaagccccagccttcagggaggtttctccgagaagaaaaatcccattcctgaggttgcacataaatgtgttggtattttgccgctaaaggagtaggtgtaaattaacatgcaaagtgattcctccagaaggctgggggtggtgaaatgggcgaaggagaggttgctacttgttcgtcatcctcaggaaattcttaatggaagaggcagatgtcaggagctttctaattaatgggcagatgaggtgggagatgaacctgtcttgggggtgtgcctcaggggcaggcatggcgctgccagagctagcactggggtgaagttccagggacccttgcccgtaagaccttaaaccagaatgccacttagaggggacagcgcatgcttggctgtatgctgtagtgtttaagcctctttgcagctgacttatatttggttctttaaaagtcttagaagtggctggctaaaggtaacggggtgctgaagcatggctcccacacatctctgtcaccccaaaggtgctgggcacgagtattcagggaaaccttggctgtgtctgacctatgtttacttcagagctttatgcctagcacgggggtttgcacagggacattgaaagtaagnaagaagagagcaaagtagatgggtctctcggaaggctttgaaggggtcccaagcttctgtattttctgcaaacgcctgtgaaaactcccagaacattccttgatcaaaatggttttcttgtaccttctcacagggagagaagcgagggtgggggcagggtcgggatgtcatgggaatggaacgttcttaagctcagttgtatgtgatttttatttttctctgttgcctggtncattaattcataaactcccttagaaggctaaacagttcattagaaatatcctatttctgttaaatagcatagaaacatgtcatttacatttttctttaaaactcagaacttgagatcacttctgtaaaatgtgagccaaggctggctcttctccgggaggctctggcggtggtgggaatgtggggttcaggggatagagggcacttgcagtttaccctgtgactttgggtagcttttgaanttttgagccgtgtgtgtattgccttgttgaaaatcccatcatggcattgcttctttggggaaatctgatttcgtttgtatggtacctcttgcaggaatgtagagggtagcttttaatcaccttcttaacactgttcagtctctagaaactggcatattattcatttgcctcagcaggcgttaagattaacaacatattccatgggtgaaacttcgcagttgggcccaggaatagtctctctgctttatagcactcatcaccttgctggagagggaaaatcaatcaggtaaggagacatgtcttgattgtttagtgaagcagccacgtgaggaaattaagacttgtttccaggtgtgaaaaaggcctatgaaggaggaggctctgccagccattgaaagtgtgttctccgcatgtgtttntgtattgtctgggcatgaagaggggtaacatggaatagatctcaaaacggggaggcagttatgaagncactgagaaataaatgtagaaaagcagagaggaagcacggtgtaggaatcctggactcttaacagagcttgaagtaccttggagcctgagaacccagacatgtcccctcctgcctggcctcgggagtcctcctggggacttatcacacttgctgcatggcagttcctggatgcactggcccctcagcagtcacggcntggagttagagagaccttcaccccacaggctcagccatggactcatgtgatcctgggcaagaggcaggttctccaggccacattttttgccttgggggtctgaagagcttgcactaagatgctaccctctgtgaggtttccagccctaaacaggaagtcagggacattccatgattatggatccgccaaagagctctgagcagtttggtgaccatgctgtgaaagtggatgttgagtgggaacaaccacgatcagatctagtaggaanaatgggtctggtaggaggacgangacagagacctctagtagagaagtgttactttgcctgtgttagcccagaaacatggagcagggcaccggttcgaccagaaggagcagaatggctcttgtaaaaataaaaagcacttggtaccagcatgcttgtggtccaccaggtttgtgccccatcagaggaatactccggaggaacttgggccgttcagaatagtgtatttccagtgcagctctggaaagagtgagcagtcgtggaccaaacatttcatggtctgatgaaaagctagtggatgctggccaggtgcagtggcactttggaaggctgaggcgggtggatcacctgaggtcaggagtttgagactagcctggccaatatggcaaaaccctgtctctaataaaaatataaaaaaattagccaggcatggtggtgtgtgcctgtagtcccagctactcgggaggctgaggcaagagaatcgcttgaactcaggaggcggaggttgcagtgaaccaagattgcaacactgcattccagtctgggcaacagagtgagactccatctc

SEQ ID NO: 127096 - DNA, 573 bp, Homo sapiens
caacacaggatgtggaaaagagacactatttgaagagactatgaaagggaattgtctatgattgttcaaaagccaatcttcagattcagaaatcccagtgaatcctatgcaggagaaataaaaagaaatctatacctagaaatatgagactgaaaacgaagaacaacgtggacaaacagtctttgcctttcagagggaaaaagacagaatatctgcaaagaaatgatcattagcttaagagctactttctcaatcatttgaatgttttaaatgcattcatttcagatttttcttctaaatagcaattctatttgtttcctacactaaaaataaataaataaaacaaaaatcatttcatggctgaatctttattttcacttaagcaaatactcaggaagacagctgcaggtggaagctatgactatgctgagctctcagcgggggctaaggcaggcagggccctggccgatggcagatcatccctcaggcgtccctgtactccacttttcctgagcgccgggagagctgcacacaccaccccacgagtaggcccctaaaacagagccaagtcac

SEQ ID NO: 127097 - DNA, 441 bp, Homo sapiens
gagaaggatcttcagttatacccacgtatacaaaatagcatatgtctggattaaagatacatctggaaatttatcctacagatattctcacacatgtagaatattcactacagcattatacattcatatgtagaatgcattacattcacatgtagaaggatattcactacagcattgtatcatggtgataaacaaatagcacaaggtaggagcaatctaaatgtccgttggcagggaactggttaaataaatattggtatatctataaaatagaacaatgtgcagaagttaaaaagagtgaggcaactctgtatatggatagtgaaagtcttcaagataatgttgagggggaaaactggatgcagaactacatgtatgatatgctaccatctgtgtagaaaaagaaacaataaccccccccccacacacacacatacatgc

SEQ ID NO: 127098 - DNA, 401 bp, Homo sapiens
cactggcccagtgctcacctcctgtgtggcctggggatggggactggggatccctatcttaaaagataaaagcagagccctgattattctaattggattcatcaccacagtcaagtgaatgttatagaaacaccaggttcaaaatcaaaatctagaaattaaaggaagaccaggtacggtggctcatgcctgtaatcccagcactctgggaggttgaggtgggcagatcacctgaggtcaggagtttgaggccagcctggccaacatggtgaaaccccatctctactaaaaatacaaaaataaactgggcatggtggcgggcgcctgtaatctcagctacttgggaggctgaggagggagaatcacttgaacctgggaggcggaggttgcagtgagctgag

SEQ ID NO: 127099 - DNA, 202 bp, Homo sapiens
agctcggttctcccttttggggtctttgctatagaatgtttaacatcattcccccccaaagttgtaacaaccaaaaatgtcttcagacattgccaaatgttccaggaagtggggaggattgcccgcagttgagagttgctgccttagggttagttttgccttactactatggcaagatctttctgtgtactctacccaaaag

SEQ ID NO: 127100 - DNA, 304 bp, Homo sapiens
tggggttggggggggggcaagaagggaatgctctttctttttttaatagacaaggtctcgctctgtcacccaggctggagtgcagtggcgagatcgtagtgcactgcaacctcaaacagggaatgcgctttctatgcgccctcagcccagagtgttgagtggtgccccttccctggcctccccctggccacactgtggtgagtgcggacagcagggagggctgagggccgccttcctggcctccgcagggttgtataccggaccgtgtaccgtcaggtggtgaagacggaccaccgccagcgcc

SEQ ID NO: 127101 - DNA, 422 bp, Homo sapiens
ctgtatgcaacaggtggttctccttttgtggctctattctctgggctctgcccacgtctctccccaaccagaaagcagagtgccttgtcagttcttgagggtttttttttttcttccctagtccttaatcctagtgtaacagcatctcagcttctaaacgttatcgccttagcaacttggagttgtacagcaagaaagccttgccttgtttccttttttgatggtaggtctgagaaactccatcaataatgaatggcaggttaggctctgctgcgatcctggccttggaggaaagaccagaaaacaggcaatgacggtcacaaccgggccagcctcttactgggcacttggagttcacagcaatggtttagggatggatgctcaagctaatgttacagaatttctgtgcaggaccatgtgtc

SEQ ID NO: 127102 - DNA, 433 bp, Homo sapiens
tttgtggggttgggggaggagggagggatagcattaggagatatacctaatgtaaatgacgagttaatgggtgcagcacaccaacatggcacatgtatacatatgtaacaaacctgtaccttgtgcacatgtaccctaaaacttagagtataataataaaaaaaagaaagcaaaagaatcaaaaaagatatacaaacagtaatcaaaagaaagaaagaatagcaatattaaaatgagataaagtaaacttcaaagtaaagaaaattaacaaagacagaaagagacattatgtaaggccaaagagtttaatccaagaagacatagcagttctaaatgtgtacataccaaaaaacagagctacaaacttccagttgaagcaaaaaccagtagaactgaaaagagagaaaggcaaatccgcaattgtttttaggga

SEQ ID NO: 127103 - DNA, 452 bp, Homo sapiens
cttgaaatctggctagtgcaagacaaggtgtgctgttactgtaagtgtaaaacatacactgaagtgcaaaggcttagtacaaagaatgtaaaatacagtatctcactaataatttttatatgatgtcttaataatatttttatatattgagtcaaatattattaaaattgatttttcctgtttctttttactttttaatgtagctactagaaaatctaaaattacatgggtggctcatatgatattactaaaaacacaaaaattagccaggcatggtggtggatgcctgtaatcccagctactctggaggctgaggcaggagaattgccttaaccaggagacggaggtttcagtgaatgaagatcgtgccattgtattccagcctcggcaacacagcaggactgtgattttctttggagactcctagattttctgtggttttgaactgaatt

SEQ ID NO: 127104 - DNA, 413 bp, Homo sapiens
gcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaaga

SEQ ID NO: 127105 - DNA, 685 bp, Homo sapiens
gatgatactccggtggcttttggcctccctagtgtctgttggggaatccatggtcactggagtcattattttcctgtgttaatatgtcacatttctcttaactactctcctgaatttttttagtgtttggttttcaagttttattatgatatgtatgagggtggttttcttttaatttaacctgtttgggtttcattgagcttttgataattttcccataagttcctgaaaccttcctctttttcatctttttttctctctatcattcatattatataatctttattaatcagtcttcaaatgaatgaccctcctctgtgatcaccattccactattgttttattttaatttcagacattgtattgtttagttttaaattttctaattttttaaaaaatagtttttctgggctgtgaactttcatctttccatacttgaaatattaaagggctttacctcatggagtacagttataatagctgctttaaagtttctttctgccagtcccaacatctgtgtcatcccggagctgacatctattgattgcctttttctttgaaaattggttctatttcctgattctttgtatgtagagtaattttttattgtttccttggcattttattctatttatttatttatttatttatttatttatttatttattctatttatttatttaga

SEQ ID NO: 127106 - DNA, 468 bp, Homo sapiens
ttgagatagatagtactgttaatcctatttcacagactaggaaactaggcaaggtctcacaaacagaaatgtaacagagctggtgttcgaatccaagctatcctcatccagacccacagctcttaaacctcatgctacagggtctcaacaaaatgaactaccaccacagccaccatgcactgcatgcttgctatgtgccaagggctttatgtgtctcacctctgagcttcagaacaatcttctttttttttggagatgaagtctcgctctgtcacccaggctagagtgcagtggtgcgatcttggctcactgcaatctctgcctccccaggttgaagcgattctcctgccttagcctcctgagtagctgggactacaggcgcacgccactatgcccagctaattttttgtattttagtagagattgggtttccctgtgttgcccaggctagtctcgaactcctgagct

SEQ ID NO: 127107 - DNA, 488 bp, Homo sapiens
tagatgaaggattggggttgggggaggaaagggagaggcaagttcaagtttgtcacggtcaggtttctggcatccttgggtcagagagggaaagagagagcagtacccagacatggagaagaggagaggcttgagcacctattgtgtgcagcgccatgctgggccgtgtcataggtgccatctcactttagccttcatcacaacactgtgaaagcttgcggaggtgagccctgagcgaaagtcatgctgtcaggatttgaacacaggcttttctgatgaagagtccctgaagccagagctgagatggctttccacagctgctttgtcccctggaccagagggagggatggcctcacagcaggagagatctggccttgggaacatttgagccctgcctctctgtgccccccaactcctctgttgccccagtcctggcttcttcataccaataaagagccccagagcctcaaagctggcatatttgcata

SEQ ID NO: 127108 - DNA, 442 bp, Homo sapiens
aacaaaggattcagaagacatccaatttggatgctgctcttcctcaaatctcttgcccatagtttcaaagccctctctatttctttacatatgacgaagcgaatctgttttatattctatatcctatagttatgatacctgaagtctttaggggtctgattctgataaccattgattctgctggttcccatgcatatgtggcttggttttcttatttttttgtcttgatttttattttattttactatatgcatggaattcagcatgctcctttatttgagagttaattggggcctgggttgaagttgaattcatttagaatttgtttttttttttttttttttttgcttctaggggcactaccaactgttaccatttttaaaataaaattctccacttgagaattgtaggaaatacaacataaatttgggctccaaatcca

SEQ ID NO: 127109 - DNA, 158 bp, Homo sapiens
gataatctggctcctccctgggcatcatccatgaaagcctactcccctccattagcctacagccctgcctctgacttcaaaccctaagcctgagggccatgaatactagaaaaaaatctcaacgtcagttatcaattgagtaccctttctagtatctc

SEQ ID NO: 127110 - DNA, 279 bp, Homo sapiens
tgagatacgtgaggggtggaataacgatagtgtatgaagacaggaggactctggctgataagagattggaaagaattgactgtgatctgcttgccaaaagcactaacatgactttgggatgcactaagagagctttagtacccagaacaatggggctcataggccccagactctgtgagagtcaaaccctgtgaggagtgtgtggcccattttgagagggacagagacaaactgtagagtccagaggtagaaatcaggatggtgagaagagcccatgac

SEQ ID NO: 127111 - DNA, 322 bp, Homo sapiens
tgagcccgggaggcagacagccttgattgtgccactgcacttcagcatgggtgacagagaaagaccctgtctcaaaaaaaaaaatgaaaaacaagacaaggcctaccctagggctgtgcttcagaccccatcaggcagttgccatgcaaaatgcctcaagagtcacagctctgtcaaacagttgtgcgcatgttcctgccaccatagcatcccttgggagtttggttctgttcatgcaaaatgagtgggagtttggttctgaacatggagcgctaaggggatctcgaaaaggacaccttacagcacgagaactcaaacagga

SEQ ID NO: 127112 - DNA, 372 bp, Homo sapiens
tgtcctgccagccctaaccctgacagaggccacgcagtgccagagcccatggctgtagtggccgcttcctcttgcaccagaagcagcagcagccagtgggtcccattcttcagtgtggtctgggaagtcctctctggaactccagccactcccaaggctagaagttacgttttctacacacccttccatcccctccctccttgggctcatgtctgaccttgaatctggacaggggctccgtcaaaggctgagagcagccacagttgagggaatgaggacaggacaccaagtgcaaagaggggctgggagaaggactcacctcatagacgggggcatcgggtccttcaaactggaggcctggaggacacaggg

SEQ ID NO: 127113 - DNA, 480 bp, Homo sapiens
gttatactcattttactgcttaggaaattcagagccagaaaaggcaagatattttctcaatatttcagtgtttaataaatgagagaacccagaaccaaagctagaaataataacagtgaatctctgagtaagcacagtaacatttcttccatgaatcttggtgtgttttacttttttatttgcaaatgttctcctgggggaggtaatggtactgtcaaatatttttgctaacagaagatgtggaatgagaagagacaagtgacacataggtcaccatcatcagatgctccaaataggtctatatgtgtgttacagtagaaaaaaggagctctaactacaaactggcttccagatcagtcacattttcctgtgttccacatagtttcagttgttatgatgaagcaccttacccacgagcagaaataagcatggaggaaggcaaattggtaattgacatgttaaaagttgttaaaaatgcca

SEQ ID NO: 127114 - DNA, 223 bp, Homo sapiens
tctggccctcatggaccatatgtgtttggtagatattagaccaatatttgggaagaagtcttgcagatactttctctcattagacattctaccctctgattctgagtttgactactctatgtacctgatatcagtggattccagagtgaatcagagtgtagaatagtagtttccaggagctgggatcaggggaattgggtgttgttccgtgggtgtgcggttt

SEQ ID NO: 127115 - DNA, 497 bp, Homo sapiens
aatgaatgcaaatgggaaaagtataactctctggcaaaaactgaagagccattgatttgtctttagtatcaaggccaatgtgccccttgaatccttctacctcagctcttcaccctagtttgtggtctcagctatgggcatgaccgtcatcgcctctatcgcctgctcgtagctccctgcctgggattccatctcttgccttctgttaagcttctgcctcagagactgtccaatctcactgctgactctgctgccctggacttctgctgggatgctcccatagtacccagggctgcatgtgggtggttcattactttctgatttgattacacaaacacacttccctaattatgcaaatatacgtattaaactttactgcagtaacagaagattcatcctcctaagtataggaagtataaagctataataccttcccttttccctactgtcctcttaagaggttaccagcgttcccagcttgctcagagcctcaggac

SEQ ID NO: 127116 - DNA, 366 bp, Homo sapiens
tgtaaacaaacctcagagaggtattgtcaaaggctaagtctctcctgcattggtagagagagactggattttgttgttgttgctaataattttgattcaagttttaacagctctcaggcctgtaaggtctgcagtgagaaaggaagtgagcaggaacgtcagaatggagggatgtgtgaagtgactgttatttattatccaaagcaagatactttgagaatgaaagaggcactatgaagaattacacaaggacaatagacattaaaacagtccagggaaaccaggacatagggtcgccttaagagtacaagggtctgggaaggaagggatggggaaagtgggttctcagactgaaaagaggtccag

SEQ ID NO: 127117 - DNA, 493 bp, Homo sapiens
tttgtttccagtgtcaagcgaaagctgtagccatgggagctgtggcgttggtcaaaggagcaaagccactgctaaaccacagtccagcagggatgaaggtgtgaggaggtggaggccaagtggttcagttagatggtgagggcattttagggagatagcactacaaaaacaaaaatacagaggtgtgggagaaaaccatgtcacattgctggaattggagtgtaggatgaagtagaagtcagatcatgaagggcctagtatatcacgccaaggcatttggaccatatcctatataaccaataagagcctgtgccccataaatgactaaaatactctgttgctaattaagtccctgtgtttgtcttgtgggttgggttggcggagccgggagaggggggaggttgagagatcattttgagtagtttgtgtctgtttcccagcttaagacttttctgaaccaaggctgctaatacaaatcacatatgttatggag

SEQ ID NO: 127118 - DNA, 821 bp, Homo sapiens
taaataatttgtttataatgactctttataataagatatgcttgtgattctctgctgtattttatatttcaatttccataggttaacaatctgaaattctagtagtctactagtatggtaaacagtattttttctggctttaggaataaagaaatcgggacaaattaaagttaaatagcttgtctagaacttcaagcatattgatagggtagccagaaatagatcttaaattttaagtccctcagttcagctgtgtacactatttctaagccctcagcatccatgcatgcagttaattctacattttctaatggctgtagaagaaaattatcatagttaaatataagcctcaaatattttggaaacttcacttcagtcactgatttcaatctcctctccatcaactcttttactagaactcctaacaagtggaaaatttaactgattttaattttactacagttaaccctccaagagctaatagcaaaatggaaggaaggcatgcattgagttagcagggaatttccttctttcctgggttgtaagtttctttataaaataaaggatgggtgttcaatgtaatcattcagtggtagatatgtaaacttagccaagcatattttaatcatattcttatgtttttactaacataatgtacttaaaatgtcataaaacttagggatagaattagtgttgtcactctgaagtttcagattgaaataaaataaatcttataaaagatgccaaataaaactatcttttaaaagcctataaaattaaattaaaataagaaataattattaaatctttttttttttttt

SEQ ID NO: 127119 - DNA, 370 bp, Homo sapiens
tggtatatggaggacgctgagctctaggcagccatgccatcaggattctgttgacattggggaattaaagtgacaattcttaagaacagacgtgaaataacagcttggacagagcatgttctcttctacagaataacacagcaactcccttattcagaagtgtcatgatttttctcctatgcagaaaaattgtatcacagtgaagaaaggcatgcccaacacttcaaatgctggccacaaggtgccagtgggggtgacagtgaccatctgaaggctggacacacaccagtggcactccagtggtgaggaggctcaggagggcctcatgggttccagcaggggccaggggcactctggatacccccggctg

SEQ ID NO: 127120 - DNA, 107 bp, Homo sapiens
caaatttggccttagttctgtctttggtagaggatcagaagcatcaaatgagagggactgtaaagaactgaacaagtcaatagggggatgtccgcataactttctcc

SEQ ID NO: 127121 - DNA, 430 bp, Homo sapiens
ggatccatagagcttatctagccccttgtctgtgagcagatggctatgaacagaagtcattgtaaaaccacaaaattaccagaattactgataaatcttttaaaatatagatgccttaccctcaacattcaagtttctgcttcaaaatgtgggtgtggccttttcatcaatgatactttgccaaacctaccaaatgtcctggggggtagccaaagctgacaaactgtagtataaaatacctctaacagctggtgttaactagggctaggtttattttcttctgaactccaggaaaactagttaattttaagcaactttcaatttatacaccaatgatttattgagtgcttcctgtgtgctagccaccaagccgtcaggtaaaaaccaataacacatgaatacttccttccagaaactcacaattcacatt

SEQ ID NO: 127122 - DNA, 473 bp, Homo sapiens
cctctgttctccccggtaggtttaaagattctttagagcaaagatacagaattttcatcttcccttttccagcccttgtgcagtacctggcacataaaagccattcagccaatgtttgttaaattcagctaaactgagcaggaaacgtctcccttgtgtgtggctgtgcctttttgccattcagagagaggcagtacaatcatggtgatttgaggacacttaaaaatggaaagggctccacatcgaaggcctcttgaatatagtgaaaatgaatatcaaaatcaatatgccgttcagtttagggatatgaataaatgatttcaaatgaattcaattttcctctcaacattaagtggtgaaggaaaataaattattggataatgtatttgaagtaatagctctcttctaactgttcctacaatttgttgttacttgtctttggacctctgtgtgtcatgtgatactgtgtgtca

SEQ ID NO: 127123 - DNA, 197 bp, Homo sapiens
tatcaattagcgtgtggtaaaattagtttccatatacatcatcaatgtttaatgaggactttagcatattgttgatctgcagatggctaatctgaggatgtgagatatagagagatacagacagccaactgaatttggttatatttcttctcgaagcaaaagtgctacgctggaatggaatgggggtaccgagctcg

SEQ ID NO: 127124 - DNA, 225 bp, Homo sapiens
cctactgacacatctccagttgtctcaaaaatgtgttttccattgtggtttgtctgaaacatgatccaaaagtcagacccacctctcacctttccctaacctgccggagcccatgtttctttccagccaggcttggagaccaccacacgggatttgcttcttggggcctccctctaaccagctatgcaggatgccctctttcctgtcaatacaagctgctcaaag

SEQ ID NO: 127125 - DNA, 228 bp, Homo sapiens
cactccagggacaacaccaatggacccatctcataaaggtcccctctgccccctctcttccttccctccaccttccccactctcttaatcctcatgcatgtctgcaccatgttgcctagtgtctagacatgtatgaatgaacaagctccctaaagacaaggggcacactcacccctctttatttaccccacagacagcaggagcttgcctagggtaggtccccaggaa

SEQ ID NO: 127126 - DNA, 330 bp, Homo sapiens
aaagcacagagagatgaaacagcctaccaagggtgccacaggtcatatgtgatggagtcggggaatcaaacccaggccagggagtgtcatcatccctcacatctggatttctgctacagtcacctcatactactctatcttatttccagtcaactcccagcagccagggtgaactgtatgtacaatggatcatgtcctccactgctcagagccttccagcagttctcacctcactcacagccttccagcagctctcacctcactcataaaagccagaggctcatgtggcccacaggcccacgtggtcgagccctgctccttctctacccc

SEQ ID NO: 127127 - DNA, 151 bp, Homo sapiens
atgagcgcccaagtgttggatttgagaggaagcaggaaattgagagttgcaagatgccagtgagagggaggagcgtggggatgttgaggaacagataggcagcccaagaggtcaccataagggaagtagtggaggggaagctggacagtgg

SEQ ID NO: 127128 - DNA, 509 bp, Homo sapiens
ccctcactattggctccttatgtcacattatcaaataaattacttatatgcaagattttgtcttgatctccgcttgcaggaaaagggtaggcctaagttattgaagcatgaaaattattctatcaatgttagttattatttgggtatgttgtcaatataaattaaaatcttgaaactaataatggaagccatatattgaggatggcagagaaacaaggagtctgggtttccaacaatcacagaaacattatatcaaccctggactgtatatgtttacatgaaagagaaacaaacatctcattttatatgccaccatcattttgagttttctgtcactcttgactgaccttcatcccaactgatgcatcccttcttttcccagggtgtgtgtgtattaagttctacacaattttatcactggtgtagattcatgtatcccgcaccacagtcaagattctgaataagtccagcaccacaggcagtgttgccacagccaaccgtggactagt

SEQ ID NO: 127129 - DNA, 357 bp, Homo sapiens
tggtggatggttggtgaggggatatgacagtggaccagcgctgttggctgcaaccctggcccaagccagcctgaggacggcctggatgagcgggactccagctgtcctttactggcccccagggaccctccccatcctgagtggacatggccagagccaccatgggcagaggcagggctgggtccaacctcgtgctgcccgggaggaccaggctggcctcctccctcctccctcagccgtccgcagctgctgggtccaggtggtgccatcccctcttttttcaggaaagctcatctgaggggagtccagctcaagccctcatctccgcctgtggcctcacgcacaccacacacagcc

SEQ ID NO: 127130 - DNA, 368 bp, Homo sapiens
gcgatattataacatataggtcttgtgtcctttgagactgtaaactgtttaatacgtatgactggttatttcacatccgaaccacattaaaaaagattcggagatatgactgctattacactaaggaaacaagtggaattttctgaccaaaactcattcatgggtcttccgataaacaatctttacataaaactgacgcgataacaactaaacaaagaatatgtgacaaagaccatgtagcctgcaaagcctgaaatatttactatctggctctttgcccactcctacatttatacgaccgatatctagagttagtattttccgggattgtaggaggataagagtgaaatgacagagactctagatct

SEQ ID NO: 127131 - DNA, 129 bp, Homo sapiens
caagcaatccacctgcctcaaccacccaaagtgctggaattacaggcatgagccactgcaccggcctattttctaactaactttttaaatgacgttggacaagtatctttacctttcttgttcctggtg

SEQ ID NO: 127132 - DNA, 703 bp, Homo sapiens
gggcattccctgaccctttgtgcttcctgagtgaggcgatgccccaccttgcttcggctcaccctccctgggctgcatccactgcctaaccagtcccagtgagatgagctgggaatctcacttagaaatgcagaagtcacccaccttctgcactgatctcgctgggagctgcagacctgtgctgttcctattcggccatcttgccagccacctgtgttactagaattttatagtgcagtatttgtcaaaccaaatgataatcatagtatttaattaagtttatatcttatcttcatcttgtaagctcttctagggcagggattgtgtcatatttttaagcccttactgcagagccctagtatgtggtaaatggacatttaataagatttgtagttgaggatgaacaaaattactttctacttttccttcctttctggccattttttctcctttttctttccaaaaaagcgtagatgtgaacattcaaattctagtagcaatctgattaaccaaagtattttaatttatatttttataagctccctggattatatttagtttctccccgactccttataaataatgataaaagccaaagagtgggaagggtgctattgaaaggcgaacataaaatattgacaccaatttcataattctacataaaaatcagctttattgctttatagtcacactttgaataatt

SEQ ID NO: 127133 - DNA, 542 bp, Homo sapiens
taactgtgatgatctgaacttaaaggtaaatggacagtatgtttgccaaggtaagatataattttcatatgagggactaattaaaaatttttaaaagactcattataagttcattttgttcttgttgactgcttcagcaagtaaaacagcatcacttcctaatgtgactacatcgacttattaaagattcaatatttggtggaaggtagaaaaacttactgtatatagaatactttatgcttgtccttttaattaagaagcacaaaatgtgtcatttaggtaagatactaaagtagaaatgatctcgtaatactagctcctcaaaagtattattttctcagaggtatatgaaatcggtgaattcacctccaccgaaattcattaaatcacatgggatttaaacgctaaaatataaaacaaaccatttcaatgactcgattattacttaattttttttgataagaaaacaattgaagtatcaaaaccctgtggctggcagagttgtttttgtttggggaaaagttgagaaaaagaatgacaaa

SEQ ID NO: 127134 - DNA, 119 bp, Homo sapiens
cactctagcctgggcaacagaatgagactctgtctcaaaaccaaatagaaacaaaaagaattccatgaagggaattaggaccactttttaattcagtgtctgcacactatctcctgacc

SEQ ID NO: 127135 - DNA, 500 bp, Homo sapiens
aacttctgggctttggagctctcagagggggtgtccaagagacaagtctgcttccttccggctccgtcttggaacattttaatgactgtcagtcaccaatccaacccatccccagtggcctaccaggcaccacattgggatgagactcatgctacccttccccaggccagccaaggagcaatccacgctgtcccccatccctggctggctgtcttatggtgcttcagcccctccgcccagctcctgtgccctcatgagcctggggctttctgtataaaagatgcaatgatatctgttccccactagccatccccacaatgaacaacttcccaggcaatagcaaatggctccattccaaaagggcttgtttttttggtaaatcaaataagagaccccactcaagacctttgaaagtccccgtcaatgaaaaaaatccagaagggtcaaaagagaaaggcagcttttaatccagtttcacagcaaaaccaggctcttggctg

SEQ ID NO: 127136 - DNA, 532 bp, Homo sapiens
cccctggagagagatagtcttctctgtctgtgtcctcgagtggcactctgacagtgctatttctgaccctggcattcaagtcttctgaagccgttacattcgctgatggctacttagagcccagtaaaggtcagaaccatcagactgaaccagaccatgaaacagcgctgctcctgtgggggcgagggctggggtgtggaagcgatgtctgcgggcctcggcctggcagccccgcccctgggctccctgggctttctatcttatgcttctccctccctcctgtcttctgtcctcagttcctcactcaccctggcctgtttcggggagtggttatgggttggaagtcatgggtgttagtgtgaaaataccctcactcaaaaagtgacagaactgaaaacgtggtagatggtattgtccctgcagttcttgtcagtggggtcctggaatgatgttatcccggcaagtggaggaggggcccagtgaccggggccctggctctttgaattgtcccacaaagaggctttccaggttc

SEQ ID NO: 127137 - DNA, 615 bp, Homo sapiens
agccacatcacctcaagtaattaattgtgggatactttcaaatagcacctactcatatctgttaatacctattgtggttataaagttaattacacaatttgggtcatttttgtcatacctaactaaatcatacttgaagggctggggaaaaagcagctggagcacatagcaccagctccaaacatttttccacaagcccaacttctataaccctaaaaccagatttacctggtaactgctgcgtcgacctgctgtgactcaaagactagttttatctaccactatccctcaccaatcagagcttgttagctcccaaaagctttgtttactgtgccaatgagttttgtttcaaaacaatatgtaatgtttctctttctaacaaaaatgccaaccttctctttgttctttggacttagcctagaccaaccctgtttacgccttgaattgcaattccgtgattaccaaataagatgtttaatatagagatttatctccacatattattttgactttgacactattcaccttgtgcagaacacattttgaaaaaaaaatagcatagggaaaaggccttcattccctgaaacataatttttccaaatatgacccagtaat

SEQ ID NO: 127138 - DNA, 329 bp, Homo sapiens
agcagggcaccttgggatcagaatggtgcttccagaaggtgagtggaggtgagcttgggtcaagggagtgcaggaacatatggggaaacccattaggaagcaaatgacactctgcagatgagaagtagtattgacccagacaatggatccaagaggatgaacatgggagagattttggaactagaatacagagcaactagtaattactcactataaagagagagaaggggagatggcaagatgttgctaagagagagaaaggaagaagagagaggtttagaaaaggagcaggtcggctgggtacggtggctcactcctgtaatcccagc

SEQ ID NO: 127139 - DNA, 395 bp, Homo sapiens
attgcagtgagccaagatcgtgccactgcactccagcctgagcaacaagagcgaaactccgtctcaaaataaaacaaaaaattaattgtcttagtactattatctattttataaccttaggcacacctgtattctaaattatgaacttttccctgttgagcatttgccctacttaagtttttccctagaattatacatcttttttacggtgactattatgttcaccaaaaacaagggagtcgggggtgggggggaatgccacaagagcagtaatgccacagataaagcagagaagcaaaaataataataataacattcacatctgtggtcccaaagcaacaagactcctatcattagaaaactaattcaagccttaaaaattaacagaatgagaa

SEQ ID NO: 127140 - DNA, 187 bp, Homo sapiens
ttgcaagctgggaacttcttaaagccaaaccagtggcagttcagtttcaaagcagataggtaagtggtccatggcagaaggaaagccgacttacattcaaacacctgaacacaagagacgtcctagactaacatccaaactcatgtacctctaaaaacccccctttcccgcttgctcagacgaaacc

SEQ ID NO: 127141 - DNA, 865 bp, Homo sapiens
cattagcttctaaacagatcttttaatcagtattttattcagtttccaagacttccacaatattatatagtttttacttcatatccaaccactcctccctataaacccaggtctttgcctatttaaatgggtgttatgtccctgcctttgaactcaaattactcatttttcaaatctcagctccaataaaattccagcctaaaaacttgtcataatatccccactaacttcaggcaggtttgtgcctccatgattattaccatcagtgttcttgttaagtcataatttacttgtctttttatctagcaggatgtgaacatctttatgagagaatttttgtctcatatgttttgtagttttttacattcttgtatgctcactattaggtagtactgtacttggtacatagttagaattttgctgtattaatattactacaaagtaacatttgtttcatctgttttaatcatttttatattatcgaaaagaaaatattatttagtcttcctagcaaacgagttttctagtttcaactaatttttactttacaggaagaggcaaaaagtagcttcctgtttttaaaattattgattattctgcttgcttttattttcagcaattgggccaacagtgaaataacactggcagttccaatgtatgtattatatttgctctgaatgagaattggttttaattattatagatgatttcccattctcataactcttattgagcaataatgcaatattttatatataaattttttcattgaagactggtaagagaagttatgtaaagctcaaataaggaagaaaatgcaatttatgtaactctcttcagtttctagtttttctagagaagataa

SEQ ID NO: 127142 - DNA, 451 bp, Homo sapiens
gcggtgatctagaggatccctgggctcaataatcctgaggcagcagaaactgcagaagaaaaatagtcaagtcaaccatgggttagaatgcgaaattgcggaaccttcacacaaggatgcaggaaagtcaagaaatcgacccccatccaacaggaaatagacactgaatagaaacgcctgattctttaatctgttccctttctacacagtccattgcattcctaatgccttcagttccttccctaaacagattagaatctatggtgctttatttccataattctcaaacttttaggtctcaagacccctttgtaatcttaattgatgactccaaacaatttttgatgttgtgggctatctttaattaatacttagtgtgttaggaataaagactgaggtagggcacggtgactcacgcctataatcccagcagtttgggaggcccaggctg

SEQ ID NO: 127143 - DNA, 304 bp, Homo sapiens
ctatcaggactcttgtgccttgggacggaggaaaagccacagacgcacggaaggaggaaacaggccacagacacacagacggaggaaacgccacagacgcacggacggagtaaacaggccacagacgcacggagggaggaaacgtcatagacacatggacggaggaaacaggccacagacgcatggacggaggaaacaccacagacacacggacgaaagaaacaccaccgacgcagggacggaagaaacaccacagatgcacggatggaggaaacgcgccacagaggcacgcacggagaaaaca

SEQ ID NO: 127144 - DNA, 599 bp, Homo sapiens
gagtgctttgctaataattttatgttttctacatagaccttagaaacgtttttgtaaaggggagataaataatggtaaggtaagggatcagctcaagatggaagagaatggggcagagaggcttttggtgatagtgtaggaggaatgaggaggaatttgcatgaaggaggaagaggatttgcctgaaggccatggcatgggaaggaaatggagaacatagatataagacatcataagtgctgataatagacttgggggtttcttgatttctgtttggagtaattggtagaaggtgaagctgttacctaagagacagtagaaaagaaagagccggctctggaaggaagttaacaaattcgattttagacttattaagtttgaggtattagcactggtctaatgtagatgtccatttagatccactggaaattttgtctagagctcaggagttgcctgggttcagaatagaaatctgggaacataagcctgaagatatttttaaagccatgaaagtaagcgagccctctcttaaggagggagtttagcgtgaaaaaaggaccaaacagagaactgcctacagagaggttggacaaaagtcc

SEQ ID NO: 127145 - DNA, 308 bp, Homo sapiens
cagcagtggggtaaagtaaggataggctcagacactttcatttattcagcaaatgctcatcaagggcttactgcttgccaagcagtgtgctggcttgctagctgctggagatatgatgataagcagaactaaaccaaaccaaacaaaacaaaaaaacagtttttaaaaagaactgagagattgagagatacggatggtcaggcaagatatcgttgtacatgggatggaagagcttcattcagtgggctttgtgtgtttctcagcaagataattaccattgtataaagagaagacacagaaaatacaga

SEQ ID NO: 127146 - DNA, 347 bp, Homo sapiens
ctctacatatgccaagttgcctctgccacaatcattcttcctaaattttagcctgtcccctttatgttctttaggacttagctggagtgcctttactgatgtaagctggactaggtactcatcctttgtaatttcatagtactttattcccccagttcccatcgcattatcaagctatgtaagaaaaaaaagcaatgtgctgctcactagtgtctagcaaaaaacttgatatttagtaggcactgggtagttgaatgaatgaacaggagcctgcatagtccaaggaattatttgcctgtggcattaagcaaccaaccttcctggatcctagtccatgctgtgggatt

SEQ ID NO: 127147 - DNA, 355 bp, Homo sapiens
ctctctgggttaggggctggagttcatgtggggacatccagcagacaattggaagtctgggtctggagttcaagagcaaggccagagctagaacacgagccacagacttgagggtctttggcacagaggtgatagttgcagctgaagaagtggatgaggtggctcagagtgagaagaaaaatcagaaagccaaaggcagcaccttcagggaagtgtatatttcaggatcaagagaggaaaaagaatgcttggaaatgagacctgtaggagtggtcaggaagggaggagaagaacccggagagggtggtgctgccaaagccagggagaaaggggcttccccagagagccggaattc

SEQ ID NO: 127148 - DNA, 606 bp, Homo sapiens
tcacctgaggggaatgtccacccggaggtttgactttggacgtctggctcaaatcagggtttctgaaagtattttctttgtagacattattagcagctattatttttgttctctaaattgaatgtgtgactcaagctgcaggataattcaaagaacatgaacacaatcaaacatgaggtgcttttaattcctaacgcacatttctatttttagaaaagagagtggacttgcaggaatagccggggtcatcgagccacataacagtatgttcaacactattgaatgaccatatgagaacaaaaatgtgaatcacttcccatagatgtgggagtgaaggcgagcaagaccaaagtgactgacagtgtggaaagcaataacacacatcacagcatcatgaggaaagaatgtgcactagtttcagcctaatcaagcatttcatgaaaatggtagaaaactcagtaggcttctcagttcagttcactgtttttctgcttttcaaagataagatcaaactgattccaccttgtttcttttacatctgtttagcttgggttaccctgctaaaagtgttcttctatcaaagaagaaaaatcatcctctctctcc

SEQ ID NO: 127149 - DNA, 509 bp, Homo sapiens
cgcctgccaccacatccggctaatttttgtacttttactagagacggggtttcaccatgttggccaggctggtctgtaactcctgacctgaggtgatccatccgccttggcctcctaaagtgctgggattacaggcgtgagccactgcgcccggcctaactttacatttagaaaatgaaattgcgcaagtgtaactattaaaatgtttatcgtatctacctaaataaactatgtagtctgttttcatgaaaaacgacagcaactttgttttttaggaatatcagataaggaacccaaaacagtattgctcacatcctgtgaactttctggatcgctgatgttgctgctgctgctcagtcccatctttgaggccaccctgcattcaaatccctgtgccaaattgcccagggaacccggtcctggtgccctggtagcccaaaagggctacttgccttctccttccacttacccagacccctgcctcccttacccttctgctaggaacatgt

SEQ ID NO: 127150 - DNA, 737 bp, Homo sapiens
cacatatatatgttccgaagtgtagtataccataatggtgacttgcacacgtgagcactaaaagtttagagctgaatgaagttgatccttttttccagatttgctccaacagactttaaaattcttatcagagtataaataactgactagagcagtaatgatgtgcaatatttattttcttaaaacatgtacacactaccaaaagagaaaaacacactaccctttgtcacacatgctaatgaaaagcttagttgattttcactctccttcatttcctctaaaatctctctggcttaggactctgtcagctgaaaaacaaacatgtggctaccacatttggggacaatacagtgtttgcaagccctgcgggagataatctagccacacattgtgttccctgttcaataacaaaactattattcacaaaattggagaaaccatagttcctttccactcaaatctgagatgataatgatgatgacaataataataataagccacggctacatcaagatacaaacagctttttttgctttgataagatccacagctgatttcacttttgaccatgagattttcttctcgtgaacaattctgcagtatgtgccataagagaagggaaggaatgttgctaattctttttttgagtttctagcccatcaatatcaaatctttaaatggcaatgtctggcccattggccaagaaatgaaagttgttgtaatgctatgttcctggt

SEQ ID NO: 127151 - DNA, 339 bp, Homo sapiens
ccagagtggtgtgtgttgccgagggccagttacctccaagttgcaaaacagggtgccagtgagggaccccagcatgaaggagctagcctccagtgcccccagcaagggtctgaggagagagatgttggggctcagggcagctgaggatgacagggtcagcaaagggtgagtgcaggctcaaacagaggttagaggttggggcaggggtcagaagtcagggtcggagtcaggggccctgtgcccccattcaagcctgtgccatttgtgctggcggagttgggggaacccctggatgtccacccacggagacagaaaggtaaagggcaggggatacacaca

SEQ ID NO: 127152 - DNA, 353 bp, Homo sapiens
cgtccgactatcaactgtgaactcaaatgtcacccacacaggtgccttggagaaatgggaggtgagacatgaatttagagggagatttaatcgggtgggaatctgaaataatgacctgtcatgggttggaaattgaaatgacctcccaggatatgaggcgagcaagatgaagtcagatgcaaaggctggagagatcagctgcagtgtgcagcacaaggaaggggacaactccgtagagtatcattccatagacaggttaatactcagggtgaaaaaataccatttggacaaagagcaaaagaaccaccattcataagcacataacatgagcccagaactgagctagccttcgt

SEQ ID NO: 127153 - DNA, 341 bp, Homo sapiens
ctgagtcgctttgcttgaatgtgttggggcaggaggacccaggggaagggtgtgtcggcaacaaggtttacagataataaaaattgacactcacagtggcccgggtgtgcgaaggagatccctctgaggcaaatcagcatgattatctattaattaaccttgaaatagaaatattctcaagcactgaaaccttttcagatgaactgcagtgaaatcaggcaccctattaccataataacattttaaactcgataatgtatttaacatttgtctaatgtaagtgcctataagtgctgtaatgtaccagttgtgatgataagatcaaacaacagtctttaaat

SEQ ID NO: 127154 - DNA, 365 bp, Homo sapiens
tttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataa

SEQ ID NO: 127155 - DNA, 437 bp, Homo sapiens
gggcaacatagcgagactccatctctacaacattttttaaaaatgaactaggtgtggtggcatgtgcctatagtcctagctacttaaaaagctgaggtgggaggactgcttgatcctgagagttagaggctacagtaagccatgatcacaccgctgcactccagcctgggcaatggagcaagaccttgtctcaaaagaaaaaggaacagttttagcaattttttacatcttaagaacattacattggtgtaaagtcctagaatgaaaactttcttagcttcctccgggcttgtaacctgaagtcataactaaagggtattaccagaaaagcatagatactaaattaattcctactcattggttagcccaagtatcaagatcctgagagcaggggccacagaatagaagtacatcagtaaacttgagacttagcagca

SEQ ID NO: 127156 - DNA, 311 bp, Homo sapiens
atttcccctcccctgttttttcaatatataattatgtcataattacaggttagatcagtattaagtgtgcatatgttgacaatcatagaatactgctcacaagtaagccatgtagcaaactgactacactagagtctggattttagagtcagacttccaggttcaaatctgggttgtggtatttgttcaagtcatttaacatctctgtaccttactttcctcatcagtaaaatagtcctaatgaaattgcctaccttatagggttgttatgaggatttagagacaatacaagcgtggtatttagaatagtg

SEQ ID NO: 127157 - DNA, 495 bp, Homo sapiens
ttctaggctattcagctaggccttttgtggccaggttcctgttctctcacttcctgggttctttccttacctcaatccagtgttgcaaaatcccaccataggtgctcacttaagctgagcccttcattctcactgaaggttgaggacactcagaataggacttccaccaatacggatactgccttggataagcccaaatgctcatcagggatttgggcaactctgtcactgagcttcaaacaaaagatgctctcacgtgtgtttctagtaggctgcaccttgcctcagtgcaccctcaagcgatgttttctgtaaccccactcacaggattttgcatttatttctgctactctcatttgtgagcctgttgtctcagccagttgagttgtattttgtatcctaattatttcatctggtcctatctttccaaagcatgttacaacaatgattgtaggtatagccctgaagatttttagctggaactcagattagcat

SEQ ID NO: 127158 - DNA, 406 bp, Homo sapiens
tacatttacacacatttggagatctagggcaatgaaaaacacagcagttgggaagagtagcggacatctcttaatgtgcaaaatggctaccacactgaaacaaaatgtagattttaatgatgataaggattgaaacagtggatatatgttattatataaaaatgattttatttttccctgattgactttaaatgtcccttaattaatatagcagtctacaaagcctaccttatagaattattcactataacatagcacaaattactatgttgagtgaatatagacttattattccaaatgccagaatgaaatcaaatgagatattaggatacacaacatatacttggctatacctatctatggcatagatagtccttccctagataagaaacagtgagatgagaag

SEQ ID NO: 127159 - DNA, 722 bp, Homo sapiens
gcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttct

SEQ ID NO: 127160 - DNA, 389 bp, Homo sapiens
tttacaggcttctacggctgtagctgacagccaccttgaaaaatttagcaagggtaaatggctttgcccctgaagagtatctagaagtgcaaatcaactcttctctagaacacattactgatttgaatggcttgaaatgatatcactactttaaagtcataagattttaatactggaaaagaccttagaggtctctgtctagcgaaagacctgtgtgtatgtagaagacatcagaacacaatctaaactcctttacaatgatgtgttttcaaggccacatctgagctggcttgtgccctcttcgacgccatcaactactactctcctcttgctcatttggcttaagctactctggccatcttaatgttgccagaacaagccacggtcta

SEQ ID NO: 127161 - DNA, 646 bp, Homo sapiens
cgggggctcaggggctgagcacaggtaaaccttcagctctggggtctgggggtcgagtgcagcagccttcaaacccaggcggggctgagggaggcttggtctccgtgtccagtcgccggacaccctcctggtcctgcaaggagccagcctggtccaagctggagcagggcagaggctgacagccggctcagcccaaggctgccggtgcgtgcatatgcgtgtgtgctcgcgtaagccctgtgtgtggtgctcaccgcccggggcgaggactgccggggtcaaggtgccgtgactggccaggagtcctggtctgactggacccagcaccgacccacagcgcctggtcaccctcacggctcctctgccctcccctctaccacagaccaggaccggcagtgcctgcctcatagggctggggtgaagataaatgatttttttaagtgaactaaattaggcccacacgtgaaaataagggtaagctgctttttaaaaggaattattagccaggcacgatggttcactcctgtaattccaacactttgggaggcctagacaggaggatcgcttaaggccagcagttcaggaccagcctggtcaacatggtgagccccgtcgtgcacaggtccacgctcgacttcgtatatag

SEQ ID NO: 127162 - DNA, 810 bp, Homo sapiens
gctgtgtgggcctctgaggagctcccagcctcccaggagccgctgcagctgtggctctgcggccctgccgggggggcttagggaccagcgggaggcgggggctcaggggctgagcacaggtaaaccttcagctctggggtctgggggtcgagtgcagcagccttcaaacccaggcggggctgagggaggcttggtctccgtgtccagtcgccggacaccctcctggtcctgcaaggagccagcctggtccaagctggagcagggcagaggctgacagccggctcagcccaaggctgccggtgcgtgcatatgcgtgtgtgctcgcgtaagccctgtgtgtggtgctcaccgcccggggcgaggactgccggggtcaaggtgccgtgactggccaggagtcctggtctgactggacccagcaccgacccacagcgcctggtcaccctcacggctcctctgccctcccctctaccacagaccaggaccggcagtgcctgcctcatagggctggggtgaagataaatgatttttttaagtgaactaaattaggcccacacgtgaaaataagggtaagctgctttttaaaaggaattattagccaggcacgatggttcactcctgtaattccaacactttgggaggcctagacaggaggatcgcttaaggccagcagttcaggaccagcctggtcaacatggtgagacgccccccaccttttctttttttttttttgaggcggagtcttgctctgtcacccaggccggaatgcagtggtgtgatctcggctcactggaagctctgcctcctggg

SEQ ID NO: 127163 - DNA, 335 bp, Homo sapiens
gagtgaatgagtggatggatagatgggtaggtgggtggatgggtgggtgagtagatgaatgaatgaataaataggtggactaaacacgccctcacacacttccacggaccttcttcccaatcccagcataaaccatgcccttcaagcagcccatgttctgctccccaaacacactgtacactcttccctcagtgcctttgcggggatgattctaacctttctaaaagtacttctgccctcttctctgcctaattccactcatgaccagggctcataataagctcatgcaaaagccctctcttcactccaaccaaagagtatcccccttttccagg

SEQ ID NO: 127164 - DNA, 865 bp, Homo sapiens
gtaatttaccatattaaaagcctaaagaaaaaatacacatgatcatatccattgatacagaaaaaaaaattgacaaaattcaacatccattcatgagaaaaacctcttcacaagctatggacagaagggaactttctcaacattaaaattaatagtgaaagacgaaatactttccccctaagtttgagaacaagcaagggatatacactcttacgggtcctattcaacattgtaaggcagtgtgcggtggctcacacctatattcaggtgctttgagagactgaggcaggaggactgcttgagcccaggagtttgaaaccagcctgggcaacatagcaagaccctgtctctacaaaaaatttaaaaatattagctggacgtggtggtgcactcctatagtcccagctactctgagaggctgaggttgaggattgcttgagcccaggagtttgaggctgcagtgagctataatcaggccactgcacttcagcctggacaacagagcgagaccctgtctctaaaaacaaacaaacaaacaaacattgtaatggaagtcctagttagtgcaataaggcaagaaaaagaaataaagaaatacagattggacaggaagaaataaatttctctctatttgcagatgacatgattgctaaaaactccaaaactctgtgagctagccaggtgccatggcatgtgaggtggagccaggaggatcacttgagcccaggagatcaacactgcagtgcactatgattgtgcctgtgaattttagagctgagatttccctgttgcacaggctagagcaacatagagagaccccatctctaaaaaacaaacaaaaaaactaaccaatgagtttaccaag

SEQ ID NO: 127165 - DNA, 420 bp, Homo sapiens
aaagtatactatttgtacagtgctctaggcatcacagacaaggttacttatatccagcggtagatgaacagagttttgctaccctacatccctcctgtctgacctgaattgtgaggggatcttgacatgcctttggccactttgtaccaggcacacaggatggaaggctctaccttaaagtgtcatttttctgcatgctattgaggaaagacctgaacctagattcactaaaattatgttgtctaaacgcctgatacctgtcagcatattttctcccagaacttacaaccatcacattattccttgcccctactatagcttagacaggcatttctgttatttcagcttccctagaacacttgatataaatctaggcacttcaaaattagaaagataacagaatacagtaaatgtatttta

SEQ ID NO: 127166 - DNA, 604 bp, Homo sapiens
ttgagacagagtctcactcagtcgcccaggctggagtgccgtggctcgatctcagctaactgcaagctccgcctcctgggttcacgccattttcctgcctcagcgtcccgagtagctgggactacgggcgcctgccaccatgcccagctaagttttttgtattttttttagaagagatggggtttcaccgtgttagccaggatggtcgccatctcctgacctcatgatccgccctcctcggcctctcaaagtgctgggattacaggcgctatctctgttttcttatctctagtgcggagactgtacttgaacttgccttacatccttattgggccatctgaggttcacacaagataacagctatacacgggccttgaaaaatgttaaggacacacactttggggatggggttggcttcatgatcatatttgttaaaagtgcagtagttttggtaaaaagaccaagaagaaaaacagggaaccatgccttaattgtatgtgggaaatccccgtcttattttattgaggaaaactgcagtctttagtcacttatataaaataacagtcatttagttagtcatgaaggtgaggtgattttccagggt

SEQ ID NO: 127167 - DNA, 480 bp, Homo sapiens
taggggggaaaagattgcacctgccctcaaggagttggccacggcaaaactgatgccactatttaataactataacaaaattagaagaggaacaaaatcctatctttcataaaatccaattatgagatttttttggggccaactatgggtgttcctcatgacagtggtttccttggctgggtgtgaaaaatcacttccgatttttaaaaactttttattggctgggtgtagtaactcacgcttgtaatcccagcactttgagaggccaaggtggtgggaaacattgaagccaggagttcaagatcagccctggcaacatagtgagatgtctgtctctatttaaaaaaacaaacaaacaggccgggcacagtggctcacgcctgtaatccgagcactttcggaggccgaggcgggcggatcacgaggtcaggagatcgagaccatcctggctaacatggtgaaaccccgtctctactaaaa

SEQ ID NO: 127168 - DNA, 516 bp, Homo sapiens
agaagaatgctccaggtgcatttcaagatagctactttccccatccacttgcagaaagcacaagaagactattctcagatcttcactatagaacgtagtagggctcctggagataaaattcatgaaaatgtgagggctcctctaaaactgccctcttctggagtttttactatcaagcttgtccacaccatgcctccagcaatttttcaattacagtttgtttttctaccctgatactggctccagtggtaatttctgctcctgagcttctgcttcagtaagctgtggttctctttagctgcctatgtgctcaatttagggaatcgtggttttccctgtgacctcagctctctgattcatctgagaagagttgctgatttttcatttcttcttctttcctcattatgaggatgggaatgataaattccaaatgctttacatgctggagtagacacagaagtatcagttgccttaacatacaagttcttgttttttccatttccatctgttttcacc

SEQ ID NO: 127169 - DNA, 242 bp, Homo sapiens
acctactttccacaggggaaatggaaaaaacaagacctgttatgtaaggcaactgatactcctgtgacctcagctctctgattcatctgagaagagttgctgatttttcatttcttcttctttcctcattatgaggatgggaatgataaattccaaatgctttacatgctggagtagacacagaagtatcagttgccttaacatacaagttcttgttttttccatttccatctgttttcacc

SEQ ID NO: 127170 - DNA, 378 bp, Homo sapiens
gccagaaaagcgccaggtcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgcta

SEQ ID NO: 127171 - DNA, 374 bp, Homo sapiens
cctcagaggcttagaacccttttaagtttcaggcaaacacagtacagggtgtgggatctgtttctgacactcttgagagctacttgaagacgggctccatctgtgcctcttgaaacaaagacactcgataaaggcacactgaacaaacagtgatgcaaaattgcaaagttcctaggaataacagtagctaacttttcctatgaaagcagtgtgggccgcacctgtgcctaggactttacatgtgtatctcatttcatctcttaaatccccgatacgaggtaggttcagttatgatgatcccagttttacaagagaaggaaccatgtgcacagaggcacatatgttgcttatagcctcgtggccatgagcagcag

SEQ ID NO: 127172 - DNA, 204 bp, Homo sapiens
cctcagaggcttagaacccttttaagtttcaggcaaacacagtacagggtgtgggatctgtttctgacactcttgagagctacttgaagacgggctccatctgtgcctcttgaaacaaagacactcgataaaggcacactgaacaaacagtgatgcaaaattgcaaagttcctaggcacaggtgcggcccacactgggtaccga

SEQ ID NO: 127173 - DNA, 139 bp, Homo sapiens
ctttaagtctcttgaaggtgattctactgagctgggattaagaacacactgccttaatcctttcatcatcaacaaaattaaatactgttactattaacagaaggaaaaaaaagctgtttaaagagagtgagaaagtgtt

SEQ ID NO: 127174 - DNA, 651 bp, Homo sapiens
gaatgtgtgtgtgtgtgtgtgtgtgtgtgcatgagccaattgtggatgtctggagttacctcagagtctgctgtgcttctgtttccaggcatcttggagagtcatctcattcttgctgccacaaaatattcctcattcctccaatgcctcattgtgtggagggtttttaacactgaagctgatgtttgagaaaatacctgactgcttctctagagacaacatatactgacaacgcaacacaacctctcatgacccggaatgacggcaatccttttgtgggcacgcacgaaatgagaatgactctccaaagatgccccgggacaaacagaagcatggacacattcacatgaggggagacttggcggcaagcactgacacacaaaccggggctgcaccgaccctcaccgcaagcaatggcgcgcggaactccacgcgcgggagccccccaaaggcacggaaacagcgagccaccgacaagcagaagaaaccctccggactgggacggcccgcacgaaaccagacgaacaagagggagagcagagcaggccacaagcacgagaaacacaagaagcgaggaaggaagagtactcgcgagcacaaactgcagggcaagcacacatagccgggcgacgcatgaagagcaacatgggc

SEQ ID NO: 127175 - DNA, 314 bp, Homo sapiens
ggtgccacccactcccatgactcacctgtcagggcaaggggtacccaggccccaggagggcagctggggaaactgaggcttgcaggttgagccccagtggccctttggtgagggcatccacccagggagccagcaggggtccagggagggacggtggcctggggaagcaccacactcggacgcaggtgtgtggggcaggaatcctgaagagcgccacccacccacgttcgtgggaaagaggccaaccggggtggcggggggtcctgaggttttgctcccctccccgggtcagcaggggcctaccggagggagtg

SEQ ID NO: 127176 - DNA, 870 bp, Homo sapiens
  misc_feature (651)..(651): n is a, c, g, or t
  misc_feature (687)..(687): n is a, c, g, or t
  misc_feature (699)..(699): n is a, c, g, or t
  misc_feature (712)..(712): n is a, c, g, or t
  misc_feature (724)..(725): n is a, c, g, or t
  misc_feature (733)..(733): n is a, c, g, or t
  misc_feature (743)..(743): n is a, c, g, or t
  misc_feature (746)..(747): n is a, c, g, or t
  misc_feature (752)..(752): n is a, c, g, or t
  misc_feature (766)..(766): n is a, c, g, or t
cgcagtggctcacacctgtaatcccagcactttgggaggctgaggcgggcggatcacgaggtcaggagtttgagaccagcctggccaacatggtgaaaccctgtctccactaaaaatacaaaaattagtcaggtgtggtggcacgcacctgtagtcccagctgcttgggaggctgaggcagaactgtttgaacctaggagatggagattgcagtgagttataggatacagtgataactattatgaatggtagaaaaacagtaattactaaatattacatttgagggtcatttaataaacatctccatatattaatgctgagttttgaatgagcaatgttctgaattcacttcttttataaatgttatacaaaaagctgacagtattgttaagctcacctgaaatttttaccaggtaaatgaatacttggaatgtgtaatcaaatgtccatttgagagcagattgtgaaacagaagcaacgttcaaacttcaagacagctggtctattttattaaggacccaaataaaaatcagaggaataagctatatgctatgtaaactggatatcccacttttcaactagcagtaaaatggcttaatgaaaactctgtaggcttgtttttttctggcctcaagtcttttaagtgtgtancccggattttcaaaggaaacttgagagaaaaaccanaagaaacaaagncaatattgactgntatgtgtcctgnnacagttcntgagttggtngcnnagtgnaaattacttggganaaatcccaagtaagcttcgggttgcgccattctgtaagcattgaagaatttttctaaaaaaaaaccaggagagaaaatttggggggcaggctcaagaaatttaa

SEQ ID NO: 127177 - DNA, 159 bp, Homo sapiens
tattcctcaacactcctgctccaaagtcaccaagaggtacacaactctgtggaggacacactgactaaaaagcagggggacaaaccacagagttgtgtaccccaaagtgctgggattaccggcgtgagccaccatggccagctgcacaaaccaacatca

SEQ ID NO: 127178 - DNA, 579 bp, Homo sapiens
gcgggggcgggtgcaggctcagtccgggtaatcccagcacttgggaggccgaggggggcggatcacaagatcaagagatcaagaccatcctggccaacatggcgaaaccccatctctactaaaaacacaaaacttcgctgggcgtggtggcatgcgcctgtagtcccagctactcgggaggctgagagactgggattataggtgtgagccactgtgctgggctcccctcctttcatttttagaagaatggaggaaacattttcttcattccccctcccccaggccacacattctgcatcttcctgccagaatatttcaaaacatccatcagtgaggtgtgagatgagctttaaattcatcaggcattaaatcatgacctaccacttgttactgaaattctcttcctcacttccatttgtcctggaattcagtgttgtctgggaagccctacgactggctaagcatgaatagtgctatgtgccactgagcaggcttaggcgttagctttaattcacttccagaactacaaaggaaactgtagagcaaggggctgggcctggagtggttgcttggtccctt

SEQ ID NO: 127179 - DNA, 592 bp, Homo sapiens
ctctctttagaggaatactgtgtcaaacttttgtcccttttatcaggttacaacagtttaaaagtagattgtgctcttggcctaaacatattgacaatgacccttaacaatatttgaattatagtgtggttttcaggtaaacatcttagtacactgtttctttttatgtatggacctcacttctttacctatttacatatctctagggaaagattaatgcgtgagttgggaaaaaaaatagatattttgctttgaaattgctctattctttcttccaagatgccatctaggaatgcacgattttgaactttgtaggcacattttcattttaaaggaaaaggaaaaatgacttgaaaaaatgtgttggcaaaacctgaaaagaaagctctacaaaaaaagaactctagcccgaaaagagaacaggaagaaatgattactgatgatttcaattttcagtaaattacaaagcatacgtaatagacttcgaagagagatgattccaatggcatacttcatgccgccttcacagataagtgtgtaaatgaaagggaaatgaattgtttcagcctggaaaatctgtaccattttggtg

SEQ ID NO: 127180 - DNA, 943 bp, Homo sapiens
  misc_feature (7)..(7): n is a, c, g, or t
  misc_feature (32)..(32): n is a, c, g, or t
aaacaangggacatctacatatcttccatcgngatccaaccagtggctagcatttgcccaccttttgcagtttctttctctttcccataagtactttcttctctgaatcatttgaaagcaaatgaaaacagtagcctaaagtgtcagtttcaaccagaaaataacagctctgatttctcatggctcacactcttctgaaacgactcgggtagaggctgaggaaggccgtgttgtttgtctacctgggactagtgggatgagagactgagaaaagaaataagacacggagacaaagtacagagaaagaacagcgggcccaggagaccggcactcagcatacggaggaccagcaccggcaccggcctctgagttccctcagtttattgattaccattttcagtgtctcagcaagaggaatgcggtaggagagcagggtgtcagcaagaaaacctgtgagcctttcctttcgctgctgcggccgcagccatgagcatgctcgggcctcagaagaggctcgcctctagtgtcctccgctgtggcaagaagaaggtctggttagaccccagtgagaccaacgaaatcgccaatgccaactcccgtcagcagatccggaagctcatcaaagacgggctgatcatccgcaagcctgtgacggtccattcccgggctcgatgccggaaaaacaccttggcccgccggaagggcaggcacgtggccataggtgagcagaagggtacagccaatgcccgaatgccagagaaggtcacatggatgaggagaatgacgattttgcgccggctgctcagaagataccgtgaatctaagaagatcgatcgccacacgtatcacagcctgtacctgaaggtgaagggaatgtgttcaaagacaagcggattctcattgaacacatccacagctgaaggcagacaggccagtaagatgt

SEQ ID NO: 127181 - DNA, 957 bp, Homo sapiens
agtagaaggactgaacctccagaaaaagtactttaagttacctacaggtgatcctagtcaggcaaatgaaaacagtagcctaaagtgtcagtttcaaccagaaaataacagctctgatttctcatggctcacactcttctgaaacgactcgggtagaggctgaggaaggccgtgttgtttgtctacctgggactacacctactgaaagaagttctcaagttctgactgagttctaaaattttttgaagattagaattcttcatatgtgggatgagagactgagaaaagaaataagacacggagacaaagtacagagaaagaacagcgggcccaggagaccggcactcagcatacggaggaccagcaccggcaccggcctctgagttccctcagtttattgattaccattttcagtgtctcagcaagaggaatgcggtaggagagcagggtgtcagcaagaaaacctgtgagcctttcctttcgctgctgcggccgcagccatgagcatgctcgggcctcagaagaggctcgcctctagtgtcctccgctgtggcaagaagaaggtctggttagaccccagtgagaccaacgaaatcgccaatgccaactcccgtcagcagatccggaagctcatcaaagacgggctgatcatccgcaagcctgtgacggtccattcccgggctcgatgccggaaaaacaccttggcccgccggaagggcaggcacgtggccataggtgagcagaagggtacagccaatgcccgaatgccagagaaggtcacatggatgaggagaatgacgattttgcgccggctgctcagaagataccgtgaatctaagaagatcgatcgccacacgtatcacagcctgtacctgaaggtgaagggaatgtgttcaaagacaagcggattctcattgaacacatccacagctgaaggcagacaggccagtaagatgt

SEQ ID NO: 127182 - DNA, 979 bp, Homo sapiens
agtagaaggactgaacctccagaaaaagtactttaagttacctacaggtgatcctagtcaggcaaatgaaaacagtagcctaaagtgtcagtttcaaccagaaaataacagctctgatttctcatggctcacactcttctgaaacgactcgggtagaggctgaggaaggccgtgttgtttgtctacctgggactaaattctggttattgaatcacagcacctactgaaagaagttctcaagttctgactgagttctaaaattttttgaagattagaattcttcatatgtgggatgagagactgagaaaagaaataagacacggagacaaagtacagagaaagaacagcgggcccaggagaccggcactcagcatacggaggaccagcaccggcaccggcctctgagttccctcagtttattgattaccattttcagtgtctcagcaagaggaatgcggtaggagagcagggtgtcagcaagaaaacctgtgagcctttcctttcgctgctgcggccgcagccatgagcatgctcgggcctcagaagaggctcgcctctagtgtcctccgctgtggcaagaagaaggtctggttagaccccagtgagaccaacgaaatcgccaatgccaactcccgtcagcagatccggaagctcatcaaagacgggctgatcatccgcaagcctgtgacggtccattcccgggctcgatgccggaaaaacaccttggcccgccggaagggcaggcacgtggccataggtgagcagaagggtacagccaatgcccgaatgccagagaaggtcacatggatgaggagaatgacgattttgcgccggctgctcagaagataccgtgaatctaagaagatcgatcgccacacgtatcacagcctgtacctgaaggtgaagggaatgtgttcaaagacaagcggattctcattgaacacatccacagctgaaggcagacaggccagtaagatgt

SEQ ID NO: 127183 - DNA, 308 bp, Homo sapiens
cagaatgtacctgaagctattctgaaagttaaatatcattagatacattgtcaaaccctgaagctgaaattccagccattcagggagcccctcagggagatcactgcttttcccttgcaaaaataaaaatagtgtataaaatactatttaaatatatactcttatctaattctaatagctagtatttgttaagtgcttagtaagtgccaagtgctgttcaaattgctttttaggctcacacctgtataatcccagcactttctgaggccaaggtgagaggactgccatcttgaaattttttttttaaa

SEQ ID NO: 127184 - DNA, 851 bp, Homo sapiens
gggggtaccatttccattatacagacgtggaaactgaggcagtcccctgcaggcaggatagagcaggccccagctgggtgggcccagggccgagacccagccctctccacctcagctctcagggatgggctttctgggtcttgtcttcctcccctgccaacctgttttcccacaccggggcctaattcacacctgggagcccctcatggcttcccttcctcctcaccaagactcgcctcagacccctcctgcaccaagccctccgccttctccatcccatcttcctctccctccattcctcccctccttcggtttccgtggcaaccccatcctccgctctgccactcggtcctgccttcccatctcatctctttcttccctctttcatctctcccctcatcgcagtgtacagtccaaatccccctctgtcctttgcctctgctctctcgctcccttttactctccttttatctccttcaatgttctcttgtcatctcagggtgacatttatttatcttttgcttaaaaataaaaaagaaaagaaggaagaaaggagggaaaaagaaaccccattccatcagccagggcttctccagatcagtcccggccttctctctctcgggtcatctctaagggtcagactccccacagtggccaggagggaggagacaaaccccagaacggacccctgcctgccacagggaagcttctctattgacctcacctagggaagggaggaggaaaacacacgggtgggaagtgtgtgttgggggggctccctgggaggaggcatcccagagagcctggccctgcttctctgaggtcagggtaggggagaagccggcacccac

SEQ ID NO: 127185 - DNA, 273 bp, Homo sapiens
tcaggctagtgaccaacttcttcagtgggagctgcggatttgccacctgatctaaaaggcaggaagtagccattgtcggttcctacgtgaggtgacaagaacagtgcgctggtcaggtgtataaatgctaccaaagaatgcattagagacatggagaccatctctcaagctagtcagtcagtttaatgtgaggtgcttaggaaaggacccattctactgcaagtgacatacctgccagagcctggtttgaatgctggtaagtcatggcagtgg

SEQ ID NO: 127186 - DNA, 244 bp, Homo sapiens
gagaaaagtggaagcggtgtgggaagaagcggggtctgggccagctgctggtcctgctctcctccctcctctggcctctaggcttccaggagtggttcggaatccgcgccatgtgctctgggggctgtggcagggcaggggcaccttggaacctgcgccatgtgctctgagggctgtgccagggcagggaaattcctcgtgtcccctgcgcacaacacggacagaaggctgggtccacccagtg

SEQ ID NO: 127187 - DNA, 508 bp, Homo sapiens
gtgacgcaggccctgggctacagcaaccttaccagcccctccagcttagaggtggcagtggctctctgcggctgcgatttctttctcggagcgtcctccccatcccgttcggcctctgcctccaccgtcgtctctgtaacccgttccctgtgggagagtctctgttgcggtgttcaggggtttcggttttctggctgaacagtgattaacgcgagggaaggcgctgacggcaaggtggcaggaagaacattccaacacagaccacaacacctatggacctggaaaacattgtgctcagtgaaagaagccagacacagaaggacaatgttgtatgaggtcttattctgttgcccaggctggactgcagtggtgcaatcctagctcactgcagcttcgacctcccgtgctcaagtgattttcccacctcagcctcccgagtagctgggactacaggtgcgtgccaccacgcctggctgatttttcttgtatttttttgtagagatggggg

SEQ ID NO: 127188 - DNA, 418 bp, Homo sapiens
ctgggctggtgtcatgtctttgctattgtgaacagtgctgggctggtgtcatgtctttgtgactgtgaacagggctgcagtgcacatttgcatgcatgcatctttatggtggaaagatttatattcctctgagcgtaaacccagtaatggagcaatctgatttctgacaaagtttgtaaaggcaattccatggggacagaaatcttttcaacaaatgctgctggaacaacgggatgtccacaggaaaacaataaacctcgaaccaaagaagatttacagatggcaaataagcatggggccagacgcgcgacatcctttgacgtgagggagcgcccatgaaaatagcagtgaggcaccgcacacctgtcacgatagcccaaatccagagaccgacatcaccaaatgcgggtgaggatgt

SEQ ID NO: 127189 - DNA, 162 bp, Homo sapiens
agggaatggacgaaatatatctgtgtatctcttcctttatatagggtttcctctaaatgggcaaactggagaaaatttaaagttcttagagaactttctaatacaggtcatttttcgtggtgtaaatacagtctgatagattgggtattttataaatgtgaa

SEQ ID NO: 127190 - DNA, 728 bp, Homo sapiens
gggaaagcgtaaatgcaggagctccgatggccctttcagcctctggagatatgcatcttgttccctaggagcccagtttccagttgcatgaaagcctaaatgtcattacatgtgccattgctggaagccacatttattaagtatttcccatgtgccaggcaccattatctacttcagtaaatgagaaggactgtgaaggcttgtaaccatgataataatgaatatgaatataaaggcttggcatactggtctcatacaagtaagcagtcagtaactatcaattgccagcaatatttgtcttgaatttgtaacaactcctagtaactacctaatgaatcagcaccatcatcaaccaattttactgaagagaacattgaatcttagagagcagagtaaccttacccagggttactctgctactaagtggctaagtctgggttcaaatccaggttggtctgatttgactgtttggtccactctcaaggtgtctcactcacatgtcaggtcagttcacactgggttttggcaggaagctatgtggacttctccctagggttgtttgagggatctcatggcatggcaggcagcatccctagaacaaaagaccaaagacagagcaagttggaagttttaatgtcttttatgacctcacttcaggaatcacattccatcatttctgcaacatcaggccagctctcttcatgtgggagggagactaactacactgg

SEQ ID NO: 127191 - DNA, 714 bp, Homo sapiens
gggtgactgtcagcacctcactgggcagggcgcaagggctgtggggtagacgttgggtggattcaggagactgcagaaagcaaagtgggtgttaatgggacttttatttcctgtggaacaaaggacactacacttttctgcaaaagaccaagtagtaaatattttaggctttgtgggccgcagatggcctctgtcatatattccttttttttcttaaaacaacccttaaaaaatgtcaaaatcattcataactggcaggctgtgagctggatttggtttgccaacaccttcttatttcatcacaactaattaccactcttctttagaaatccagtgtttaatgagtttcctttataataaggttgagatttgggaagtcagtttttacttgaggcaaaaaagttgtatcttgattcataattcagaagtgtcattttatctaggttttaggcatagcttctcacctgattggtgaacgtataccctgtttattattagctaaaaataagtgcttgatgccagattcactttttttctgatttatttcttagtatttttcatactttgcctttaatactaagtgtggggaagagtagtaaaaatatattttaaaaaaaggttttgtgatttttaagaacgtagaggtgcatgagctgtattattccaccagaagcatggtgggtggcactggcattgttattctgtgccctcaga

SEQ ID NO: 127192 - DNA, 308 bp, Homo sapiens
gctcacattaatacagggcctctctctcagcaggagccaccgtcaagacagggctggcacccaagggccccagcacaagctacaaaggcctcccagactgactctcccacaatgtgcacacaaggacaggacctccacccagttcactcctcggctggagacactaggtgtcctgcccctaatctcaccagagccacctcataaaccctgcaagctctgcgaagggcagctgggcacagctgaaagcccagccaccagcccatgtcctgggtgggactgggcaggaggggccacctcctactgctgat

SEQ ID NO: 127193 - DNA, 599 bp, Homo sapiens
agaggacctggatagtaaatttcagtacatttaggtcaatttcagctcttaactcagcagtggctatccatccccattctcctgcgtatttctggatcagcttgcacacagcttgccgaaaccagcaggagccataaggatactgtccattaaatatcagggatctgtgttctgatatctgattgatgctctgatcaaaaaggcagagacacagacaaaggtgggaagttttgttgcaactcctcctttgttgcaagcccttccctctccagctgaagtgagatccaggggggtttaaagggccagcgcctcggcacctttagtttttctccttttccccttttgagagccagacattaaagactaggacattaaattaaaagcaaccacatatatagaggaaattagaaagtaactgtgcatgcccggagaaaggtatagactcagaaatgaccagaaaagaccttagatttatacctcaggctggtccttggcacagagaagcctatatcaattaaaacagaacagatacagcaaattctgggaaaggagaagaatctgatttccagagacatgatattattagattcatatatata

SEQ ID NO: 127194 - DNA, 288 bp, Homo sapiens
gagagtggacagatggccctcccacagctgggggttggggtggcagctgcctcccacccccacggccaccagtcttaggcaggctgcccgccagcatccagccaaggagcccagggggtggctgtcacagctgggagccaggaggggtgggtgtcccagagaccagaggccagcagtctgctccagcatcccgctgttttgagctcacagcacttcccatcggtacccttgctcagccttgcctggtcgtgatgcagtcaacagtgtctcgctgtctgccaggcactg

SEQ ID NO: 127195 - DNA, 299 bp, Homo sapiens
aatgtcaactacagtgtagaaaggtgattttggccttggagcctgggagagatctgaagagcccacactcaggtcttgcctgagctctgtcaacaactttggttctgctctgtgcctcggcttcctcatctgtcaaataacagggattaactgactatatgacctcccaggcctctcccagctcctcccttctctgaatcctggccagtggtcataaggctgaagatttgctaagagtcacccttgaggagcttgttaaactcactctccaaaacgcaggtattgtaaatgctgacatt

SEQ ID NO: 127196 - DNA, 372 bp, Homo sapiens
ggcgtgggacagcctccatacaaagtcaggccagagcctcgcagggacccgtagtaccgactgtgtttgaggagcagccctgtgctttctgttgctccagtctacccgccccctgagctgtcagcaatgcctctgagagacggtgggcagaagggcagtcatccatggatccccgagccagggcccttgcacatgacctcagatgagaggccgatggtgccaaggccttctgagtcaggcttgggttcaaattcctgctccaccactgggtgatgaagtacaggacctccttcccgcgtggttagagggcactccgcaccctgtccatcctggtaagtcacttactttggccaatggaatcaagtgaatgcc

SEQ ID NO: 127197 - DNA, 242 bp, Homo sapiens
tttggctgtgcaaatagaagtacaaggggaggagattcctttacaggtcccaagttttcttctgctatagataatagagaaagtgtttcgtttcttgttcctgaagactcaaaactttaaaaccctgaatgtcggccaggcatggtggctcacgcctgtaatcccagcactttgggaggccgaggccggtgatcacttgaggtcaaaagttcaagtccagcctgggcaacacaggaagaccc

SEQ ID NO: 127198 - DNA, 630 bp, Homo sapiens
ttgagattatactaggcatggtgctgcgtgcctgtagtcccagcttctctggaggctgaggcgggagaatgacttacacccaggagttggcagctgcagtgagctatgattgagccactgcacaccagcctgggcaacagagtgagagtccatctcttttaaaaagaaagaaagaaagaaagaaaggaaggaaggaaggaaggaaggaaaggcttgactctttttttcattcattcaacatacacaggaaaatgagactatactaggctggtaatacaaagacaaaacactatttgatctcaaggagtttatcctctagggaaggcagatactcagactagtaacagcatcctgggataaggttaagtgttatggacaactgaggtaagaacaaagtgatgtgggagcctggggattgctctctttaaggaaaacaaggaaggagtcatggtctaagcactcattgaactgggttttcttcagtgagcatatagtctagtgaatgtgactgccacgcccatgaataattccaataccaggtagaaaatgccgagtgccctacaagaaactcagacatagggctataaagtaggttcagaggtgagtgtgtttacttctagctggggtctc

SEQ ID NO: 127199 - DNA, 662 bp, Homo sapiens
atgcccgcctaattttttctatttttagtagagatggggtttcaccatgttagccaggatggtcttgatctcctaacctcgtgatccgcctgccttggcctcccaaagtgctgggattacaggcatgagccaccgtgtccggccaagttctagtgttctttcagcgagctactaatggcagtgttacctagaatgagccaggtgtatctacatgagagaacaaacattgcggagaatgaatgagtgaaggaagtaattggtctctgttacaggtgtatttaatttcatataatatatgttcttgtgtgtaaatttaatcctattttgaatgcaccagacaggtccctgtgggagaaaacctgtggtgagttccttaaaactggaggagttctctcatggtgcttgcagtcatccctggtttgttagttggcagcctgggggaaagtgacaacatttactgaggccaagtacctgcctaggattatgtaggaaagtttttacagatattatcttaatctttttaacagctttatgaggaaaagctgccattttatgagtgaggagactgagttcagagagtttaaccaggttccagtattttttaaaaattgtgaattagatagaagtgttaccagtatcatacaggtcatatagatggcaaa

SEQ ID NO: 127200 - DNA, 406 bp, Homo sapiens
gaagctctctctgtgggggaaatggtcagattttgaagtcacacagacaggaggtagaatcccagtgcagccacttacaagctgtgtgctccttggcaaggttcttaacctcccagagcatccatttccgcagctgtcaaacacagataacaaggaacctcgaagggtgggcgtaaggttgagatcgtgggtactaaattcctggttcaaagcgcagctggcctaccaacgaatggaagctgtaagtccattatgaaagactggactccggggtcactgatgctgtgggcactgcctgacttgcaagcacagggggaaagctgtgattgatgtgggcagaagtggctggaacaggtagcaagtgaatgatatggcagcagcctggatgatcaaatgggtaccctgg

SEQ ID NO: 127201 - DNA, 514 bp, Homo sapiens
ttcacacacacacaccccacaaggcatacaaagaaacaggaaaacatggcctattcaaaggagcaaaattaattggtagaaatcaaacctgagaaagcacagacatcttactaactaggcaaagtctttaaaacagctgccttaaatatgttcaaagagtgaaaggaaaccatataaagaactaaagaatattaaaaaaaaaacacataagaacaaaatgaaaatatcaaaaaagaaaaattataaaaaggaaccaaacaaatcctgaagcaactgaaaagtcccataactgaatttaaaaatttactagagaagttcaaggtttgagtaggcagaagaaaaaaaatcagccaactttatgatacgatatttgaaattatcaattctaaggaccaagaagaattatgaaaagtgaactaaacctatgagatttatgggacatcatcaaatataccaatatatacattatgggagtcccagaaggggaagagagaaaggatcagaaagattatgt

SEQ ID NO: 127202 - DNA, 529 bp, Homo sapiens
atctcattttcactttcagaattttaattgcggcacaatctccaaggtttaacttacacaggagtatacataaatattgccagcattcacctggtgattaaaaatcatcaccaaatcacatgaccaggatcagtggccagagaggtaatagtgagctcccacttacaggaaagggacagagagccctgggtgcttggctcctacacagctctaggctccccaaatcctgctggtttctactctgctctttaaaggtcacttcagtgtgaatcatttacgggacttgtcatgacgcagctcccaagaatgtgtacaagtcagtttcacaggcagggaaaaaaaagtgagaaagaacagaatgggcacagccatcactctcccctaaccctgaaagataaaacaaaggagtgggggctgatgccaccccacgggtgaccctttgaattcccgctgaagccagttctagaaaataaggtctttctgagaagcaacttcacagattccaagtgaagcttggtttctttataat

SEQ ID NO: 127203 - DNA, 727 bp, Homo sapiens
gaaattgatgttgaaatttgagcccttatttggaacttgttgcccttgaggacacgtgaaaagggcaaggggcaaaaacatgagattcctttaaaagtctcagcttagaactagcaccttgtcacttctgctcacattggttccagaaagccacatgacaatgccagaaaatgaggtaaggaaggatgctctgcgtatgtgtgacattgggaggggatgcttgatcttctaacagagaagagaatgaattagttgctgagaaaaatcatataatccattattgaagtatttttaatttcctgcttccattccagtatatttttgaaaatatttatgatcttttaattatcctaataactttccttctccactagcattaatagtgcttttaaaatatatatgcttgggaaacacttgtaagttgaattaaaagggaaagtaattatgaataagctatagggtctatctctgcctaattcagttattgctcttactctttccacttgtcctttgatactgaatacaaagaaaaaaagtaaaggaagagaaaaacaaccagcttgatgttctaggaaacgttgatcattttctaaaacaatataagcctgtatgttcacaactgatggacacaataatgttctcgccatgtgagcagaaaggatgagatttgtagggtcacaatttataaaagctctgcgtcctgttgacagagtctagagggacattc

SEQ ID NO: 127204 - DNA, 577 bp, Homo sapiens
tcataggactgaagggcaggaaggacactgacaacagccttaaggcaaacctctcacaggcttgacaggagggaaaggagtagatgatgagaagaaagagaatggaaaagaagacacccacagtcctcctagaaactttaactaaatggacgaggcctaagacaggacctggttgtaaatttcatgctttggaaggttattttagactcaagtcccagtgagtctatgttagactcaagtcccagtgtttgggctgtattttataatggggacatttgtgtaatgggtttattcatctatccattgtgcacccgcctacccacccatctatccatccattcacccatcatctgtctatccatctacctgagcatccatcctgccatcatacatctattccatccactcttccacccattcacttttccatccatccacccgtcatctgtctatccatctattcatccatcatccattattcatccacccacccatccatctatccacctacccactcagccatccatccatccatttgtccacccacacatccatccatccatccatccacccatcc

SEQ ID NO: 127205 - DNA, 227 bp, Homo sapiens
gaagcaaccctgccagcagccagtccctgagctggggtccaggtcccccaggaggcatacactgagcctctatgtggacagacaacagagccactctgtccttgagaaagaaccctgtgtgtcccactcactctccttccagcacaggcacagacatccaaatgtcccattcactggccgttacagcctccagccctcaaactgcctgcagcctccacctccgctgg

SEQ ID NO: 127206 - DNA, 503 bp, Homo sapiens
ctcactgcaacctccgcctcccgggttcatgcgattctcctgcctcagcctcccgagtagctgggactacaggtgcgtgccacaacgcccggctcctttttttgtagtattttagtagagacggagtttcatcttgttagccaggatggtctagatcttctgaccttgtgatccgcctgccctggcctcccaaagtgctgggattacaggcgtgagccactgtgcccggcctctgccctaccgtctttacccagaggatctactgattttataaagattaccttcctaagcattctccttcttaaactgtccataaatttaatcaaggtagttcttagcaacagtccctttagcagacagagatactgaaatctattctctatttgaaatatatgtaactttataaaattttaaaaatccatagaaatatttcaagagtgattatagaaatggatgaaaaacagcacaattagaaactatgccactattcagaaatgtgattt

SEQ ID NO: 127207 - DNA, 319 bp, Homo sapiens
agttggatcactgtctcccggcaggctctgggtttggtttattcttgaaagctatgatcctaggagataacattgccggcggagaggaggcaaatgtgttaaatggggaaggtttttgtgtttggagaaaggcaaatgttctttcactcagtgtttttccccatttatttccttccaaaccttcttattcggaacaaactgcatctttccatttcaaatggatgtagcctgtgtatgagatgaatgggtgactgaatgctgaggggaatatcacgtaaaaaggtagatgatgttctctatactctgatgattggttttg

SEQ ID NO: 127208 - DNA, 464 bp, Homo sapiens
tgtggatttattcctaggtctgaataaggcattgtgtggcatccagagagaggcaggacagaggaagcagtgagagagaagcaattctagaaaatgtggataccttgctgctcagtgtggcttatagacagtagcacatgcatcccccggagctttgtagagatgctaaagctcagctcccaccccagagctactgagtcagaatatgtggtttgtgtgcacgttaaagttagcgatgctggctaccatccttggttcctggtggcatcttttaggaagagttgctacctgggatggattctgcattgtccccttccagtggccttaaagatctatagtgttacttggaataccgagtatttcccaggtgtccactattgtgatctgactttaggaagacataaattggatgaaggagagatagcaagcaggtagatcaactataagcccagtcttctcatgaa

SEQ ID NO: 127209 - DNA, 227 bp, Homo sapiens
agcaattgacaaagtaaatcaaaatttcaaatggaccgggcataatggtcactcctgttaaccccaccacttcaggaggacgaggtgggaggatcacttgagctcacttgagcccaggaattctaacaccagcctgggaaacataacgagatcccgtctctaaaaataaaacacacacacacacacacacacacacacacacacagtcttcaaatgcgcccttctac

SEQ ID NO: 127210 - DNA, 684 bp, Homo sapiens
caggtgatctgcccacctcggcctcccaaagtgctgggattctaggcatgagccaccgcgcctggcctggctcctcttcttcttccactcagatatgcctgaccctgtcaacactttggttgaggtcttctttcttctttcttttttgctccgcacatttagcttatgacttcaaccatcatttctcagagcatgggtctggctcaacctctctcctgaatttcagacctacaagtctagctacttggtggagacctccccagaatgacctgctgcttcccaaaagcagactctccaaattacagtcagtatctcccccggaagcattcccccaggcatttctctttctgccttcaattccccattctcctacattgccttgccagaagcctgctggtcagcttggatttctttttgtccttttttttctatattttgctggtgcctagtcatgtagttgctgcctctacactttctcttctttaaaaaaaattattaaagcaccacgtgcttgttgtaaacatttccagaaaatacagaagtgctcaaagtgaaaaaatggaaatgccttgtcccttcctcattccctgccctaacctcacgccccagattcagctatgtaatagtctgtcatgccaagtcttatttccagctcctcttttccatccccactgccatcatctg

SEQ ID NO: 127211 - DNA, 608 bp, Homo sapiens
gacggcttctggagagagcatgtctctctttcccctgggctccatgccagcttgccagaatttttacaatttgttttcctcatttttctaattatgtttcctcctgaaagtgattatagatagaattcatttgtatttgtggagacttctttatcagatcagcaagttttcctttttttacgagttaatactttcatctttagggttctcagggaatacacagcatatgtcaaaacaaaaatgagatgaaaattcctaggtaattttttttttacttttattttaagttcatgggtacatatgcaggtttgttacatacgtaaactcgtgtcacgtgggtctgttgtacagattattttgtcacccaggtaccaagcctagtacccaattgttactttttctaatcctctccctcctgccaccctccaccttccaataggctccagtgtgtgttattcccctctttgtgtccgtgtgttctcatcatttagctaccacttataagtaagagcatgcggtatttggttttctgttcctgcattagtttgctaaggataatggcctccagctccatccatgttcccataaaggacacaatcttattcttt

SEQ ID NO: 127212 - DNA, 521 bp, Homo sapiens
gtttgatgcgtgtgctggaagagatagaccgagtgtgttatgagttgggggaagagcagatggggtgtgactgccagcctaccagctaattagaaaatactgatttattaaacctgaactctaagagaaaagcccgtaatatgtacacctctgacagaaaggacagaaatgtggtttttcatatgaccacattctgaattacttttatttatgaactatatgttgttatcacttgaaatgacaagaaaggtcatttctccttagcaaagaaaatcctttcagaaaattttcgaaataaattaccaactagaatttgtaatgaggcatgatatcccaaaatattagacaaagagtaagacaaatacaattcagaatcatattctgcttgttgctggcctgataataagccttgattcatttggaaataatagtttatagtcagagataaaccattatttttggaaaaatgggtccatcacatcacttttatgtgttatcttcataacaaatcagaacataac

SEQ ID NO: 127213 - DNA, 407 bp, Homo sapiens
gaggagggaaggtgggggatgccaggcccctctgggtgagtcgaagatctccaccagaggctcatttcaaaggggaaggcggcacctttattttcaaaagaggcaccgctcctggcttcctgtgagctccacttctaccgtagttagaggaggagggtttgatggggctcagggtcatggccgaggctctccagcctgtgtggatgaatgcactcgcagatctcatctctccgctgctccctccccagcctgatgtccagccctgcccttgcactctagtctcatacgctattgctcacttggcatctcaaatgacagttgcccaaaacataattccagcttctccttccagatttgtttcatctcccttctgtctcactgaaggacagccccacccactcagccgc

SEQ ID NO: 127214 - DNA, 132 bp, Homo sapiens
tgagacaatttatacaataatggacctataagctctcaaaatgtcaatgtcatgaaaacaaagaaaggctgaggaactgtttcagattaaaaggacatgaaagagggccaggtgcagtggctcatgcctgta

SEQ ID NO: 127215 - DNA, 768 bp, Homo sapiens
gtctttctgtccctttatctctcctttcctttctaaactaccattgtgcatatgttgttatgcttgatggtgtcccacaggtctctgagactcttcattttctcatttttttcttctaacgggataatttcaattgatctgattctaaatttgctgatttttctgcttattcaattctgctattgaattcctctactgagttttcattttaggtattatatttttcaaatccagagtttctactttatttttttaaaaacatatataatttttctctctgtattctctattcagtgatacatagttcacacaattttctttagttatttagacatggtttcttttggttattggaacatctttaaaatagctgatttaaagtctttgtctagcaagtccaatatttgatccccctcaggaatagtttgcgttgattgctttcttccttgtgtatgggccattgctttttgtttctttgtatatcataatttttttgttgaaaacttggacattttaaataatgtggccactctgcaaatcatattctctctcttgccagggtttgtttagtgacttttctgaactgattctgtaaagtctatattctttgtcaagtatggccactgaagtggcctgctctgttagcttagaggtcaccaaataattggacagattttctcaaatgcctagaaccaataagtcacaaagtcttggctgagtggctgtgtgcaagtgttggagcacaccttcagtgcttagccaggcagt

SEQ ID NO: 127216 - DNA, 284 bp, Homo sapiens
ccagtgtaatcataaagatccttaaatttggaagagggaagcaaaagaaggcagcgtcaagtggtgcaatgtgagaaagacttgactggtcattgctgtctttgaaggtggaaggggaccataagccaaggaatgcaggcagctgctagatgctggaaaaggcaaggaagtggtttctcctgtagagtctccaggcagacacactggttttagtccactgtgacccattttggactctgacctatagaactgtcagataaactgtcagaagtgtaagctggttg

SEQ ID NO: 127217 - DNA, 1843 bp, Homo sapiens
  misc_feature (518)..(518): n is a, c, g, or t
aaccaaaagagtcttcagaaactttgctagacctgaagtacttgaacctgtgtcccctgaatctttcttacagcatctgggacaaatccctggccctgtgacatccgaagcagaactgtgccctgctctctccttctgtgatgaccaaggatggtgaactcaagttgttctctacaagccaggccagcaacctaaatacttggagaggaacttttagaaactataatcctgacaaaatagaaaagtttcccataggggcataccataatactataataacctcccaggaactattgtttgccaaaatgtagttaatatattttaagatatatgcttttttgcataggactagaaccagaaaagacaccaaatgcccccttgacatcaatgtcctttctagtgggacaatttggtctccattaatgccaaacctttctgaacaggatacatggcttttaaagggcagatgtttctcctgctgctagaagttcctcagtttactagagcacaatgagganagtattcaacctccctactgccaaggaattccctgcttctcccccaccgccatcatcttgtccaagctatcagaagcaaccttctagagataatctaacaatcctgattagaattgctcccatatccctggtgaccacaggcttcattcaaattgtccaaactggttaacatgtatgtgatggggtatctctgcatctgtatgtctgtctgcgaggttccttgtatattggctgtccgctgacttgggacagatctctctagaacttgggttcagttctctgacatagtccactcagccataggctgagtggctaaatatgcataaataagcatgcctaaataggcatatataggttggtgcaaaagtaattgcggtttttgccattaaaaatgatagcaaaaatcccaattacttttgcgtcaatctaatattacattgcttgatagattaagatggaatcccaccaggtttagggtaggactggatgctcaaaaaataaagaaggagaaaaatctgtggcagaggcatcctaatgagaacctgacttctccttgcttccctctgctctctcctgcgcctcagagacttgtccccattgcagaagcttcctccatgctaggccagaggatatcaaagtttagtttggtcaagatttgggccaagaaaattcctttttagaagagccctcatatctgaatcacatcactttgggccagttatctctggtcaccctcagacaaaccctcgtctctttttctcccttcctagaggaattcccagggaactttgcagaaataggtctccagagttgctacagaggttcatggctcctttcgaggagggacatgtatgaaatttgaacagatcaagacaggtgtttgtcttcaaccatgggggaagacctccagcttccattttcccctatacgtgtctgtgctgacatcctttccagcagtagaagactaaaaagatatatcttaacccattcctcaaaaggacatcttcctaaagccagagaaaattgtctgcgcttccccaccccaggaagaggcaaaagggaagtgagggcgtcacaaggtcttttgtaaatcactattgtgtttgtcacagcactgggcggagagctggatccacagagctctcagtttttctaagcactgtcctgtaatgtgctaatgtctgggggtgggagggctggggaggggtggggttagagggaagatgccaacctttgtatggagatgattttataaccatgcacttttgtaactgtgcagaatttttcataaatgtacattaataataaagagtgtatagtttaac

SEQ ID NO: 127218 - DNA, 405 bp, Homo sapiens
aaaagcagagtccctgacttgccttcagacattaaggcttataaaaaataagacaatctccctagaactgcacatatgataccggaggtcatgcatcatgcatttctagaaccataacctccttcactggagacagtgacaccatggtttacgtgtaaacctaggctgtctggaatctatctccaacctacttgtgacctatatgcaatcttctcctgcttgctcactgagacccactctgtgctacagaagaggctcccagctgtcccacctagacgtggattgttcctacaaccctgctactttactcatgctcttccaccaggaagaattaataatgtattttctgataccatttctgttgcatatatgcacataattcttacatacattgggttcaagttt

SEQ ID NO: 127219 - DNA, 202 bp, Homo sapiens
tcggtatgaagggaagatggggagtgatttctgacagagtgaagtaagagcatatgtcctctatatgcaaggtgctgtgtttagaaagcagttttcagtttgccactttcagcctttcagacgagatgtcattttcgatataatgttcgtatgtgttactgatagtaaatgccatgtttcctcttggtggaattgcaccgta

SEQ ID NO: 127220 - DNA, 757 bp, Homo sapiens
catcatggcagacacctgtaatcccacttacttgggaggctgaggcaggagaatctcttgaaccagagagacagaggttgcagtaagctgagattgtgccactgcactccagactgggcaacaagagtgaaacttcatttcaaaaaaataaaattaaaaaaagaaataaataaatacatcaagaagacaatcccccttacaatagctacaaaaaaatacaataaaatacttaggaataaatttaaccaagtaggttaaagacctctataaggaaaactataaaacactaatgaaagaaattgaagaggatataaacaactggaaagacaccctatgctcatgaatcagaagagctcatatcattaaaattaccatattacccaaagcaatctataaattcaatgaaaataccaatgtcattttttacagaattagaaaaaaaatcctaaaattcatatagaacaaaaaaagagcctgaacagtgaaagtaatcctgaacaaaagaacaaagctggaggcatcacacaatttgacttgaaaatatattacaaggctatagtaaccaaaatagcatggtattggtataaaaatagacacagaagaccaatggaacataacagagaagacagaaataaatccaggtagttacaactaactgattttccttttttcttttttctgaatgtttctcaaaaagccaactgattttcaacaaaggtgtcaagaacatacactggggaaagaacaccctcccttc

SEQ ID NO: 127221 - DNA, 466 bp, Homo sapiens
agacagagtctcactctgtcacccaggctggagtgcagtggcgtgatctcggctcactgcaacctctgccttccaggttcaagcaattcgcctgcctcagcctcccaggtagctgggattacaggcacaccaccacgcctggctaatttttgtatttttagtagagatggggtttcaccatgttggtcaggctggtcttgaactcctgacctcgtgatccacctgcctccgcctcccgaagtgctgggattacaggcgtgagtcaccgctcccggccctgtgtatgctctttttgtaaatgaaagggaaatatgtatatatgggtttttttattttcattttttttcctttttttgcataaaatctagctcctgcaggagaattttgtgtatgtgtgtttaaaaaagaacaaaacaaaactgaaagcataaaccaaaaagcagaagaagaatgaaacagggtaaaa

SEQ ID NO: 127222 - DNA, 391 bp, Homo sapiens
agtgagcagagagagggccctgaatagaatgggaggcaggttgaccctaagcagttcccagcttgatttttccctttagcttagtgatttgggggccccaagatttattttcctttcacatatccaccaacaaacacccaagcaacagggaagggactctgggtccttaagcttctttaggccaaccttgtgcttttatagcaaaggaaaataaagtccaaaagggaaagtgactttccctagtccacaaaagttgttggtgaccacaataaggagtttcaagtcctagacacatcctgcctcagtctctaccctccagataatgagcccttcttgtcatacttgttatggacattcatacaaggctaaactatttgaatgacttaacact

SEQ ID NO: 127223 - DNA, 691 bp, Homo sapiens
tccatgacactcattggtatacaagaaaaatcattctgctgtcttcatcatcaatttaaggtgttcagctgtgatgccttggtactttatgttgtgattaattgccttatactaacatctgatgaatatttttaaaaacattccttaggttacctatgtggctgaactgtgtggttagttgggaaactggggctatgaagtgagttccccaaagagctgaattcaatcgagatgtcatgcacaactgacctctttaatagagtattttactcttttgacagcatctaaaaccgacctttccctcagggtctagctcagtttctcctcctgcccaaaacctttcctgacaatttaagttcttactgacatctttcctctgggacacctaaagccctgtgatctgtgaagctgttatggcatttgggtatgtcatcatatgccatcatttattccctaacttttcaagtcaaaggccatatgcgctgccttttcagctccccctgcagtgcctagcatagtgcccagtacatatggaagctccatggtagaagtggattgaattggcttatagcctttttcatcattacctgaattatcatatctaggactagggtctgcattatttctttttatttttccagtcattatctgttccttagtgacccaggagcatccacagtgagttgcaagt

SEQ ID NO: 127224 - DNA, 224 bp, Homo sapiens
ctcctggtctccagctgcaggatactcatattagaaaaacgccagctcctcccgggttctacagctgcatgaccctcaaactaaaaaacacccgctgctccccaggtctccagctgcatgaacctcaaactagaacaacatcagctcctccccgggtcttcagttgcctgaccctcaaactagaacaacatcagctcctctccaagtccccagatcacggccct

SEQ ID NO: 127225 - DNA, 576 bp, Homo sapiens
gcactaataacttcttgagggtgattctagctgagtgtttcctgcttgtttcttataaatgtatttggtacaggatcagtgtagttatatttccctgaagctatttcttacacacgatggcttcagcaggtttgaggccaaaatgccataggaatgcacatgccttcctcagattttgcctctccattttgaatgtatgcaagtcttgaaaatcctcgttattgggacccttctgacccctgaccacagccttgtggtctgacagacgctgtagcctcatggaacagggcattttctccacctgtggacttgttttctgtattcctaaagggaagaaaataaagaatcctcaagatctcttccttgttcaaaaatatgggccaaataatagtacaacattccctccccagcctcctgggtctttaatagttgccctcacctccctcatctaaattagtcattaaagactagagcattatctccaagaagcctatatgaaaggcacagcatttaactggcatgaaggccattttatctctctcctaggtattgattagtttctcagattagatcacg

SEQ ID NO: 127226 - DNA, 601 bp, Homo sapiens
gaaaacatcttacatagatgtcatttatgaacacaaaaaaattgacatcaatacattactgttaatgagacaacatatggtatacagatttcaccatttttcaacctggacttccttgtgcgtgcatgtgtacatatagttctgtgtaattttatcccatgtgtagttttgtggaaacaataccacaatcaagatacagaattgttccatcaccatgaaaacactccttagtgctgcctctttgtagttacaatgccccgtgacccccaaccactagttttgtcattttgagaatgttgcgtgaagtcatgtagtatgtaatctttggagattgatgttttaaaaatgtaatttgttttaattcataaagtgaaatctcagaaagtttacaaaaatagaaaaaaattcttaattctatcactaatacagtcaattttggagctttttatagcctttttcatatacatcttctatcacttatagtatatactcaattttgtttgctactttttacaaactttatattaagtattttccgtgtcaccatccatcatatttagttgttgctatcataagaaatgttgcaaaatataaaaaaaaa

SEQ ID NO: 127227 - DNA, 497 bp, Homo sapiens
tggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctg

SEQ ID NO: 127228 - DNA, 653 bp, Homo sapiens
gctcttcgtctgtattgtcctgaaggggttggttaaagcaataaaataggaaatgagaataagaagaaaaaaataaagtagcagaagggaaagagacagtttttatttgtaaatggcagtttttctgttaatcttcttgagttttgtgtcagaactaacaagagttcagtaagatggctggagagaaaatacagtatacaagcaagcagtaaacagtttgaaagtctaatagaaaaactatcctatttagatagtatcaaaagtgctaaaatactgaggaataaacaagaaatgttcaaggtccctataatgaaggaaactagttttaaccaaaggacaagaatgacttgaatatgaataaatggagagaaatactgtgttgtggatgagaaggtgtgattgatgtattcatatctgttttctaattattgtatccccattttctagcaaagagtgggtgctcaacagctacttgtgctagacactattttgggtgcttggtgtgtaccgtagtcaacattatatttaattaccatagcttaatttggggagaattgatatctttacagtagtggatctctgttgaaaacaaaatcccttccctctgggagcttatgttctagtcacacacagaccactcaggggctcttaaa

SEQ ID NO: 127229 - DNA, 413 bp, Homo sapiens
tggtgaggaccacccccaaattgtatttatacacctaagttggaaacttcattgagtgatctgcaaaaccagtatgccatttttaaaatgaaaacgctaaacttcagaaagacatgccgaaggaaaacttcacaggaggcatttacctatcgccatctgcacaaagcctttgcaatgtcatggaaattctttgatatgattccccagtcaggcagttgaaagatcatccatcaaacaggtggatgtcttgattagggcttcagaaaaatatgaatatttcagctgtaagcttccccatgactgtcaaatctgctactcataagacaatatccaatctcaaaattcctagaaagcttcaaaagccacggtcaacccacaagccacggtcaacccacaagccacggtcaacccac

SEQ ID NO: 127230 - DNA, 297 bp, Homo sapiens
ggagagcaccaagatacccagaaaaagaagcaactcagagtaaaaatcaaatggaatgctagagaaagcggtacccacccataaaaataatttccatcctcttccatttatagatgaaaaatgaaggcccagaggattaaatacagacagaatttatgttcctaatactgatgccaaggacaggaagaccttgactagtctcgggaggacgccctgcctgaagtaccaacccttctgcagtggtgagtgactggcacagggtaaaactctacagtaatgatttgcattgcgctatcc

SEQ ID NO: 127231 - DNA, 189 bp, Homo sapiens
agcaagctgttagtgaaaagtgacactggaagaggatttatacattttgtgagtcacatatcaacaacattgggcaatatgataataaccacagatgctattatccacagaatattcaaaatagcatcaacattatttcaaatatttggcaaaacaaagatataaaccaaaaccaaaatgaacagtaac

SEQ ID NO: 127232 - DNA, 450 bp, Homo sapiens
ggtctttctggtctccctctcgaagatttttttcctttcttcttcttatttttgtatatttaccttttaaaaataatcctctttataacaaaatacacgcttgttgcaaaaattgtttactatgaaaagaggccaaagccctgcttagaagcctagctgcaaaaatcaagtcaggcagcaatttaaggtaccactagaggtttatcagaaaacaagtccagtgatgctaggaggagccaagtaaaagaacactattcatagtatttcaaacgtgcacaatgattttttaatgctgtataactgtgtttagtggtgatatgcagaatttattgttgttatcttaaaccaagtgtctgcctacactcttttggcagtgaagaaaaaggaagactatgtggtaagaaactttcccaaagggcaggctgcagagcaagttcagataaatcactt

SEQ ID NO: 127233 - DNA, 303 bp, Homo sapiens
gggggctcagggaaggtgtttgggtcattccctcatgaatggcttggtgccctctccttggtgatgaatgagttcccactgttcacacgagaactcgttatttaaaggagcctggcaccttcttctcctctctctctctccccccacccccttgccctttctcttgccatgtgacacacctgctccccctccaccttcctccatgagaaaaagcttcctgaggcctcaccaggagctgagcggtgttggtgccatgcttgtacagcctgcagagctgcgacccaaataaacctgttttctttg

SEQ ID NO: 127234 - DNA, 499 bp, Homo sapiens
cctcatattatactttctcaaagctttatacttctcaacgcttatacttcctcaaagcttcatacttctcaacgctttatacttctcaacgctttatacttctcaacgctttatacttctcaacgctttatacttcctcaacgctttatacttcctcaaagcttcatacttctcaacgctttatacttctcaacgctttatactttctcaacgctttatacttcctcaacgctttatactttctcaacgctttatacttcccttattaccactcagctcttagaagttgtttgggctggagaaatgttttcattattaggacactttctgggtcctctctctagagaggcaactgagcctcaaccataccatctcccaggctcactccgtcctgcccaatctgtttacatctctactttggaggcaagctctatccagttctactaacctcagtgcgatgactcagggaaaacctagtttctttttcctaggaaaatca

SEQ ID NO: 127235 - DNA, 245 bp, Homo sapiens
atatttacagaaaagggaaaaaaacctaacctcttgccaaaccatgcccaaaagataacttaaatataagacttagcgagcacagctacacttgggataactcctagttcatggccatgaacacatgtatgcatgcatgtgcacaaacgcacacacacatatacaaggaagtagacagtgatttagggggcctcactggatgtgggaagactgcccgcagaagtgctggttggtaatatttatgc

SEQ ID NO: 127236 - DNA, 395 bp, Homo sapiens
gtagctgggattacaggcatgcgccaccatgcccagctaatttttgtatttttggtagagatggggtttcaccatgttggccaggctggtcttgaactcctgacctcaggtgatctgcccacctcagcctcccacagtgctgggattacaggcgtgagctaccacgcccggcctgtgttgaactttttatacaggaggccccctccttcatcttcaacagctggatgatataccttaatttctttaactactgctaatttctttatcttgtatcgataaagttaaggttgtttccaatctctttctttttgctataaagtaaccttatggagcctaactcccccctttcagttatacaatacacgaccatatacatgtgtcgtttcactcatatg

SEQ ID NO: 127237 - DNA, 319 bp, Homo sapiens
caccagatggtgagcccagaggaagaccccgtggctctgggccagtgtgcgtcagccaggtccccagcccccagtgtgctgaagctcaggcccttcccaacgccctggtctcctgcactgaggtgtggtgagcacaaccaggtcccactggatgcatgcacagggagggatgtgccctaggttgggtcgatgatgagaaccttatattgtcctgaagagaggtgatgacttaaaaatcatgctcaataggattatgctgaggcccagtctaggttaaaattctggaagaggatgctgggatcccaagttcacaggcagg

SEQ ID NO: 127238 - DNA, 829 bp, Homo sapiens
gatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagaga

SEQ ID NO: 127239 - DNA, 83 bp, Homo sapiens
tatagggagaaataggagccattttgatatgttagcctggtgcctggcacagggtaaacttccaatcaaggggaactgttcct

SEQ ID NO: 127240 - DNA, 190 bp, Homo sapiens
gctctcagccttagctgtggaagagtcagaacctgaaggctcacacgctgtctttgccctggtcacctctgactgggttagtgacagccttggcagcaagcagtaaccccgaagggacatactggctggcatagactcggaggtgtggcctcacccagaccacggcctgcccagtcccccatagcctgtg

SEQ ID NO: 127241 - DNA, 648 bp, Homo sapiens
tactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaa

SEQ ID NO: 127242 - DNA, 713 bp, Homo sapiens
aaaaaatccctcatgcccaagccaatcagcatacagcattcctctggtcacatgattgggcactggatgtcacatgacctcagtctagctgggaatgctgggatgcactctgtcttcctctgggtttggcactgcaaagaaatgaggtttgggaccactacaaccaccggtggacaaccaggggctactggctcactgccaggagccgttaagatgcaactgacccaggctaggcatggtggctcacgcctgtaatcccaaacattttatcttattttttttggagacagagtcttcttgctctgtcacccagtctgcagtgtagtgagtgagtcacagcccactataacctggagctcctgagctcaagcaattctctcctcagcctcccaagtagatgggactacaggcatagaccaccacacctagctaattttgaaattttttttttgcagagatggggtctggctgtgttgcccaggctcaaactcctggcctcaagcaatcctcccacctcagcttcctgagtcactggaattacaggcatgagccaccatgcttggcccccaaacatcattttcaatggctcttcatccaccaattctatggatgcaccgtcttccatgtgtccattctccaatggatggacatcttagtggtttgcatattttgctactgatgaaaatcttatgcatagagctttgttccctgcc

SEQ ID NO: 127243 - DNA, 510 bp, Homo sapiens
ttgatattatcctaggcctcccaaagtgctaggattacaggcgtgagccaccatacccggcctgttacttcaatgttgtaagggaatatatagatggaagttgagaattctttattttttgtaaaaaagtcaaacacctgattacttgcctgattcttcttagtgaagtgagacagagactcatgcatgtaagcagtatacttttctacttgtgcttttgctctgcagtaatctgaaatgagacatcgcccatcttagaattgtggtttatttgcaggggaggcatgcattttcctactgccctatacacacaagcctattttattactttgtttgaagactgggtgtgtctaatgtagtggaaattcatcgattcagtgttaagtacaggtgaaacacatttcaggaccacattagacagtctttttaattatccttttttttggattattcatgtgactgctttcctcttttcacgtgaattgctgagaatttatcatcctttccagt

SEQ ID NO: 127244 - DNA, 837 bp, Homo sapiens
atttttagtagagacgggtttcaccgtgttagccaggatggtcttgatctcctaacctcgtgatccgcctgcctctgcctattcttccatttttaaataaacaaacgtgtgtgtattcatatctttgcttttttcacttcacaatagaatctgaacatctcttcatagtattgtttggaaatattgctcattcctcatttctttgcatagtatatattactctgatgtgtggacatgctacagtttatacaatcagtcccttatttgacaagtgtttgggttgtttctagtctttgccttcacaaatacaaaacaatgtacagctttgttagccttgttcatgtctctttgtattttgccagcatacctttgtgataaattcctagaaattgtattgttgggacaaaagctaaatgcttatacagttttgtgaaatattgccaaatccccctctgtagttgtgccagtttgtatttccagaaggtatacatgagatcatctgtgtttccacagcgttattacaaactatattgtcaaatttggggattttcacaaatctgataggaaataaatgatacagtcgaggagcggatcatatttatcttttttctgtatggctatctagttacccacaaaaaagctaaactttgctgcattgattgaaatgctgcctttatcatctactaaaatatttatatataagtgagtctatttctagattttctatgctgttctgctggtctttattcttgcaccaataccatactgctttattaggagagccctttaatatgtttcatggctatagctatgtctcatttctcttcttttccatca

SEQ ID NO: 127245 - DNA, 324 bp, Homo sapiens
tgcacccgtggtgaagattccaaaatgctgggattgcaggcgtgagccaccatgcctggcccatctctctttttaaatggtggcattccattggaaaaatacaccatgaaaatttactgaatcatcttcctattgagagaaattttactagttttcagtttctagttgagcacaggttgttttgttgttctgcagagttgcttctgcaggataaaattctctagcgtggcattactgggttacagggtagtcacatctcaatggttcttgttcaacatggccagattccctatggaacactgagctcactcacatgtctctagc

SEQ ID NO: 127246 - DNA, 744 bp, Homo sapiens
ctgacctcagatgatccacccgccttggcctcacaaagtgctgggattacaggtgtgagccactgcacccagcctaattttcttatatggtataaggtaagggtccaactttattatttggtatgtggatatccagttttttcaacacatatttcctactgaatgatcttggcactcttgtagaaaattatttagccatttatagccagagttgatttctggactctctctattctattgtattggtctaaatgtctgtctgtatgccgttataacactgttttgattactgtagctttgtactaagtaaattttgaaacaaggaagtgtgaaacctacacatttgtcttcttaaagtgtttttttcttagtacttggggtcctttaagattccacatgaattttaagataggtttttttatttctgcagtaaatgtcattgggattttgatggagattacattgaatctgtagattgttttggttactattgatatcttaacaatattttcttctaatccataaatgcagagtgcctttcagtttgtgtctgctttctttcagcaatgatttacagttttcatgcatgctttttgcctccttggttaagtttattactaagcattttattcttttgatgctattgtatatggaattttttatttctttttgaattgttcatgttagtgtatagaaatgtaattttgtgtgtgatttcgatctttgaaatcatgaattgttatt

SEQ ID NO: 127247 - DNA, 198 bp, Homo sapiens
gagctgcctataaggcatattgcaaggtcagaggtttttctttttttcaatctcaacagactgctccaattgtcctccaaagaagcagtaccagtgtatgttcccacctcaaaacaacaatgtatgaagatacccatttctgtttgttggtgccaaaatgtataatcaaatgtcttaatttcttccctgtttgatgag

SEQ ID NO: 127248 - DNA, 411 bp, Homo sapiens
attatcttctcaattaaatgtcagctctatggtggtaagaacttggtcagtttgattccctgctgtattcatagctcataaaaaagcatctggcaaaggatgagtgctcaataaacaatgtttgtttagctgggcacagtggttcacgcctgtaatcctagcactttgggaggccgagatgggtggatcacctgaggtcaggagttcaagacccagcctgggcagcatggtgaaaacctcatctctactaaaaatacaaaaattggctgggcatggtggtgcgtgcctgtaatcccagctactcaggaggctgaggcaatagaatcgcttgaacctgggaggcggaggttgcagtaaaccgagatcgcaccattgcactccagcctgggcaacagagtgaggctccgtctc

SEQ ID NO: 127249 - DNA, 397 bp, Homo sapiens
tggctggcggtgtgtgtttcaatgcttctgctgtatgactctgtgtgtgtgtctgggtgtgtctgtgtgtgtgtgtctctgtgtgtgtcacccattcgctcttctgtctctgtccctcggtctctgtgtgtttctttccctctctctgtgggtttgtgtgtatgtgcccgtgtgcgtgtgtgtctttggccgaatgtgccctgtgcgccacaaagcggcttctggcatggcggccggtctttggtgagcctctttctgcgcctctgcctgggtcatgagggccggttgtcaatcgttttcaccgccccggatccgctttgtgtgtgtgaagacctggcccacgtgaggagatgcgtcggtcccggagcaactgaaatctcatccccatcctgagcgg

SEQ ID NO: 127250 - DNA, 626 bp, Homo sapiens
cctacatcctgatcttctctgtcctttcatgcgtcaccccagacaaccatgcccggggcaagaagaacctgatcgacccaaggccctgagggatgcctagacgtgtcccatctgggatctagagactaaagcatcataaatcacatgcttggtaacaccaagacactcacttcgaggacgtgcttatactacttttttctggagcaagagataaaactgttatttcagcctgattccaggagcaaagaggaagggctcttgattccatccactcctcaccccagccagggcccactttctgctcttctgcagagtaccacagtcagtattacatctctgtgttgagccacatgtaaaggccatttttaaaacaacaaattgacaaaatatagtatcagtataagaattttgagaagattttgtcatttgaggacccaagaaaagttgcttttagaatttatttaatgcattagtgtctgagtccccacatgttcttagactaggaggactgctgccagaacgccttggtgtgatgatatgattgtaccaaggacagcctttcattttatctctactaatatttcatactctcttctgcagattgctcccagggattctgttaatgt

SEQ ID NO: 127251 - DNA, 586 bp, Homo sapiens
  misc_feature (136)..(136): n is a, c, g, or t
gcctataccacaaaggggatggtggcccagcgaagcccaaaatgtcattcacaaggttcagttccaggccggcccaccatgatgatcagaacccggccaatgacactgcggctgctccagtgcacccacccaaggnacctgcctggcgagctgctgggctaccggctgcagtactgcggggccgacgaggcgcggcccaacaccatagatttcggcaaggatgaccagcacttcacagtcccagccagggcccactttctgctcttctgcagagtaccacagtcagtattacatctctgtgttgagccacatgtaaaggccatttttaaaacaacaaattgacaaaatatagtatcagtataagaattttgagaagattttgtcatttgaggacccaagaaaagttgcttttagaatttatttaatgcattagtgtctgagtccccacatgttcttagactaggaggactgctgccagaacgccttggtgtgatgatatgattgtaccaaggacagcctttcattttatctctactaatatttcatactctcttctgcagattgctcccagggattctgttaatgt

SEQ ID NO: 127252 - DNA, 427 bp, Homo sapiens
tccctactggaagaagctttgcagagtgtcctttcccttctttggttttcctcctacctctctgtcacctcttcctctgcctcctttgctggcccttcttcctcagccagaattctaaattctaaacactaggagtgccttactgttctcttctctattcctctctccctggtgatctcaaccaggcccatgagtttaaatactgtctcccatgctatccaatagggtggctgttagccactcataactattcaaattaaaattaaataaaatttatcctgaatcaaggaccagaggaaaaaaatgttaaatagaatttaaaacttagttttctgggtgcactaaccacttgtcaagtactcaacagccacatgtggcttgtggctttcaaatcggacagagcagctatagaacagcttcatctttg

SEQ ID NO: 127253 - DNA, 823 bp, Homo sapiens
agatctgaaggatgagtaggagttgctaggcaaggtagactacaaattcaagagctgaccagcatggtggctcatgcctgtaatcccagcactttgggaggccaaagcgggagatggctggagcccagtagttcaataccagcctgggctatgtaaggatattccatctctataaaaaataaaaagttagccagctgtaggggcacatacgtgtcgtcccagctacttgggaggctgaggtgggaggatcactttggcccacgcagttgaggctccaataagccattgtgccactgtactccaggctgggggacagagtgagaccctgtctccccacccccaaaaaaaacaaaaccatggcatgtatggagtgtgtgcacaaaatgaaaaaatgagagggaagtgtaagatgaggctggaaaggtaagtagaggctacaccataactgaattcaagaactattagttgatgaaattggaaggacatactcaagggagtagaaatgatgtataaaggaaagagatacattatacatgattctcagatgtttagcttctgcaactggtgtaagaaataaatgaaggctgagcacggtggctcacgcctataatcccagcactttggaagggcaaggcgggtggattacctgaggtcaggagtttgagaccagactggccaatgtggtgaaaccccgtctctactaaaaatacaaaaattagccaggcatgatggcaggcacctgtaatcccagctactcaggaggctgaggtaggagaatcgcttgaacccgggaggcagaagttgcagtgagctgggatcacat

SEQ ID NO: 127254 - DNA, 214 bp, Homo sapiens
ttgtaggtgcgaggcagaatagacagttgagtggatattggccatgatggtgacatagtcggcgcactgaggaattcagggtagggctgggagctggagacggtaataacctgggggtctgtgcatacaggctggagtccaagagatggttcagagacagttcctctagtcagcctcaggctaggtgctgtggctcttcgctgtaatcccagca

SEQ ID NO: 127255 - DNA, 683 bp, Homo sapiens
agggcactgtatttctgattagataagtttaaaaaaattaagtttaaatttaattttctatgtttttagagatgggattttgccgtgtcacccatgctggagtgcaggggctaatcacgggtgtgatcataggtgcattacagccttgaattcctggcctcaagtaatcctcccacctcagcctcctgagtagctgggaccacaggcaccgctgttacctggcttgattagacaatttttgctgcagaaatagctggctgttttttcaatcttacaatttaatcatgccaccctcccccactccccaaaagcatatacttttgactaataatccttggttgtaccttttcaacctccaagctaaccccagttgtgaatcaggtgaaaataatcaaggaatttatcattgctgaaatgttgtgctatctgtgtattaaacaccagatgctatattgtcacagatcttgctatattgcttttcatggtatcattgtgaagtttttagatggcatatatctcttgttgatcacatagtgggtgaatttacaaaacttttagcaaatctatggtatagctctgtattgaacttttgtggatctgttctttcttcccttgtctactatacttatatcacaggcccataaatgctataaattttgggcttctatctacaatctataggg

SEQ ID NO: 127256 - DNA, 245 bp, Homo sapiens
attgagacgcccataagagtctggaagttgcttccttttgggtttgaagtcgcttggaggctggtcccgtccccggtctttctgctatagggcaatgtatacacttcctatcgcatagttttcctgctcaaaaccttgttgactcatcctgccccttgctttttaaagtcctcacccgtgcgctggattcccgccctgggcgcctcccagcccccgtcggcctcccctggagcgcagcgccgggg

SEQ ID NO: 127257 - DNA, 1994 bp, Homo sapiens
gcactgggtgctggtgtcatccagggaccccacacacttccttaaatgtgatcctgcttccctctgcgcagctgcatcctctcctcctgcaggactgtctggaaacttggctctcagtttgctctcccttctctcctctgcctgtcccaagcccctctttctaaaaaagtgatggaatattcatggggttatttcttgaaaatacttggcggcctccatgcttctgttttctttgagccaggtggtcaggagggtttacaaagaatgcctgggctcccccgcaggtgccggcagatggggtagcgaacggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccaggattacattccagcatcttattagaggaccgaagcagagggtgctgtttcaacgccaccaccaggagagaggcagaggggctgtgccgtgctagagtcctcagggagggagtgacctcgaccctggctgtgctgcaagctgactccagccttggtgtcagcagcacccggcgaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacacagagaccccctcgacatcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggacccctctggggatgggcaaggccttccaggataggctcagttttggtcccctgctttttgaggttgggttaaaattccgaccatggcagaggaagcacagctcaggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaaatacagcttcagcgtgcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccatggagcactctgagatctcatcgtggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgc

SEQ ID NO: 127258 - DNA, 1475 bp, Homo sapiens
gcactgggtgctggtgtcatccagggaccccacacacttccttaaatgtgatcctgcttccctctgcgcagctgcatcctctcctcctgcaggactgtctggaaacttggctctcagtttgctctcccttctctcctctgcctgtcccaagcccctctttctaaaaaagtgatggaatattcatggggttatttcttgaaaatacttggcggcctccatgcttctgttttctttgagccaggtggtcaggagggtttacaaagaatgcctgggctcccccgcaggtgccggcagatggggtagcgaacggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccaggattacattccagcatcttattagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcagaggggggctcacagctgctggtgggaggtctttggggcccaagctcccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatatgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctgggcaccccctatcactcccatccatgcaaacctaggcaagtccctgtctctgaatctcagccaccaccacatacaatgcaagtcggaagatgggcaggactgggggtggggcaggcagaggccacctctgtcaggctggggttgcatgggctggagcctgtcttcccatacctgggacatgacctccaaggaccagctgtcagtcatggtgatgggctggctggggttggcagggagcttgctctccttctcggagggccggagcagcgtggg

SEQ ID NO: 127259 - DNA, 1150 bp, Homo sapiens
tgcgcagggctgaatggtcgctgagacagagatggaagccaggacaagggagcccaccgggcccagatagagacttcagaacccactcctgagaacagcggagccaggcgcttagaggaagaccaaatgctgccaggacacggattgtccaggattacattccagcatcttattagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcagaggggggctcacagctgctggtgggaggtctttggggcccaagctcccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatatgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctgggcaccccctatcactcccatccatgcaaacctaggcaagtccctgtctctgaatctcagccaccaccacatacaatgcaagtcggaagatgggcaggactgggggtggggcaggcagaggccacctctgtcaggctggggttgcatgggctggagcctgtcttcccatacctgggacatgacctccaaggaccagctgtcagtcatggtgatgggctggctggggttggcagggagcttgctctccttctcggagggccggagcagcgtggg

SEQ ID NO: 127260 - DNA, 450 bp, Homo sapiens
ctaaaaaagtgatggaatattcatggggttatttcttgaaaatacttggcggcctccatgcttctgttttctttgagccaggtggtcaggagggtttacaaagaatgcctgggctcccccgcaggtgccggcagatggggtagcgaacggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccaggattacattccagcatcttattaggtatctggatctgttggggaaaaaattagaaactatgtataaaacttacaaatattcaagtatcaaaaggttatttaggatgaaagttttaaaacaagtcatcagcaag

SEQ ID NO: 127261 - DNA, 1244 bp, Homo sapiens
gaggaataaacactaaatccgaaacatgacggaaattatgtattttattgcagtgacagaaagagtaaggcccttgctcaggtttacccatgaaaattatgtttggctgcacgtagagaaaagctgaccacagtggcttgagcagacgggcaggagttccagagtgagcagtccaggctgatacggtggggtgcaggacactcctatgttttggtcccaccatgctgaggccagggagagatggcctgcacctctgatctgtccaggcagaaaggacatgggaggcctcaaccccttcttgtgggtcctggtatttttattcaggaagggaagcccttctctgcaaactttcgctgacatattgcttaggccacaactaggtcacaggcctctggctggagggaactgaggacaatggagttgtcactttccagcctggagagtggagggaagcagagaggaaggtagctgggagcagatgtctcgtgaacccagagccacatctgccagacctggtgacaaagacaggctgtgtgccttcccagtcatatcttgtatcatttgttttctgtgccagctgggctttggaaacaaatgcagagaaactttatgttcttccttcattccctcttggaagttgcagatggatgccaagggtgaatatttattgttgacccattgaaagcaaactggacaggagaagggatgaggtgggggaaggggctaggttaaatggatccaagttcacacctattttcagtgtcaaagccccaaatcacacttgagcgtctcctcaagttagaatgagcaatagaaaaccagacagccctgtatctatgggaatgttgcttgcatcagagccaccacaccttgctgtgaggttgatcggtttctcgcagctggaaatagttgcttcccgccccccatcttcctcactcttttaaactctcaaaaatcccccagcctcccaaatttgttttaatttttaagagaattcttttctacaaaagagggaaaccttctttcaaatggcccttcataaatttccctaaagaggtttttatctctgatagaaatatgaaaaacagataaccagataattgccctctatctaggctttaaacacttattcatacattgaatttctgcaagttacagatgattgttgctgtgtgattactggccctgtctatttcctcagcatggatgcaaatctttctccctgagaaagtcattgcttcgtt

SEQ ID NO: 127262 - DNA, 739 bp, Homo sapiens
gaggaataaacactaaatccgaaacatgacggaaattatgtattttattgcagtgacagaaagagtaaggcccttgctcaggtttacccatgaaaattatgtttggctgcacgtagagaaaagctgaccacagtggcttgagcagacgggcaggagttccagagtgagcagtccaggctgatacggtggggtgcaggacactcctatgttttggtcccaccatgctgaggccagggagagatggcctgcacctctgatctgtccaggcagaaaggacatgggaggcctcaaccccttcttgtgggtcctggtatttttattcaggaagggaagcccttctctgcaaactttcgctgacatattgcttaggccacaactaggtcacaggcctctggctggagggaactgaggacaatggagttgtcactttccagcctggagagtggagggaagcagagaggaaggtagctgggagcagatgtctcgtgaacccagagccacatctgccagacctggtgacaaagacaggctgtgtgccttcccagtcatatcttgtatcatttgttttctgtgccagctgggctttggaaacaaatgcagagaaactttatgttcttccttcattccctcttggttcggtatcccaggctggataatttattggtgaccaattgtatggtacttgtcaggatcggcccagtctctctcctctgccccttactcttactcttccctcccg

SEQ ID NO: 127263 - DNA, 2443 bp, Homo sapiens
ggggagccgaggcgagcgcgagcgaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcacgctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgcttgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccac

SEQ ID NO: 127264 - DNA, 876 bp, Homo sapiens
  misc_feature (863)..(864): n is a, c, g, or t
ctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccactgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctcggccgaattaacaccaggcctcgtacctagcctaagttgtnnttcctgcgcgtc

SEQ ID NO: 127265 - DNA, 755 bp, Homo sapiens
tattactagtgaattcactagtaatgccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccac

SEQ ID NO: 127266 - DNA, 2133 bp, Homo sapiens
tggcgagggtgaatggcggagtcgttgaatgccggaggcgttgaatggcccccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcacgctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgcttgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccac

SEQ ID NO: 127267 - DNA, 363 bp, Homo sapiens
tggcgagggtgaatggcggagtcgttgaatgccggaggcgttgaatggcccccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagcgctctgcagcaccacaacctcctggtctgttctgtgagtggtttctatccaggcagcatggaagtcaggcgtcccgggatatgca

SEQ ID NO: 127268 - DNA, 1215 bp, Homo sapiens
ctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccactgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccggccagccgccctctctgctgtttcttctatttgttcttcttttcacccacagctctgtgttcctgtcatccctcctttcagcaaaagtcctgttcccgttccctctgtccccacccactcctgttcccccaagaaaa

SEQ ID NO: 127269 - DNA, 523 bp, Homo sapiens
tggcgagggtgaatggcggagtcgttgaatgccggaggcgttgaatggcccccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcccgcaaggggttttccaagtaagaaaattactgtgcagacagcccgggccaggctggaagacgtcgctggggtatctt

SEQ ID NO: 127270 - DNA, 850 bp, Homo sapiens
ggtcacttcactatactaactgggagtcaaaggtcagatgggccttgaaaggagtgaaatggaggtagcaggatggagcaaatcgaggcagccagacacactatcactccttgagcatttattttgtgctggacactgtgcaaaggactttatgctagtacattaaatcttcataacagccccatggggctagtgctagtattcctacattattgtcgtggaaacggaggctcaaggaggttaaatgacttgtctaaggtgacccagctaggaagtgacacagccaagacttgaactcaggtgggcctgagctcctaagtgctaggcctcaactaccctagagaagcttctgcttgctctccccaggccctggagaggcccacgggcagaagaagagcttgcctcatcacccttttagaccagcctgtccccacccttcgaaggggagtcagctagaggctacagctctctgggctgctgacatcccaggctggggtgggcgtgtaaggtctccagctgtgaagaatcagctctttgcaccctagaccttggttgctggattcagggcaccacttggcatcttctagaagtacatggggcaggacaataggtgtcagcagccctgcctggaggaggagctttgggccctgtggccctcctcagcactgcctttcttgccccttgggccctggcctgttctacattcccttgatgccccgccttacctgcccctcccaaactactgtgatccttggggtccttgcacagctacctacctccagcctgtaatcatcctatatgccaaactgggcctgatatctgagacacaccacccctgagctgcctcccc

SEQ ID NO: 127271 - DNA, 735 bp, Homo sapiens
ggagttatgaagattgggtcgaggaagaagaaaatggagacgggttatgaactgttgaagaatttttgttatgaagagaaagggtcatagtatggtactagctagtatgtgattcagagtaccttcattccctctctctgctgtcctccttcaacctctccctttcatctctttctttttctcttttctttcttactcgctcccactcttcctgttttctacctactttccctcctttctccctaacatgatacacttgaacatttaatgttacaggatgagaatttaacttgggacagcatgacatcttatcttatgcctataaatatgagtaacataaataaatattaaaataggtgttagatcagaatgaaactgttaatagtttcttgaatacaggatcacagccacatatatacctttaaacatacttgctcaataaattttaatgataatctttgaaataataaaatatcaacactttactaaatgctttacatgttttccacaatttcaaccttatcagcaaaatctctgcccattttatagatgagaaaactgaagcacagagaagttaagtaacttgtccattgttctatacctggtatggcagtgtggttctagagtctatgctcttaatcacaaggctgtattccttctcactccactgtactagttattttcatgcctttaaaaattcattagtaatatttttgttgtaaattatgatacaga

SEQ ID NO: 127272 - DNA, 481 bp, Homo sapiens
gaggggaatcacaagcaatacagtaaaaggagccagacacccatgaaatggcctcagggcatgtaggaacgcagatgaatccactgggaggacaagagaaatgaagggccaggattctcccccttatcttcagcagactcattccaagaccctcagcggatgcctggaactgcagatagtgccaaaccctaaatctattatgttctttttcttttttgagatggagtctcgctctgtcgcccaggctggagtgcagtgacgcgatcttggctcactgtactcccgtgatttaaagcaagaccctgtccaaacaacaaaaatgaaaacataaaaacaaaaaaataattcaaggctaggtgcggtgattcacacctataatctcagcactttgggaggcagtgagtcttgatgataagggtgagaaactgaaatcccaaacactgttttgttgcttgttccgctggggaccgagctcgatcgt

SEQ ID NO: 127273 - DNA, 596 bp, Homo sapiens
tgctctaggtaataaataagggttgtccttcactgattaagggaatacttaaacttcaataaatttaacaaagaaatcacactttagtttttaagttttgacagatgtattttattttatttttttttggagacagagtcttgctctatcacccaggctggagtgcagtggcgcaatctcagctcactgcaacctccgcctcctgggttcaagcgattctcctgcctcagcctcctgagtagctgggacagcaagcacgcactaccacgcccagctaattttttgtatttttagtagagacagggttttgctatgttgcccaggctggtcttgaactcttgagctcaggcaatccgcctgcctcagcctcccaaagtgctaggattaccggtgtgagccactgtgcctagccaaagttttaagagatgtattttaaatacatctttcataggagtctgcaagctttttatctctaaaaaatgacttaatttttagggctcaaaaattccattcttcaaaagaaatgtccaagtattttcttttatagcttcaaactttctgcacctaactacttgactgttccatgccaccccaaa

SEQ ID NO: 127274 - DNA, 313 bp, Homo sapiens
agtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggt

SEQ ID NO: 127275 - DNA, 421 bp, Homo sapiens
cctactttgggctctcttccagtttgcctacaaagtgctatttgttgcaagggtgaagcaggcaattctctgggcagcgacactgtggctgcaggcagttgctgtagttcaaagcaaacagccaagctagagtaggagggacactgacggggtttgttcattagaattttgaacattaatttttgaaggaaagaaaggggagtacaaatagaataggaatagaaatattgtgaaattttctttataacagaacaaaattgggtcaggagaaaggactttaagaaatcacttaacatttatcattactttgaaagcaaatgccttttttgagtaaaagcaaatgctttttgagcatttactttgtctgcagtgcactctagtggggtgggaaacgaaagttagcactaaatattaacaacgg

SEQ ID NO: 127276 - DNA, 694 bp, Homo sapiens
gccctccccggtgccccacatgcaggctgaagaactacggtcctatcatttattttttttaaccacttctccccgaccctcacttgtctacacaacttgtaggcctgccatcaatgtgatttgatcaatgttaccacgatcctgcgttccatcctttttaagttgttagggggtttcttttttgtatttgtttcattattcagccggcactggagttgcattggactggtagcacatcctggggaggaactatccatctggttttggttttgattggggggatttttagggggaagtgctcatttttcctgagatacctgggcctatatcttccccctgtgtctcctgtttagcctttcccactcctttttcagaagtgaaagagcagacagaaggtcccctacaaacagttaactacggtattttctcgattccaggatgacattaattgtaaggtgccacagccattaaatagcaccttttcccaggtcccaggggcaattcaaggacagtctcgtcatccacccagcactggcgagcagaaagagatgggtatagtgtggcagtgcagggcatgggcctgggaatgtaccaagagcagcttctagtgccgtatgactaggtcataattaattcacacatgcccttcttgtcttgtgggaatcaggtgcttcactttccctttggcttagag

SEQ ID NO: 127277 - DNA, 762 bp, Homo sapiens
ctcagcctcctgagtagctgggactataggcatgtgccaccattcccagctaatttttgcatttttagtagaggcggggtttcaccacgttggccaggatggtctcaatctcttgacctcgtggtccgcccaccccagcctcccaaagtgctgggattacaggcgtgagctaccgcgcccggccttcttcttcttcttttttttttgatcaacgtgctttattggccctttagatgtttttctcttttctatcaaagtttttggagtattacaaattttatttcttttttctttttcttttttaaattttaaccaaccattttcacccccccttccctacttaccctttccaccttctggtaattaccaatgaactctctacctccatgagacccacttttttagctccacatataaatgagaacatgtggtatttgtctttctgtgcctagattatttcacctaacataatgacttccagttacatttatgttgctgcacatgacaggtcttcatccttttttatggctgaataattttccattctgtatatgtactatctgtgagtggaaaacaaaaccaacaaaaaactcaaagggtttttcctgttttctcactcaacaacaaacaacgcagaaaacttcagtgaacaaatgtgtggggttttttttctccacacaccaagcaagcaggcaattctgccagataccagctgggtgtcctctaattcagttctgaagatgtccacctgaagatagcatc

SEQ ID NO: 127278 - DNA, 234 bp, Homo sapiens
cttggaagatgaagcaaatgttaacgtacactgaaaacatgtctccattcattgcgtaccaaccgtattttcttagtggcagactagtgtctcccctgggcctacactgaaatgatccatgtgaaagtcaaacatgaaagcattcttaggtttcaacatggggagtacattacaaagccagcagatgtgcagaaataaaattctaataattatgtttttgcagttggaatagct

SEQ ID NO: 127279 - DNA, 330 bp, Homo sapiens
ccaatactgcagactccagcttaaacacatggacacatgcacacacacaattctccaacctcttgaataattcccttgtaagcttccccaactggcactaatgtgccatgttttttaagtgtttgtagatcacagaatttcctagtatctctttatgaactttatgtttagagcatctattttaagtgttctgagttctatccggtgactttaaaaagtaggctttctttgtatctccatccccgaaccctcctctaatcttcagttgcatgacacgcttccaggatacccaataatcaactttgacacattttctttcccatcagatat

SEQ ID NO: 127280 - DNA, 250 bp, Homo sapiens
aaacaatgagatatgccatgttgtgtaggaaagtgttggcatagccaggcatggctacttatccttagaaaggctgcttactaaggcccttggctggagtctaagaactcaaatttcaggagggttcccacaatttccagactgataaaaagtggctcaatgtgcctaaactgttcatacaaacaatttggtttatcataaacacctgtttccttctgggagtcttaaaattttagtacatgccaggcag

SEQ ID NO: 127281 - DNA, 737 bp, Homo sapiens
agtatgggttttaaaagtaatctgctgtatttattattgacataaacagttacctgcagtccatttgaacatcatcttagatttaactcatgtattaaagatattatgttttccactcagcaaggtcaccttcaaggtgaaaactgtatgtggttgaaaatgaaaaagatcaagtgtataaagataaatatttaaaaaataaatgatatataggatttcatttttgtacactcctgattaataatcatattctgtttattttttacacccaccttcttctcccaatctccaactccagaaaccactaatctgttttccatctgtataattttgttatttcaagaatgcaatgtaaatggaatcacatagtctgtaaccttttgagagtgactcttttttttttcactcagcataattcccttgaagtctgtttacttttatgtggattgtctgtctcatgcttgtttcaccagggtagttacaactagggtggcataatttgactgattcaagaactacttcaatataaatcaaaataagagagtctaaattctaagtaattttttaacaggacaagattatttataattatgagtccatggtaatgagtgaggaatatttatttttagacagtgttagagcaaatatggacaaaaacgcgcctagttcaactatgacatagttggcagcatgattaaaagaaccaccaaatttccctaatgccagtttgagtgttt

SEQ ID NO: 127282 - DNA, 531 bp, Homo sapiens
ctagattccagtaagatagggtgatatagtgaagtaaaattggtggtatactaaaatgaaataaggtggtatagtgaaataaaatttaaaaggagttgaagacctgtatccctgcttcacactggtacatcctgcctctgtgactttggacaagccatctaacatctctaggcctcactttccttatctgtaaaacgaagggttgagctggatgattcctaggcctttttcagcaccatcatcctgttggggggtttatgttttgttttgtatgtgtgtggttattatctgagcagtttggtttatgtggtgtggtatttctttagacaagagaggctgtcctggtcagtagatacacaagatagtctatgatgtcaattaaggtctgtgaggtcaaattaagtgatatgcaagattactttgatatgagcaagctgaaaccaatagaaactaaagaaaggcatgagaaacttgaagggcagggaagcccttgaccagataggatcattgagaatatagggaagtttcaag

SEQ ID NO: 127283 - DNA, 479 bp, Homo sapiens
aactgttacatttaagaatgtttaagatggtaaaatttcatgtgtatttatttcaccacaatttttaaaagttgattttaaatgttaactccttaaaagaaacgatggctcatcaaactaaccacttaagatgggtgcattttatggtggtataaaacctaagtaagaggtcaagttctcaacctaagtaagaggctcacagtggcctctcagggaagcacgctgctgttatccatcacttagcaacgcccactctaaggcaaagtccaaaccagtggaatccatgtggcttttgcacagcatcatgagtaaaatcctctcctcaagtataactgttatttaaagagaaaatgtgtcaagcatggttagggttatatcatgtttcctgatctgttctcagagttattttagaatcaaagtccctcgaggaaacatgaaagatcgcttaatttcatgttcatctttcagaaacaccattg

SEQ ID NO: 127284 - DNA, 402 bp, Homo sapiens
aactcactaaaagcaggaagactttaaccccaacatattctctaagaagaatctgctttttgaatagctgctttcagtttagttcaaacacaagacaatggcataaattcacaccttggaggttagttgacttttaaagcttattgtgctatattaactccttttgtgccaatttatcttgagcaagagggtttttctttaaactacacatatgagctagaatttactacagaagaaaaaagttttataatctgaattattaaactgaattttttttcctttcagttactttgaattgtgtcatctagttttgaaaatatggttatattccaatgagaacacatggacacaggaaggggaacatcacacactggggcctgttgcggggtgaggggagcaggg

SEQ ID NO: 127285 - DNA, 245 bp, Homo sapiens
gctcaagaatgtgcaggatacatccaaaaatggttacgatggtaaattttatgttatgaatattttaccacaattaaaaaaaaatttaatgctgttaggcacagaatcaggagaaccacaagagcttaatgactttgacagacacaccaatacatgcatagagaaagaatgaaaatattaaaccaaagaatgaatgagtgatgaaatatttaaataaggtgggtacatagcacatcagaacatat

SEQ ID NO: 127286 - DNA, 794 bp, Homo sapiens
gaatttaataagttattgcctaccccttagactccaacccagcttgattgtcatttatttatttatttgagatggagtctcgctgtgttgcccagactggagtgcagtggcacgatcttggctcactgcaacctccgcctcccgggttcaagtaattctttgcctcagcctcctgagtagctgggattacaggtgcccaccaccatatccggctaattttttgtatttttagtagagacagggtttcaccatcttggccaggctggtcttgaactcctgaccttgtgatccacccgcatcggccttccaaagtgctgggattacaggcgtgagccaccgtgccagagatcttcatgatctttctaggaaagctggaggctaaaaaccgaaataacaaaacccagcattttaacaaggccacttaaaatcattatctgatgcttgaatttcttctgtaatcctcaaacctgtttcaatctatatggcaaataaattggtttagaatgcatggctaaaatgaactataggacaaaagatatctcactggagaaaactgaaaactttaataattgttttttggtaggccaggtaaatattttttggtaggccaggtaaattgtttttggtaggccaggtaaatatttcttggatttgaagggtgtgtttcttagattattgctatctgatacagcagttattttaagaatatcatcaaaatgtcattcaacttgatgtgtgtgtgaaaatttaaaatgagaatttaaactggagatggtgagaccccaccccagatc

SEQ ID NO: 127287 - DNA, 450 bp, Homo sapiens
aaaactggtctcctgggaacactggaaagcagtgcgtgatccgaaggggcagaaatgactgacactctcaaattcccctctgcatcatgggcactcagcactgtgcctagtgcatagtaagacttcaacaaatatgtgctgttgttataattcggcatgacgatggaggtgcagaggtttacctgtgtttttattatctctggttgacaaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaaccgccccccccccccccgccaatcttactcttctgttatttcatgt

SEQ ID NO: 127288 - DNA, 269 bp, Homo sapiens
tattgaaagtggcatggtgaaatctctgtgaatattggatttttctagttctccctttatgtctgtccatttttgtttcttgtattttgttgccttgttactatgtacatgtaagtctttaattgttatatcttcctgatgggctgttgcatttattttgatgaaattctctttagcaacattaaaaaaaattttttaaactctcttttgtttacatagtcactttagctttgttgtgtttgctgtttgcatatctctgtttccttcct

SEQ ID NO: 127289 - DNA, 609 bp, Homo sapiens
gatttcttggacaggaagaaaacctggaagaatggcagtattaccccaggtgacagagctctgtaaatctcagagttcaggagctgtggttgagctctcttaacacctgcttcctttggccaagaaagatgaaaacaacaacaaaaacccagcagccgccgtcctgagatgttctctgcagggctgtttgtggctgtaattttatgcttggccggacttctgggttacctgttacctagcttcaaggtgataattttctttgttttacctacaggttttgcttttgcagcatggctaaaacactatggaatacagatggaaattttactcttgatttggcattcatttaacaagctggtatagcaaaggattctgttactgaaaaaggcaaatcactcaggatgtatagagtaagaaagctgaatttcatgcatgtaaaattgttttcattcaatttctcaaattacatgaatccctggaaggtcaataataatgcaaaattagatttttttccttaattaaattatgtttttaataggttattacatgaccatggtaaaaaaattaaaagtacaaaatgtgtgcaataaaaaattatctccatttcac

SEQ ID NO: 127290 - DNA, 228 bp, Homo sapiens
actaaattacagtattaaaagaaacaagaggcacatttttgggccagtaacaattttaaaaatctagtctatttacccaacttgaggctgttatttttagagatgagacactagacactgaaagtttttttttaaactttagatttttattttcattttaaagatgtttttcccttttgcatttttaactaagttttgaggtcagaaagcgagtattgcacatgcaca

SEQ ID NO: 127291 - DNA, 511 bp, Homo sapiens
gctggcagcagggtctgggatggatgtactgcctttctcagagctaggctgggaaaaacatttccttgtcatttattttttaaatgtcaggagattttaaaacttctaggagagcagataagtgataagaagaaaatctgggtcgtttttgtgcatacaaaggggccattctaatagtggtttcaaggggtcttttctagacaaaaggggaggagattgttttagtagccctctcttcctttcctggggagtttgaaactatctagttttgaaatctaaaaatccccaagctcttggatctggtcctttttacccccttagccatatattccagtttctgctaaaaaaagtctgcctcaagatataagtgacatccaactgttggggctgttttctcttttcatagaaaccagagcttctggggttctgagatgtctctagcggtcactgacctaaccattagcaactgggttctacaaataatgtccctggggaactcaataaaattatc

SEQ ID NO: 127292 - DNA, 274 bp, Homo sapiens
gcagcagcaggtaatcactgccacccttagggacccagagagatgatgggaagaagtggtgttcccagagcccaactgtgggtctgtctggcaggagtgaaaactgcagagaaggcatgggtctggagctgggactgtagagccaggggctgattgaccaggggtgaaaccttagggaagatacagaaagggagagaaataccaaggctttccccctccttctacccttcagacctctgccattgccttttattggtgggacctatccacaaag

SEQ ID NO: 127293 - DNA, 204 bp, Homo sapiens
ccccagatcatacttccatgagcgcacctcttaaataggcttattatcctatttgtaaataagcttactgcgagctcaggcaattcacctgaattatatggctctcagtttcatcatcatttttaaaaggtagataagcacatctttccggccaggtgccatggctcatgcctgtaatcccagcactttgggagcttgaggcgg

SEQ ID NO: 127294 - DNA, 735 bp, Homo sapiens
ctcctgtctcagtcccccaagtggctgggactgaaggcatgagccaccacaccaggataatttttgtattttttgtagagacagggtttcaccctgttggccatggtggtctcaaactcctgggctcaagcaatctaccctcctcagcctcccaaagtactgggattacaggcatgagccactgtgcctggccatttttcacttttattaaaaatggtgggggaacccttcaagtctcaagccccacctcagacctcctgacttcagcatctctggggatggcacccccggtgccaggcagccagatttggttctctgtctaaccaggctgaaagccaactggcatctgtaggggaccaaggactccatgaagctcacaggggtttcaaagaaactacgaattcactaaccaattgactatctccttgcccgcctctttccctttctcctctccttcctcaagtattttttgagtacctcccctatgtataatgtcaagcatgcatctgcagaccttcttttcccttcgggagctgggagtggatgatgcctattttgcacccttgagattcatggaaaatgtgcatctttataatccttgaccgtctcttcatacctttatgcctgagaatgcacccttggtgctgtgagccctttgtggagaatgtgacttcttctcccagacaagatctcattgtgaggccaggtctaggtttagaggttcataatgatggg

SEQ ID NO: 127295 - DNA, 736 bp, Homo sapiens
tgggaaaggaagaagaaaaacttatctctatacatggaatgatcttgcatagagaaaatatagggaatccacaacaaaacctattacaataaaaacaaagtcagcaaggttgcaggatgcaagatcaagatacagaattcaattgtatttctatacattagcaataaaaaatctgaatgaaattaaaaataacaattccattcacaatagcattaaagagaatacaatacctaggaataaatttgagaaaagaagtgcaagacttgtacactgaaaactaaaaaccatcatttaaaaaagtaaagacctaaataaatagaaagacatccatgtttatgggttggaaggtttaaaattgttaagatgatactactccacaaagttatctacagatttgatgcaatccctatcaaaatctctgttgattttttaatagaaattgacaagctgatcctaaaattcatatggaaatataagtgacccagaacggccataatagtcttgaaaaaaactcaaagttggagaactcacactttctgatttcaaaacctattaccaagcttcagtgtagtactggcataatgacagagatcaatggaatggaactgagaaaccagaaataggccatcacatttatgggtccactgatttttaacaaaggtgccaagacaattaaatggagaaagaatagttttttcaacaaatggggctgggacaatcagaaatccataagcaa

SEQ ID NO: 127296 - DNA, 638 bp, Homo sapiens
ccatcatcatatggggtcacagggagataataaagtcataagggtggtgccttcatgaatgggattagtgccctcataaaagagaacccagagctaaccccttataccatgtgaagacacaccaagacagtgccacctatgaaaccaaaatgcaggtccttaccagacatcaaatctgttggtatcttgatcttggacttcccagtctccagaactgtgagaaataaatttctgtcacgtataagctatctagttgatagtattttgttctagcagcctgaacagactaagacaagtccctgcccttggaaaatttccaaatgaaatgcaggaaagccatataaacaataagtatggaaaaatggagtcaacgagtggttgggagaaagagagcaacacagtcaatgttggtgcagaggatgaggatgtggggttgaggggagtggtggggcatcaaagaagtctttcaggagaaagttgagaaagttgcaaccaaattgttactgagggatggaattccaggtcacgtgatttgaaagtaagactttcataatcctgcatagattctgaacaattgggccactagaagattttggactatgtatttattttcaaacatcttttttccctgtcagtac

SEQ ID NO: 127297 - DNA, 180 bp, Homo sapiens
aagaggagcccgaacggagctgagcagagaaaggatctgcagcctctccctggtgattggcttgggcagtcccaggaaggcaccagcactggtctagagcctaaacctacacatctggaaacatcacagagggcttccttctctgtgctccatgaatgagggcataccctcttcttttat

SEQ ID NO: 127298 - DNA, 402 bp, Homo sapiens
tgatgtcctggaacatggacaatagctattctggcagctgcaggttatctaattcttggatgattaattcttcgtggcccaggtcttggcctttgctattaataagacctcgttcagtccaaatttttccaaaggtgtgagctaccccaaaggcgtacttggaattagtataaatagtcccttcttggttttgcaagtgctttaaggcttgatttaatgcaaacaattcacatgtttgggcagaccaattatttggcagtcttctggactctgcttcttcaagtgcctccccatctacgactgagtacctattatgcctttttccttcaattacttgggaagagccatctataagtcctgccccgttttgtaaagggtctctcttaaatcaggcctaacttt

SEQ ID NO: 127299 - DNA, 266 bp, Homo sapiens
tactgttccctctactgcaaacacttttccatgcgcttgcctgtcaggaacactcatactcatcctctaagtctcggctccaatatccttgcatcaggaagccctcctcatcctcttccccactccaccacaccgctagacattgatttctgttatttcactgcaatttgcataaatcacagtcacagtctttattacactgaattgcaatgatcttttatttattttgtcttctacactgagagtttcttgaggccagggactaa

SEQ ID NO: 127300 - DNA, 290 bp, Homo sapiens
ctcagccccccaccagcccaagctatggaaaagaaactgcccccttgtatgaagagcaaggtgttggcggggaagtgcactctgtatatctgtctgtctgtctgcaactgtggctatcagaataatgtctcagcccttttcctgtcagatctcggctgaagcaaataaggacaatgaacagcagcaaagaggtcatcctgggcatctctttcactaatggaagtcaccaacagatctaaatctaatcgatcctaataatagagctacatgtattgagccttgggtcaata

SEQ ID NO: 127301 - DNA, 440 bp, Homo sapiens
acactaacttttttccacttaagtaaggggccccaccacttgtgatcaggaagctgtaaagagctaattcaatctggcattagcctctttctcatttcccatcctgtaatggcaaacatcatgtattaactaaaagttgcactttgaagtataaagcctaatgggaattctgaactttagcttggtgatctttaatatacttatcttagtctattttgagctgctataacagaatagctgagactgggtaatttataaagaacacagatttatttcttagttctggcggttgagggccctgcatttgggcaagggtcttcatgctgcatcatcccatggcagaaggcaggaagtcaagagagagctaaactcacttttataacaaaagtggattttttttgtttgtttttttttgtttttttccaagatggagtctcgct

SEQ ID NO: 127302 - DNA, 761 bp, Homo sapiens
ggctctgtggccccggctggagtgcagtggcacgatctcggctcactacaacctccacctcctgggctcaagcgattctcctgcctcagcctcctgggtagctaggattacaggtgcatgccaccacacccagctaaattttttttgtatttttagtagaggcagggtttcaccatgttagccaggccggtgttgaactcctgacctcaggtgatctgcccacctcggcctcccaaagtgctgggattataggcgtgagcttccgcgcctggccagctgactccatttctatagcaatgagacacattaggcagcagcagcagcagcagcagcagcgaccaccaggtccatgcctcttttccgtggtcacagctccatgtgtccggggaagattgctaatgcttagtttcctgcacaaagcaaaccaaagcatttttgagaattttctacattattcctaaacattagcaatagaaacttttaagagcaaatgccagtcttaattcagcagctctcccacttgaggaatagttagatatgtgagtagcctggagcccatgttatagggctgctggttaggtgctctctggtgcatcattactgctcaaagcatgacccacttgctctttcagatccactcagggtattttatgtccatttccaggaaccatccaactccttccctattcagtccaaacttccttttttttttttttttacttgaagttcaggggtacatgtgcaggttgttacataggtaa

SEQ ID NO: 127303 - DNA, 655 bp, Homo sapiens
cttttctgtcaggcatatcttcagccttcttcccccaaagactggctcctctgctcatcgcttgaggccaccagcctcaagtctgcatgactttgtcttgactcccactagtaacggacacaatctttcagtgagagacccaatttcctatgagagagaatctgatttcccaagatttagtcgtgtccaccatgcccataaagctgcttcctggaagagatgagtgtattgataaaagcacagtggtctgattatgtccctcagccaaagctgcagatgcgggcagatgattttacaaaagcatgaaggctccaagacaataattaatgattaaccacttcagtatcctattctattcatccacagctagtcgttgatgtcactagtgcggatactgtaacaatcgtgtctcatctcagggcatgctacatttgatttcaaaattttcaatattttctatttctgatttcaggtgtggtgccacatttacatgatgagataaatagaagattactttacagaattattttagaatgtttcacatggttttcaataactaaggaacaccgtgatatcatcattagtgtttgctacatcaagtgaaggcataggcagtaacacacatgcctcgtccaaaaagaaatcaaaagggcta

SEQ ID NO: 127304 - DNA, 328 bp, Homo sapiens
ctgccacacatagctcctgtaaccaaagggcctgggccacctccctcagacacgctagggctgctggactggagagagccacatccagtgtgaccacaaaacacattaggagtgatgttcatataatatcactaccgtcagtttatgtgcacttacaaaaaaactggagcatactgttaatcttttaatgaagtctgtcttataaagccatacaaaagttctagatgaacactttctttcagaaattaaatgcatggaaaggaggacagaattattcctaagaaccacatagaagaaagtgaagtatcccttatgttacagtgtgtgt

SEQ ID NO: 127305 - DNA, 535 bp, Homo sapiens
tggccatgtctgagctgggaaagagaagctagagaaatatgaaagcttttgttagctctctagaggttgcctatgaaaaaggggtagatttactccatgtcacaacgtaggaacaaagtggaggttatatagagatagatttcagctgagtgcaaggaaggactttcaaatcactccatatccaaaaaatgaaactggatgacaggcaaggactccacggccatctcatcaaagagttttggaggagactcctgctcttggcaagaggttaagtggaggaccttgacagtcctttctccccaaagattctctaaaatgtcagtacatcctggctatatcagataactgcaatttcaaaataatcaatgatcctatacaatttatatctctggaaatctagttcatattaaaataatcaataaatacttttgcacgctgtgctatttttttttttttttttttttttttgggggcacagaaaaaggggggggggatcctttaaaggcgaaggggggggttgtaagtttgggcttgg

SEQ ID NO: 127306 - DNA, 353 bp, Homo sapiens
tgcagccaagacagtgcctacaatgaggaggtgtggaactggaaagcctggagcaggcgggtaccagaagggctcccaaaggctggaggaacattcttcactccagaatagaaagcgatcctggaatcgtttggaatcactggagatgtattagagcacacatacagaacgtccagtgggaaacagggagttgagctgatttctccatggatgaggattttaaaagataaaataggcagggcacagtggctcatgcctgtaatcccaacactttgggaggctgaggtgggaggatcacttgagcccaggagttcaagaccagcctgggcaatgtagcgagaccccatctctac

SEQ ID NO: 127307 - DNA, 615 bp, Homo sapiens
tcagagggtgagttcagaacaggcagagggctgggtccaactaggattagtgttctgcaagctataacctagtgagaaaagggcaatggagttaaagatgtttgaactaaggtagttattgactatagaatctaggctaagagggaaatgagagaacaaagagaatattgaataatgaagaaatggtggggtcagcagactttgtgtgcctacgtgagccaatgcatcaactgttggactgaggctgtagagccttgctactaaaatgtggtcccagggccaggagcatcagcaccacctgaagcttgtgctaattcccaggccctaccctacatgtactgagtcagaatcgctggggctagggctcagaaaactgtgttcacaaacccttttgttgattctgatgcttgttaaagcttgagaaccattcttccagagtaagagagctgcaaagactgggggacagcgcagagtgggatgcttgaaatggttacagcaatcacaaggtctgaaatacagctagggggatgagaaactgtgaccaagtggaagaaaaaatcattaggaagacacaacaatccaggtggggtgcagtggctcatgcctgtaatccca

SEQ ID NO: 127308 - DNA, 277 bp, Homo sapiens
tttctagtcacaggcaccctcctgcctcagggcctttgcacatgccattccttctacctgaacattcttccccagagagccacatggttcacccctcactacctgccagtctttgctccaatgtcacctttcaacgaggccttccctgacttatttaaaaggacaacacaccccaccctccctccctacccacctctctgcatcttcttcttgtgcacctatcaccatctgagtgctgcagatgttaatcattcatccatttatttgattctcgcct

SEQ ID NO: 127309 - DNA, 457 bp, Homo sapiens
tggttttaacatctgtactacctcttttgccagctgttctaacccacaaggttgttgatcccactgacaatataaactgtctttgaatataaactgtgtgaggtttacaggatttgatgtctcagggaactgtcaataaactaatgggatacaacaaagttgctgagaaggtaaccatattataccatcttccctgaattctagatgttgccctgaaatcaattcatacttagccagcttcagtatggttactacaacatgtaaaccatcctcagtgactctcagcttacccaactataaaaacaggcatctccctctctacctgccacacttcatgggagcttgctaatcaaatgaatttccacctagggctctaatgagaaacaatcaccttccctttgggcctctcccttaatttattacattaattactgtaacaaaggaactgtgtcatctc

SEQ ID NO: 127310 - DNA, 482 bp, Homo sapiens
ttctatgccagaccccagccaggacctactgttagggctcttcaagaggatgaaggcgaatcctaggcctctattcctgtgaaggcccagctcttactgggaagggcagggaggcccccagatactgtctccagggaacgggacagttcaccaagaccacacacacagcctgctctcactgaaggacaatgagatgtggaaaggttcacttaaaaaaaaaaaaaagcacattagggtttttcttaatgcacagtacaatgaagaaaacagaaaacagaccagaaccctattgtccagataacacctactgacctttgaaaagaatagaagaaataaaagcacatggttaaaaaattccaaacagtgcaaaaataatacaagattacctgtggaggtcaccaagcacttccggttcctttccatgaaaaataagtgcttattactttctgggattccttctcaaaaacttcttaatgattgaa

SEQ ID NO: 127311 - DNA, 257 bp, Homo sapiens
aaacacacacacccagtgtataaccaatctgtgcctactcaagtcctgcaggtggccctgcagaacctgagtatatgaaaagtcagccctccatacatacaggttttgcagcccatgaatactgcagttttgatgtgcatttggttgaaaatatccacctatttgagggcctgcgcggttcaaacccatgttgttcaagagtcaactgtatatcccacaggtttctgaggctctattcatttttttaaaaaaatctc

SEQ ID NO: 127312 - DNA, 638 bp, Homo sapiens
atggaggtcagtagcacttttaatactaaaaaggaagccaggtcctgtaggggggcagagagaggaagtgctctaccaacatgtttccataagccaggctgtcctaggtgacccatctaaagaggaagatacttgtctgaggtaagtaaacatcttcaaggtcactggaactcctgggccccaagagaagtcgaattctaaaggttgtcctagatctgcaaatatagtctgttgtttatatgggagtgagcagggttattcttaaaattgttcttgccttactcaggatttctataggagctgtatcttgttctcaggcaggtaggcatgcaagtttgtcagcttttcacactaaacaaggaggagagacaatatatgggaagaactttgttttatggaaaaggcaaattcataccacaatagcacacaaaagtatgaaaacctctgccaaagaatgatttattttgacacagtaagactggttataaaacacagatgctttatgcaggaatcttccagcaagacaagacattctcagtggagcctccactaaaaagctcaaatacaattaattcatcccattatgactgacatggacaggaaaagcgaaagttctttgcagtggtagaagtttgtct

SEQ ID NO: 127313 - DNA, 105 bp, Homo sapiens
ttactagtctataatcacacaatatttttacctgcatcattccatttgttccaacaacctggtaatgtaggctgggcaacagttcattgttatgttttacaaaca

SEQ ID NO: 127314 - DNA, 299 bp, Homo sapiens
cagaggtggtcattacacactgagtgtgggggtgcaagaaagatggtaccttagagacaagtaagtatttgttgttactttcactatgacatgtcagtgttatgagctgactccaaatttcatgtgctttcagtttaaaaatgcttcatgacatctaaagaaatgctgaaggcgcttgccttcccagcagaaattctaaacatgatcattcccagaaatgctggcagaaagatcacgtgtgagtgtggggcataaaagtcaaatgtttgtgtatttctgcattggggggcttgacaata

SEQ ID NO: 127315 - DNA, 232 bp, Homo sapiens
attctgcctcagcctccctggtagctgggattgcaggcacatgccaccacgcccagctaatttttgtatttttagtagagacagggtttaccatgttggccaggctggtctcgaactcctgacctcaagtgatccgcctgcctcagcctctcaaagtgctgggatgtgagccactgcacccggccaatatgccattgattttgttggaaattggcaaattgtttggagtatt

SEQ ID NO: 127316 - DNA, 376 bp, Homo sapiens
cctgattcaaaaagtaaaagctttaaaacaagatccagtctagaatagaggaaatataatccagggtatctcatccttttttttttaatgtttaaaaaccatatgaaggttgtctaacttaatgtctaaaaatagatatctaattcattcaacaaaaatactaatggccaaggagtttgagaccagcctggccaacatgatgaaacccgtttctactaaaaatataaaaattggccaggtgtgttggcggcacctgtagtcccagctactcggaaggctgaggcaggagaatcacttgaaccgggaggtggagggtgcagtgagctgagatcgtgccattgcagtccagcatgggcaacagagcaagactctgtct

SEQ ID NO: 127317 - DNA, 575 bp, Homo sapiens
ccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaac

SEQ ID NO: 127318 - DNA, 704 bp, Homo sapiens
atcctttcacgtgttttaatattttccattggatttctacgtctttatttctgtgactggtctatagcaagactaatattaatagatgaaaatgttttgaggttgattgtataacctttaagcttcccgcatcagtttaccttaagacagatcttaattcacatatccttattagtagcttagtcatatataagaaacattgagtgctcttttccactaattttaagtccctttcatgtattttcaaagtgacagtattaacatgcttgcttctaaagttctttttccagatactgatgtaaaggttctcctctatcctacattaattttaacctcaaaagatcaccttgaagaaaaaatttctagttttatcatttaggtttattttagcctttgcctcttcctaaaattattaatagaatgtagttagtgtgactgaattttgtgatatgaatactttctacagagaataagaccaaatctctaaatttgctttgaactgaaatgtaaaatgcttttgaatccaacaatttttaacctagtttgagatcaaactactatagattgtgcaattgaaagtatgttttcttcaaatgaatacacaaaaatctataacctacatgtatatatagtgagtacctagaagatacaatttcagttagaataaactcaagagctctgttgtacaacatggtagctgtagt

SEQ ID NO: 127319 - DNA, 636 bp, Homo sapiens
gagaactctgtgggaacaataactttctaagtcataatacacaacactaattactgttatttttcagtaaaagatcatgaaatttattagaaaataaagattttcttattgttgttgcattggctagaaagcatttggtattaagtttaaagttgataacaaaaacaaaagttaggttttcaaaagagaaggaaaaacttagtcttgttttcctacatctccttagactcccagaattcttgcaaaaacttaaaatgtgtcagatggttttgtgtcttttcttcaaatccacttttaacagagggctagtttggactatttgcacttaaattttctctgtattatagaaaaatattccagaaaaaatgtttgttaattcttgctaatattcttgttgctaaagcaagacaattgttaactattgtgaatggtcatgtttatttgtgcatctccttccactaagcaaattcagtttcgtaatcaatctgcagtgtggtgaatttggattcaagaaatgtggctatttcttgcatttatatggtgaatatggactcaccacattgcacatgaattaatctcaaacttataaagttgattctcagaagaatgttactaaaagccaaatatattttttat

SEQ ID NO: 127320 - DNA, 999 bp, Homo sapiens
caaaggattgtgttgaaaattaagtgaaaacttacataaattatgtagtgtggtggggacatatgataggtactgtggcctatccttaggagggatgaggaatggaactatttttaaacataaaaggtcaactttatatgctgccatataagtaacccagtgcaattggagcttgaatcaacagggctgggagaaagcttacagagtgtgcctttgaaatcccaatacccagtcatggtgatttatgagaccttaccagcttgcatatgtgatggcccactgagtttgtttactttagttttagctcagttacccagcactctatgatagcctatttttatttacactctcactaactcctctattatgatttctttgaaagaatatgaagacagccataaaaaagactcttatggaagttgagagggtctcctggtaggtcttcacttcactgtgtctaaacattggtctgttgcttgtgctttgctatctctcaacctggatgaccttcaggctcttccaaatgatttctctgattccctgaaatactgaaatgtgattacagaagtttcagtgttatcaatatcagatagtagtgtctctccctgggaactagaatgaaaacaaaataggctcgtatcatgcacgcttcacaatgaaatgcgagtgagaacaggagatgcatggaaaacctaaaccagtctaccccagaagagggcttggcagagctgagaagaccaaccggaagagaggatcctaaaagggctatgtcaacgggaagcagacacagggaggaaaaggacacctcgcaattcacgggggaccattagaggagagacaatgacggaaagaagcctccatatgtggcaaaacaaagacaaaagtgggcgcggccaaagtacaaatgaggcacgaaaatacggtcagagcatgtgcaaacgcaccagaggcctatacactcctcacgacacgcaacaacacaataggacaagaaggagg

SEQ ID NO: 127321 - DNA, 379 bp, Homo sapiens
acccaccatctacaaattctccttaaggtcttaaccctttaatttctattctttctcctctcatcatttagaaaacggataatttccaatttcttgggagaaaggaagggattaatcaggtgtgaaaacctcactcaacctcacctccagcaataaatattatgatcaccaccataacagctacccttaagcatttcagtgctactcacatattcagctgtcacgtaatggccttgacaatcctcacagagcccatttgaggtaggtgttattatttgcagtttatgaatacataaaccgaggctcatagcatttagaaagttgccagaagtcatactccaagtaggagtgcctccaaggcttgagctgctttcctttt

SEQ ID NO: 127322 - DNA, 337 bp, Homo sapiens
caggtgtaggtgcttggagaggctgtgggactgggttcctaagctcagttagggtcttgtgaacctattgtggcacctgagtctcgagttacaggttcactgtctgtggatgtaggttgtccatcgagcaagaatctgtgactgaggcattccccagcatcttgtgaccggaggcctgaattgtagctgtgattttgctccagaggagagggcttctctgagaaattcctcaatgaaattgtttatcttataatgagggtcaactatggccaaagcatggacattaatgtcttttggagggcagaatcactgattctagcctctgagcagtggaagg

SEQ ID NO: 127323 - DNA, 760 bp, Homo sapiens
tgcagtggctcacacctgtaatcccaacactttgggagcctgaggcaagaggattgcttgagctcaggaattcaaaaccagcctgggcaacatagcaagacgctgtctttactaaaaataaaacattaaaaaattagctaggcgtggtagcacatgcatgcctgtagttccagctacttgggaggctgaggtgggaggatcacttacttgagcccaggagttcgaggctccgccactgcactccagcctgagggacagagagagatcctgtctccaaaaaaaacacaaaaagcaaagtagaaagcatgtgccctgggacactgagtcagctcgcaaataaatgcactagccaaaacctcaaggagaaggtagcatttgaagtgagatttaaaggacgacctgtatttaaacatgggacatgggaaatagtgtaagtaaaggaattagaattcaaacccacatttaattccaaagctacgctaccccaccccacagtgtggcttgaacagagtaccttacacaaaacagaaggaaaaagactgaggccatatcacagaaggcttaggatatcacactaaagaatattcagcagataaaagctaagcagagtaatgagactccagtgagatcagagctgtttaaatgcatgattacatagtacttgctgagagtattttctggtggtaccaaagtttctaacacaagatcttaagttacctgttgtattcccctgtctctctaatcaaccctagatgagatc

SEQ ID NO: 127324 - DNA, 281 bp, Homo sapiens
ccatcacgaatatcccttattcttccccaccccacttctcacctcttccatgaagccttcccagatcactaagtactccagccacaatccctcaaacccaagtcaaagtaatctctcactcctctgaaactttataacatgatatctgcattttattattttccaaataatatttatatttccaagtaccattcaaaatatgtgtgtgcatgtcttaacatcttgactagattatgaactccttgaaggcagtgccttttcttttctttcttttttttttt

SEQ ID NO: 127325 - DNA, 253 bp, Homo sapiens
ctgtgtatatacgtggtatgtggtgcatgtgtggtgtgtgtgtatagtgtatgtacacatggtgtgatacgtgtacataactgtggtgtgtgtgtagtgtgtgtgtaatgtgagtatacatcgtgtgtgtgctgtgtgtaaacatggtgagtatgcatgtcgtgtatgtgttgtctgtgtgtttacatggcatgtgggtgtggtgtctgtgtgtatacatgctgtgtgtttgtatggtgtctgtgtgtataca

SEQ ID NO: 127326 - DNA, 736 bp, Homo sapiens
gaggttgaggctgcagtaagtcatgttcttgcccctgcactccagcctgagcaacaaagcgagaccctgtcacaaaaagaaaaaaacataaaactgatatggaataattaccatccagaatatataaagaactctcattaatcaataagaaaaagaccaccccttcattaaaaaaatggggagaaagatataaacaggcatttacagtacagaaaaaacagttggtttataactatgaaaagattatgcactgttagctgggtgtggtggtgcacatctgtggtcccaactacttgggaggctgaggtggtaagatcgcttgagcctaggaggttgaggctgtgtgagctgtgactgcacgactgcactccagcctgggtgacagaataagaccttgtctcaaataaaaataaataaataagaaaagattcttggccaggtgtggtggctcacacctgtaatcccagcaatttgggaggccaaggagggcggatcacaaggtcaagagatcgagaccatcctggcccatatggtgaaaccctgtctctactaaaaatacaaaaattagctgggcatggcggcttgtgcctgtagtcccagctactcgggaggctgaggcaggagaatggcttgaacccaggaggcggaggttgcaggttgctggttgctgagatcatgccactgcactccagcctcctgacagagcaagactctgtctaaaaaaaaaaaaaaagaa

SEQ ID NO: 127327 - DNA, 654 bp, Homo sapiens
attccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttg

SEQ ID NO: 127328 - DNA, 573 bp, Homo sapiens
aagtggcagagtggagacgagagagggcagaaccggtgaccccgaggacagacagaattcatctgcctgaacacacagaaacggaccgaggacggtcaaggcctcagagacccgcaggaccctaaccaaagagcagatttctaagtttctgcaatcgcagaaggagagaacaagtggactgaaaaaggatgtgaggaaatgatggctgaaaacttcctgttagccaagagacataaacccacagatgcgagaagccaactgaatccaaatagaacaaacccagagaaatctgctccaggatgtatggtaatacaatttctgaaaactaaagacagagaaaaaaaccttgaaagctgccagagagaaacccctcattccttcgagagaagcacaagtctaaacagcagcaggtttcatagctggaacacagaagccgggggcagggacacgcgcttcccaggcactggatgaggagagccaccacctggaaatccacatcccgtgagatgccctcggagtgacgcggggacaaaggccattcccagacgaagaaaaacttagagaatttgtggc

SEQ ID NO: 127329 - DNA, 401 bp, Homo sapiens
gcactgactacacttggtcccctctcttctctctccctggctctgtttccttcacggcacataccacgatttgtccttatgtatttgtttctctaaatgcttactgctcccagggcaactttcttaggatagggttcatgtctattatattcctcaatgaaaagccatgatctagccggtgtctggcacataatgcaagctcagttagttagaatgaatgactgaaggtattgtatataaactgcctggcacagtataggcaagaggtggtccacttccagggaagcctggaccgtctgaggtagctattttgcccctaagcacaagccagcaacaattctcactttcttcggaagctctttaagtctcccaacttcactcaccaaccccttctacacaca

SEQ ID NO: 127330 - DNA, 256 bp, Homo sapiens
gtgtatgactgtgcgtgtgtgtgtgtacgttgtgattgtgtgtataattgcatgtgtgtacgtgcatgtgtgctgtgattgcaagtgcatctgtgtgtgtttgtgtgttgtgggagtacatgagtgcctgtgtgtgtgtgtgagcaagtgagtgcacatgtgtcaccgtgaagggaccatatttgggaacatctcttgggagggagactgagctaagccctgaaatggtcaaatatatgaacaggccaagctgcct

SEQ ID NO: 127331 - DNA, 176 bp, Homo sapiens
tccttcttcatctcctttccatgccactggcctagagaaggagaagccactggtcccttttccctcctgctgaaaggcaattcagcattaaggcaattacatcttatctgtcccttaacaacagagggaagaaaacccattgcaggcccagtgacacagcagataggaggtcctgg

SEQ ID NO: 127332 - DNA, 508 bp, Homo sapiens
atttgtgaacctatattatgtttgtttgagagaaaaaacttttggatttgaagataatttaaaaactatcataattctggttttttttttaggtattgtttatttttacctgtcaaaaacacataaaaaatttacaatcaagtatttttaaatattcagtttagtcatcttaatgttatgcaacatatccctaggatgtttttaccttgcaaagctacatctcactacacattaaacaactaccatttttttccatttcatggcagttttcaaacactattttgtttcctgattctaagagtgtaactgctttatatatcttaatacaatcttttccatggctggcccatttcatttggcatgttatgaagatttatgcttatagttgttacaatatttcctgcttttggaaaaatgagtgatattttaaattatatttactgaatgattggttgaccgaaatttgcattgcttttacctattgggctttcactaacaattctgcaaa

SEQ ID NO: 127333 - DNA, 874 bp, Homo sapiens
cctctgcctccccggttcaagcgattttcctgcctcaacttcctgagtagctgtgtctacaggcgcgtgccaccacgcccggctaatttcttgtatttttagtagagacggggtttcactgtgttagccagggtggtctccatctcctgacctcatgatccgcctgcctcggcctcccaaagtgctgggattacaggtgtgagccaccacgcccagccctctccttttcttactaaaccagtgctgtaggggcttgctactccaagtgtggtctggggacctgcagcattcctgtcatccaggagcgtgttaaaactagagtatcctgagccccatcccagacctacttaatcagaatctgcattttagcaaaatccctaatgagtcctgagcatgttactgtgtgaggaagctctgcttagaggaggaaagtctgacaattacaactatgcatcctggccaagactcaggacttgaatccatggactggacccgaaacattggtctatctcagtgagggaggaagggtgctactagaatctgatgggtagagaccagggatgcagctaaacgctctataacacacaggacacccccttccaccaacaaagaattatcctgcacaaaatatcaatggtgccaatgttgaaaaaccctggtctaattgtctagatgtagaattcacatcctgtagatatgtttcgtagcctcagatgtatgcaaatctctaggaagtagatcttaaaggagttgatacaaattgcagtgtgctatgcaaatgggaatatttttattgggacttgaaaagagaaaaagagcttaaactgaagcatgaaagatttccattagagttttgagagtgtcagactctcaa

SEQ ID NO: 127334 - DNA, 539 bp, Homo sapiens
tgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgatgccaaatgaacctactacctccaatctgcaagttggtctgtggccagaaaagacctcgtttctccagaaatctgacctta

SEQ ID NO: 127335 - DNA, 428 bp, Homo sapiens
acatgtcactatgaaaacaaactgcagcgcaaagcaagaaaggaagaataattgagattacttatatctctagagaaggatggacctcactaggttgttcatattcatagacaggatattaaagttacagatcctaaaccatgaaaaatgaatatacaaaaactatttccaagaagaaaatcacagcaacttgtaccttaaaggttatggattggctaaaagagaccacacactggttcacctcctttaaatccccaattatttcaccaatactacagaacttaatagaagccaggtgattacccagagccacagaacaggcacacaggcagtttctctttgcttggcctttcctttgcccctgtgttccatacacagcacacaagaaaggattctgactgagctgagaaattcctgctatttcactg

SEQ ID NO: 127336 - DNA, 312 bp, Homo sapiens
  misc_feature (296)..(296): n is a, c, g, or t
cacctgccgggacacctcacccccagcccactggctccctgcatcccagttgcatccacaggcactgaatgctttgggtcggtccccaaactctcagagccccagtttcctctttcgtaaaacagcaattaataaccaccattgtaggactgttgagttaattagcaggaacatataggatgcacttgattacagagctggtgcacattaaagctaaaaaatggttgctgccgggcgtggtggctcacacctgtaatctcagcactttgggaggatcgattgcgcctaggattttnaaggctgcagtaagct

SEQ ID NO: 127337 - DNA, 364 bp, Homo sapiens
ccaatatgacatgtaattttacagcacagatagtttttcaaaagaattacattcccaggcttagcagagggagcggcctacttattgaaatgtgaaatcgaatctctgaaacagaaacaccaaattattatactaatctgtaaagtagctataaaacgttatttttcagagtgaagtatctgtcaagatggctagttttggtgtataatagaaacggtattttattccttttatttctgtaaacagattaagtctgtgtgtgtgtgtgtgtgtgtgtgtgtgtgtgtgtgtgtgtgtgtacatgggatataatacaaatctacctcgacttataatgagttacatcctgataaccacaggccaa

SEQ ID NO: 127338 - DNA, 701 bp, Homo sapiens
tatgtttagccctgggagccatgtgttatttatcattgtacagatcttcttgctgacacaactgggtatggtagacggcctgataggattaactgcaagtaaagcagaaattattaaaaacaatattgaggccaggcaaggtggctcacgcctgtaattccagcactttgggaggtcgaggtgggtggatcacgaggtgaggcgttcaagactagcctgaccaagatggtgaaaccccgtctttactaaaaatacaaaattacgtgggcatggtggtgggttcctgtaatcccaggctgaggaagataattgcttgagcccagaaggtggaggtggaggttgcagtgagtcgagatcacaccactgcactctagcctgggtgacagagtaagacaacgtctcaaaaacaaaaacaaaacaaacaaacaaacaaacaaaaattaaattaactggatgttaaatgtggtttctttacatttaccagaatttcagccaaggtcctaatggccccaaataataggtgctacattatcaagcagatatatcaagagattgtgataatgttaatgaaacccctttgctcatcactcatttccaaaatttatattttcaaagggaattttgtacagagttcctaaaaaaagggatcatgatgtcagtgtattgcctcactgattgctaaatgaagaggactataataa

SEQ ID NO: 127339 - DNA, 547 bp, Homo sapiens
tttatagttgtgtttatttattatatctcagtaatacgtaataagagagttcttatgagtggaatgtctacattggctcgattgctttaacattgacttaaataatttgatctctgatggacgaaggtatcagaactacatgtgtgattaaataataactttttagattttttaaaagcttaaatgggtaattttgattctatgccatcactctcaacaaatagttttgagcccactgctataggtgactgctatgatggcggaaagtacaggatacacaggagtttaagggaagaaatgcccgaggagagcaggaaaatgcctcctccaaactggaagtaacacataggggcaatgccaggtgagtggggatgcatgggcaggcaaagatggaagaatagtacactggataatgtgtttggttccagcatatgtacaggtgggagatgtgaggcccaaaagctgtagttagaatccaattgtgaaaggctttttatgtaatattcaaaggtttagatcatacattgtagatcagtgattctctttt

SEQ ID NO: 127340 - DNA, 601 bp, Homo sapiens
gtgttacagcttttaaagatggcaccgacccaaagcgtgagcagtagcaaggatttattgcgaaaagcaaaggacaaagcttccacatcgtggaaggggaccgagcgggttgccactactggctggggtggccagcatttattcccttatttgtcccctcccaaattcgatttctgtcctatcagaatgccctttttttaatcctccacaactggctacttttagactcctgctgattggtgcgttttacagagtgctgattagtgcattttacagagcgctgattggtgtgttttacagagcactaattggtgcattttaccatcctcttgctagctacagagcgctgattggtgcgttttacattcctaactagagtgctgattggtgtgttttacaatcctcttataagacagaaaagctctccaagtccccattctacccaggaagtccagctggcttcacctctcagcaccatggctgaatgcaatggtatcagggaaggagaaaagatgaagtctttggacaactgataaaaaatgatcagtctttaggtcgagcatggtggctcacgcctgtaattgcagaactttgggaggct

SEQ ID NO: 127341 - DNA, 315 bp, Homo sapiens
catttattcgatgcatacttctgaagatcatacccaaccatggactaggatggccaatgtccaagttagttggctatattatatggaggctacctggttaaaaaacaacaacaaaaaaaggactttaatagactcttttgcaagaatttgtatacacctatgtatttttgcagacttccagtatgtggtaactcagtatcagactcttggttagaaatgatcagtgcctccattgtaactaatacctccacaaataaaattacccaaggaggtattagttacaatgtgcatcgataacaccggccgagctcgatt

SEQ ID NO: 127342 - DNA, 893 bp, Homo sapiens
tcatccttaagggtacattgcttccagacggggtcacactatgttgtccaggctcatcttgaacttctgacgtcaagtgattctcctacctcaatctcccaaaatgtatggattgcaagaatatgccaccacaactggtctcttttagctattttgtaatatgagataacttttcattaattattattattctactgtgtaataaaaaacaaaaacttatttcccctaaaaaaaaaaaaaaaaaaaaaaaaaaaaaaaaaaaaaaaaaaaaagggggggggggcggggaaggaaaaaaaaaaaaaggggggggggggggcgggggccaggaggggagggggtgggggcaagagaaaaccggaaaaaggaacggggtggttgggtcctctcaacacaataaaaaggcggcgccgggggggaaacgcagggggggttcatgagcaccaaaatgccaaagggggggtgtcgagcgccgaaccggtgggaacaacacaccggaaggtcacggagattccaattataataccgccgcccgcgcgcggtgaggcaaataaaaataacatcaccacgacagctagcagaaaacaacacaaccaacatgcaaagatacgaccacgccaaaacacacgcgaacggcaagaagagagagacaccagggagaagaacacgcacgaacgaacgaagaaggagcgcgacgaggcaagaggggcgaggcggaggaacaagaaaagagaaaggagaacaagagaaaacaaacgaaagaagagaggagaagcacgaacgaaagaaaaaagaagaacgaggcagagaagaagagaagaaaacgaacagcaaggaagcagaaaaaaagagaagaaacgaaggacgaaggaaaaaagcagctagaaaagagg

SEQ ID NO: 127343 - DNA, 514 bp, Homo sapiens
tcatccttaagggtacattgcttccagacggggtcacactatgttgtccaggctcatcttgaacttctgacgtcaagtgattctcctacctcaatctcccaaaatgtatggattgcaagaatatgccaccacaactggtctcttttagctattttgtaatatgagataacttttcattaattattattattctactgtgtaataaaaaacaaaaacttatttcccctatctaatcataacacaatacctgtgaagcagccttttcccatcctcctgcttcagtctctggtaacccctgttgtactctttgcttctatcaaccctttttttcaggttcctcaaatgagtgagataataagatcataaagtatttgtgtttctctatgtggcttattttacttaacatggtatgctcaaggttcatccatgctcttttaactgacagaattttatgctttcttatggctgaatagtatttcgctgtgtatatatagtacattttccttatccattt

SEQ ID NO: 127344 - DNA, 481 bp, Homo sapiens
tgttgggattataggggtgagcctctgcgcccagccaaaacatattcatttgaaactgcctatttttattttcagtgttatggtaacattgattccctatagctttcatctacctctactcatgagtaggtgacgtttttctaccactcaacctgtacacattttaaaaaagctgtcccagctggttttgaaatgtagaagtgtgccttgagttgaaaaataagtaggaaagtacaggtctttagataactaactgtggcatggagtcagtttatactttctttttcaggtgaatacattatagttcttcagtgtgacttgaagtagagcattcacagtgtgcgtgaaaacatgcagtaccacttgtgtctggctgagggggaagtagggagtggtctcataggtggatttttaggaagttctatgttttgaacagaattcagcaattagtggaattatgttgttggttgttaggaagtat

SEQ ID NO: 127345 - DNA, 604 bp, Homo sapiens
ccatgttcatggatgggaagaatcaatactataaaactggcaattatccccagtccatctggaaatcaagtgtaatcctttaaaatttccaatagattttctttcataaattatacattttggatcctaaaaatcatttgaaaagaaaaaaggccaagaagagccacaataatcttcttccttttaaagaaggtgaagaattgtcctaacatacaatagtgtggtacaggaacaggcaaacagatgaagtgaatgagacacaaaggttagaagcaaacctgtctttgtatgggaatgtggtatgtggtagaggtcacattacaaaccacagaaaaagcatggaaggttcattaagtggttctgaaacatggaaaggtaaaattgaagacaaaggtgaaagaaacaaagatctttaacactttaaaaagcaaatatatgaaaatgtctttatgacctctggccaaagatttcttaaaacacaaaagcaaagccataaaagaatatgctgctaaattaactaatgaaactttaaaaaaaatttttttcatgaagaaacaacgtaaagtacaaagacaagccacagactggaagaaggtatctgcaa

SEQ ID NO: 127346 - DNA, 458 bp, Homo sapiens
aaaatttgccaggcatggcagcatgcacctgtagtcccagctactcaggaggctgaggcaggagaactgcttgaatccgggaggtggaggttgcagtgagccaagatcgtgccactgcactccagcctgggcaacagagcgagactccatctccaaaaaaagacacaaaaggaagtagaaggaggctgggcacagtggctcatcctagcactttgcaatgccttggcaggtggatcacttgagcccagaagttcgagatcagcctgggcaacatggtgagacccccgtctctacaaaataaatacaaaaactagctgggcatggtggtgaggaccttagtcccagctactcaggaggctgaggtgggaggatcgcttgaggcaaggcggcagaggttgcagtgagctgagatggtgccactgcactgcagcctggaagacagccagaccctggctcgg

SEQ ID NO: 127347 - DNA, 219 bp, Homo sapiens
agagaagggaaggggaataacagtcacctcagaggtgctatgggaaacagtggcatcggcaaacctgctggtggaggggaggactcagaggaatctgatgaagaagtcaatgaagtcaagtgtcagctatcagccaatatgaggctacgccaagcctacagcctccgggctcctggctcacggcccctccctggcctccctgtctcagtctcaccctat

SEQ ID NO: 127348 - DNA, 467 bp, Homo sapiens
ttctccccacaaccccttcaccaccaatggcaggccaggaaggtttttctaagtaggatagaatcactttgccccaaggaacctgagaagaaactttaggccacagccttggtacacagaagaaagtgtcaccatctcgtcctgtctctaccacccctcacattacagatcacttctctatatcacggacacggatacacaaactcctttcttttccaaccctgctccctcctgggacagtctcttgaacataaggaaataggtcagaaaaccagaaggggagaactagaaataaagttgtttctctcttttcctaccaaataggagctagactggacatcacagtcagaagccagcttgaggggagggggacaatcgcctctccagatcaggcctcagaaatcgtgggtagtttccgtcaacatgggaaacttaagaaaaagtagcatgaactacgagactgaaac

SEQ ID NO: 127349 - DNA, 462 bp, Homo sapiens
gaggtctcccagcatcttaaacatatgtcccaacccaaactcttgattctgcctttaatcacctccccttgatcttctcactcgccttcccttccctccagccttctcgattcttccagatgcccaagccaaaatcctcagggttgcccttgactcctctctttctctctcacctcccatcctatatatcaacaaaatttcttggcatcatctaaaaggaattccagaagttgtccatttctcaccaccttggagaggtaatggtccaagtaacattatttcatatctgggttactgtctcctaataggtcacctagtttccattccttaggccctattgtacaggttactcttttggaatatttaatccaattatatcattcctttgtttgaaatcccccataggctcccccttttgttcagcataaaagccagactccttcaaagccataaatggcttac

SEQ ID NO: 127350 - DNA, 393 bp, Homo sapiens
aaacttgactatagagggtgtggcaaggccttcatcagtggactgcatactgagccgccacattctgactcacacaggagaaaagccgtttgtatgtgcagccaatggctgtgatcaaaaattacccaaatcttaactttcagaaaaggtaacaaactcctaatgcatgtggcagtacatgtttgctccagctgccctgtccctctaccctgcgtggactccagaaccgcccatgttggagcccacctcctttccccacccctgcccactttccactcacacctcaggcaaaccctgcattttgctgttcctggaaaatggcttatgcttggatacctctgggcctctgttgatgcgtctgtctgttccttgtggaaattcttcctgacattc

SEQ ID NO: 127351 - DNA, 356 bp, Homo sapiens
gtagttgggaatacaggcatgcaccaccatggctggctaattttgtattttagtagagacgggggttcaccatgttggccaggctggtctcgaactcctgacctcaagtgatccacctgcctcggcctcctaaagtgctgggattacaggtgtgagccactgtgtctggccacaaatcctcaaattctaacattttaatgcaactactatgggtcaagtttctcaagcatatgataggctcttttaatatgtcattttctttcttattttatttcagggaatgttacagtaggtagttagacataaacaaggcaggagaggcccctccacccccagccaggaatgtcaagtgacta

SEQ ID NO: 127352 - DNA, 431 bp, Homo sapiens
gaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaa

SEQ ID NO: 127353 - DNA, 240 bp, Homo sapiens
tgaatacatgtataccaagtaaaggagttaaactggtaattaaaatgattccaagaaagaaaaattcagattcaggtgattttacaggtaaattctatcaagtactttaaaaagaggtgacataaaacattcataaagtgttacagatttcagaagctgcaacaattttcaattcattgtgagttgccccaatgctaactccagacaaaaatatcacaaaaaagaaaaccacgtatcaat

SEQ ID NO: 127354 - DNA, 328 bp, Homo sapiens
gggtacaatggtacgatctcagctcactgcaacctctacgtcccgggttcaagcggttctcctgccttagcctccccagtagctgggattactggcatgaaccaccacacctggctaattttgtgtttttagtagagatggggtttcttcatgttggtcaggctggtctcgaactcccaacctcaggtgatctgcctgccttggcctcccaaagtactgggattacagggttgagccactgtgcctggcccaggcccacggagttttaagaggcttcctgtggcagtggcatccagacggagtgcagaaactcaaagttgaaggccag

SEQ ID NO: 127355 - DNA, 665 bp, Homo sapiens
tacagagacagttttaaataatagaaactgtgggtctgtttatttacttgcttttatgagcagtaatatttgttataggccaaccttgatgttaaggaaacctctttttttttgtagacagagttatttcctaagaggtttcctgggtacatatgcagtgaaattcttggtttgtctagtttcccaaataaaacccaatgtaatagaatatcacttttctggagttacaaaaatgacttgtttattcatttttttaaaatgtctcagaatatctaccaaaatagccattcttagacacagtatggcagatattttgaattataattaaaaaagaattgtacagcttcctatgtaaaaacaaaaaggctgctctttgatttctctgttttataatattaaatatcagaaaactataaatcagtgtccacattttgagtttgtttttctgctactggattcatttttaaaatgataattcttttaaaaaagagtttgaataccacaaatgtatgtgatgtgaaaatgaggtccttagttcattttctttcccactttctgccaatcatagcttccagcggtgactacttttaaccttggaatgtatagatctttttctatacatgtgacatatacaagatgattttgggggggcttaagtaaaaata

SEQ ID NO: 127356 - DNA, 518 bp, Homo sapiens
  misc_feature (4)..(4): n is a, c, g, or t
gganccccactactccacggttggctggtaataagaacacaaagagagactggtatcttggaagctgagagaggatggatgtcatagagagacatgttgtcgagacactcaaataaagagacaataataaagatagtaagtgaccacaccgaaactgagaggtaaaatacgttggtaaatgtggtgaaaagatttttaccacagttgagagaaaaggtagctcatcagcagttaaaaggtagctgattacagaatgctgaagaaaacttaggaagttaaaggaatgaaaaaaaacctatgcacactacaacttttcataatatcttgtctatgaaagaaaaaggggacagagaatgacacatagaaggaaatggataacttttagaaatcctgatggtggtaatgagacaaacttgtgcaagtttatacaatgaaacaaaagaaaccatggctaaatacttacataagagagtgaataaatgacgaacatgtaagtatttagccaaccgtggactagt

SEQ ID NO: 127357 - DNA, 745 bp, Homo sapiens
tatcatgaaaatccatctgtggaaggagtaacaagctgcttttagaaacttgatttctttttattctcccaagtatttggcttaaatatttctttgaaacatcacttaattttttcaaatatgtggtttaattttctaggaagtaacgactaaacttttaacaagacaaattgaataatacagttttacagtaggtttttcaagtacgacccattcacattcttctgatgagcctttgatcaagtctttcactgctgggcagtcttacctcacagatttaggatatgtcagggacatctgtgtcctcctaaatctgtattggagagaatattcagggaacatacatggtggtgatagaatcatggtatggggaatggtctgaattcaccaccaatgaacacctgaactctcttcattcatttatcttctagttcctcactgagcacctaccgtgttgatcaggtggagagaacactccctggcctcttgaaactaactttctactttcccagttctgcatcagaatccttgttctatgccagtgccaagtcacatagagctaaaaaatattcttcttggtaatcatgcacaggctgtagccttcaaaataaaattattcttcgtgctaaaaggatggtgttttctgtcattatattgtttctgcagtatgcttgttcagttatgtaaactcattttctgtgacatttataggatcctggcctagaatgcaggtttaaaggaggaa

SEQ ID NO: 127358 - DNA, 217 bp, Homo sapiens
ttccccctaaaaatcccgttctcccaaagtgctgggattacagatgtgagccaacgtgcctggccactccacacatttgatacattatgttccgtttttattcactttgatgccttctaattttctttgggactttctctttgatccatggactgtttagatgtgtgttgtttgagttgcagttgttgggagatgctcctattacctttctattatt

SEQ ID NO: 127359 - DNA, 545 bp, Homo sapiens
aaactttaaatgtttcattggagagattaatagttttcctcttgaccctttcttgtgacatgtttgtgagatgtttgaagatctctcaggttaaaaaaaaaattattgtattttaattcctgtatttttagtgaatttcatggagctttttttaaggaggtatctaaggttttgtaatactgtttttctgcttatttattgattcactaactctctgcttttatttttttctgagtttgcagaattcacaaattgttaatcacttaagaaatctgattaatgctctttgggggaagttgtcttcattgtctgcatcttttgcttgggtggaatttgtcagactccttttaatttctcctcttcccatctggtttgctttccctgtcttagtaaagcacagatttttttatttacagattttaatttattcactctaaattacagctacttttttatatagctcttactacatactgcaaagagaaagactgatctaattatctttttagttaaagggagaattcattcatttccctgtgaagtat

SEQ ID NO: 127360 - DNA, 320 bp, Homo sapiens
ttcagttttagggaattctgctagttttccaaagaggttgtgctcatgcattttcatcagttccagctgctgcacatcctcatcaccacttagaattgtcatgacaggccaggtgcgcgggctcatgcctgtaatcccagcactttgggaggccaaggcaggtggatcgcttgaacccaggaggcggagattgccgtaagccaagatcatgccaccgtactccagcctgggcaacagggtgagactctgtttcaaaaataaataaataaataaataaaagcaagcaaacaaacttactgaaacaacacagaccccaaaag

SEQ ID NO: 127361 - DNA, 661 bp, Homo sapiens
tctgagggagccggaagatagacggcgaagctgaatcccacagtactgagttcagcagaggttaggaactctggccaacctcacagaggggatttcatgtgtcagtgtcagtggtcgagaaataatgaaattggaactgaaaagtgattgagccggtacctgttactgtgggtgcaaaaggctgcgatacacgtgggatttggctcgctgaagctggaaactgtttggattcttgtggagcactctgacctctaactctctctatcatctctctaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggtatgtgtgacccccatgcgctcaggggttcccccacccgctcttctgcttgcataccttccgagcagttctcctgggcggggtgctgtgcagctcagagcgggtaagcaaggactggctctgcaaggagctcggtcaccagggcctctaaataaacatcagagttctcaaaactaaatagaacctttctccttcttacaaaaacaatacgtgttcatgaaaataatttaggaaagacaagtaaa

SEQ ID NO: 127362 - DNA, 525 bp, Homo sapiens
cgccgggaggagctggcggcgagcgccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgccctgagctgtagccccagtcccctttgacatcacccattttccaatggaggaagcttccagggagacagggtaccacttggagagcccccatggccacttcagattgcagccattgccacttcatctcacctgaggtgctgaggggagagtctagtttacagggcatccttttgtcacctgctcgccacccttatgcccctgggtgtgaccagcttcctcagaaagagctgtaatcaatagcatattgattaaaaagcatattaagatgaaaa

SEQ ID NO: 127363 - DNA, 2981 bp, Homo sapiens
cgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaa

SEQ ID NO: 127364 - DNA, 2847 bp, Homo sapiens
cagtgctccacatgaggagtcaatgagatatttcatcaaaagcatggagcacagcgtctgccccagttcagcagtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaa

SEQ ID NO: 127365 - DNA, 2763 bp, Homo sapiens
tctgagggagccggaagatagacggcgaagctgaatcccacagtactgagttcagcagaggttaggaactctggccaacctcacagaggggatttcatgtgtcagtgtcagtggtcgagaaataatgaaattggaactgaaaagtgattgagccggtacctgttactgtgggtgcaaaaggctgcgatacacgtgggatttggctcgctgaagctggaaactgtttggattcttgtggagcactctgacctctaactctctctatcatctctctaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaa

SEQ ID NO: 127366 - DNA, 1161 bp, Homo sapiens
cgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagcataatcaacatactgttctacacttggcttttttccagtattctatctgggtatcaggagattgttccatatcatacagagaatgcatgtgtgttgacgagtctgtaaagcccccaggatcaggcagaacgtacccagcaggttatcagagaacattcggttggcaggctggggaggatggggtcaaggaggggactctccagcagtgaggagacagcagcaagcagggaatctgcagtcagccttcgcctgagcggtttcactgagcactcgctgcacactgaggaatgctggacaggagggaaaaacctctccttaggcccatgcaattacagatatcccctggctgggtgacttcgaaccctgagaccaaccagtcacaacactttccccagggaagaggccagtctggaggccaagtgcaaggcagatggtccaaaggccgtggttctcaaggccagggccccgctctgctcatccttcatgaataaccccaagaggctcccttcacaagctgttgtga

SEQ ID NO: 127367 - DNA, 620 bp, Homo sapiens
cgccgggaggagctggcggcgagcgccgagccgggcgcgcagcgacggagctggggccggcctgggaccatgggcgaaggcccgtgggtgtgaagctggcagtgcggagcccaccctttcaaacgggatgcgactgcggtcgggcttggcagtaacttaccctcctcagagtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgccctgagctgtagccccagtcccctttgacatcacccattttccaatggaggaagcttccagggagacagggtaccacttggagagcccccatggccacttcagattgcagccattgccacttcatctcacctgaggtgctgaggggagagtctagtttacagggcatccttttgtcacctgctcgccacccttatgcccctgggtgtgaccagcttcctcagaaagagctgtaatcaatagcatattgattaaaaagcatattaagatgaaaa

SEQ ID NO: 127368 - DNA, 966 bp, Homo sapiens
cgccgggaggagctggcggcgagcgccgagccgggcgcgcagcgacggagctggggccggcctgggaccatgggcgtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgtgagtaagagaaagggaggagagggagaaagagacatactactatctagaggtgggtgggagaaaggataggagaatgttcaaggtcctgaaaattcatagggggagattttggccccagaacctgtccctggacaaggttcctggttggtggataaggaagtgtgcccacattccagtgtaggggttaccagttaggagcaaagtcactgagataggaaaaatgaccccatgggaatctgaaatccatttgctgggcccatcattctggttttgagaaggccttgaaagccagctgagacttgggcttagcacggcaggagagcactgagctgtttgaagtttttgaatgaggtgtgtgcccttttggaaataatggcttgagcaagattggtctggggtttggcctgggaagccactttaccatggcttaatttataggccctgagctgtagccccagtcccctttgacatcacccattttccaatggaggaagcttccagggagacagggtaccacttggagagcccccatggccacttcagattgcagccattgccacttcatctcacctgaggtgctgaggggagagtctagtttacagggcatccttttgtcacctgctcgccacccttatgcccctgggtgtgaccagcttcctcagaaagagctgtaatcaatagcatattgattaaaaagcatattaagatgaaaa

SEQ ID NO: 127369 - DNA, 402 bp, Homo sapiens
agttaatgattaaaaaggcatggaagaagaactggatggcggcttggggagtagtttctgcagtcaggaggcacccttcacctcattcccttggcccacagtcatctgtgcatgcgtctgcccctccctccatcagtggagctccctctgagctgcgtactcgagggtggaggagagtttgggggaactcaaacatgtggtagtagagactgtagtaactttaaaattctctttgtatttgcagaatcatttccccaatttacacactcatgtttcagtttacagggcatccttttgtcacctgctcgccacccttatgcccctgggtgtgaccagcttcctcagaaagagctgtaatcaatagcatattgattaaaaagcatattaagatgaaaattattg

SEQ ID NO: 127370 - DNA, 3356 bp, Homo sapiens
cgccgggaggagctggcggcgagcgccgagccgggcgcgcagcgacggagctggggccggcctgggaccatgggcgccctctcccgcacggcccccgcactcccgccgctggattccagccgagattcaagctcccgggatcccccttcccgggcggtcctgagccggctagtctccagtgagtgcaatctacggatcagtctctgatggtgggtcgttaacctcagtggggactccaagatttccatgaagaaaatcagttgtcttcattcaagaattggggtctggctcagaattcctgcagctggtgaaaatctgttttctagaagaggtttaattaatgcctgcagtctgacatgttcccgatttgaggtgaaaccatgaagagaaaatagaatacttaataatgcttttccgcaaccgcttcttgctgctgctggccctggctgcgctgctggcctttgtgagcctcagcctgcagttctaattggaaaagaggtcaaaagaaggtgggcatcagaagtttaaaaatattccagatggcaaatgaattgtaaaatctgaatcctttccaaaaagtgtgtccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaa

SEQ ID NO: 127371 - DNA, 3018 bp, Homo sapiens
cgccgggaggagctggcggcgagcgccgagccgggcgcgcagcgacggagctggggccggcctgggaccatgggcggacatgttcccgatttgaggtgaaaccatgaagagaaaatagaatacttaataatgcttttccgcaaccgcttcttgctgctgctggccctggctgcgctgctggcctttgtgagcctcagcctgcagttcttccacctgatcccggtgtcgactcctaagaatggaatgagtagcaagagtcgaaagagaatcatgcccgaccctgtgacggagccccctgtgacagaccccgtttatgaagctcttttgtactgcaacatccccagcgtggccgagcgcagcatggaaggtcatgccccgcatcattttaagctggtctcagtgcatgtgttcattcgccacggagacaggtacccactgtatgtcattcccaaaacaaagcgaccagaaattgactgcactctggtggctaacaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggagttgtgcagcatttgcagaacggtcagctgctgagggatatctatctaaagaaacacaaactcctgcccaatgattggtctgcagaccagctctatttagagaccactgggaaaagccggaccctacaaagtgggctggccttgctttatggctttctcccagattttgactggaagaagatttatttcaggcaccagccaagtgcgctgttctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaaggtaattaagacccatcagatcgaggatgaaagggaaagacgggagaagaaattgtacttcgggtattctctcctgggtgcccaccccatcctgaaccaaaccatcggccggatgcagcgtgccaccgagggcaggaaagaagagctctttgccctctactctgctcatgatgtcactctgtcaccagttctcagtgccttgggcctttcagaagccaggttcccaaggtttgcagccaggttgatctttgagctttggcaagacagagaaaagcccagtgaacattccgtccggattctttacaatggcgtcgatgtcacattccacacctctttctgccaagaccaccacaagcgttctcccaagcccatgtgcccgcttgaaaacttggtccgctttgtgaaaagggacatgtttgtagccctgggtggcagtggtacaaattattatgatgcatgtcacagggaaggattctaaaaggtatgcagtacagcagtatagaatccatgccaatacagagcatagggaaaggtccacttctagttttgtctgttactaagggtagaagattattgctttttaaaggctaaatattgtttgtgggaaccacagatggttggggttgaacagtaagcacattgctgcaatgtggtacgtgaattgcttggtacaaaatggccagttcacagaggaatagaaggtactttatcatagccagacttcgcttagaatgccagaataatatagttcaagacctgaagttgccaatccaagtttgcactcttctggcctgccccatgttactatgtgatggaaccagcacacctcaaccaaaatttttttaatcttagacatttttaccttgtccttgttaagaatttcttgaagtgatttatctaaaataaaggttggcaaactttttctgtaaagggccagattgtaaatatttcagactgtgtggaccaaaaggccacatacagtctctgtcataactactcaactctgtttctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaa

SEQ ID NO: 127372 - DNA, 612 bp, Homo sapiens
ggcttggaaaggcttcctgagatgatgatgtctaatctgaatcttgcctaaagaattatttatttagtatccattaaaactgtggaatctttgcttcatgctgggaaattaaaggagaaggcagtgtctatctttgagggggattgttgtctaatttaagaaacaggttataaaacacaccatgtacacacaaagtggaatagggtatagactataacagaggtctaaaatttgttttaggaaaccaaaggaggaatccagatccttttggagggagttaagaaaggtggcctacccaagctgctattaagtgtattagcactgtgaatagagagatatgaagatatgtagaggaaggagtgactaattttgcctggaagagggtagaaatttcttaagacttcatggaggaggtggcatttgatctgagcactgaaaattaagtggaatgctcccaggtaggaagagtgaaataagaacagaagaaaatcccaagaagatgagatagcatgaaccaatgcttggggttgtgaacagctctggtgtatttagagaaagaaggtctactttggtttggctggaacttgcggggcactgataatggtttggatg

SEQ ID NO: 127373 - DNA, 621 bp, Homo sapiens
tatatgtctgttcttctattgagttggcaaatacaatgtatgtcttcaatgcaggtaaatacggtttaagaataatgttttaagactgaatttatgtttatggttcaaatcctttccctactatttagactaaaattagcaaatggactagaatatcaacatcttatgaaggtgaccaaatttcattttatcttcatctctagtcagtgattaagaacattcccagagtaaagtaattcctagaagaaactgagggtaaaattaaagaataaagggaaaataaaaacagtaatgagaaccctcttcttcacaattccagttcattcaattcttattcccgaaggacaatcaagggtaagcaagatgagtatagtgatgggacataataattggcttacacagattataaatgatgcatcacactaattaaactactaggcacagtggtacatgcctgtagtcccagccaattagaagtctggggcaggaggattacttaagcccaggagtttaaggccagcctgagaaacaaggcaagatcctctctaaaaaaaaaaaaaaaattagccgggcatggtagttactaaggaggctgaaggaaaaagattgtttgaaccagga

SEQ ID NO: 127374 - DNA, 826 bp, Homo sapiens
ccagagggtaactattatttttaacttttaaaaagcatataattgtcaggttgggcaattattatagggttgaggattgcctcatgtgtgaccttcctttcctattctacctacatgtctagttctctgtgttagtcttctgtccacttaaaatatcaattgaacagtaagctccacaaaggcagggcatagtatatacttactgagtatttcttgaacaaatgcacgcacatgtacctgtaattacccagggtttgggaaactagattttaaaaaatattttgaagggaaagggttgttactggctatacttaacttttaattttctccctccttaaatcaacatgttattcttcagcaatgatgtttacaaaaccaaataaaattagaattaaccatttgtttcccacttcagtgagtccgtacccagtggggtgatgtcactgtcatatttaggagaggccagatgatataattgcctttataactttctgttacaatttaaaagagcacagtgacttactaccagaaaagctttgtaccatcatattcttgtttatatgtagggaccacttaaccaagtggatacttttgtttagatttttaaaagttttagtttcatgtcttctaaactttaaaaatatcatcttattatatgatttattgttttgatctctctctatatatatatataattttatttttttgagatgcagtcggagtgcagtggcatgatctcagctcactgcaacctctgcctcctgggttcaagcgatcctcctgcctcagcctcccaagtatctgggattacaggtgtacacaacca

SEQ ID NO: 127375 - DNA, 287 bp, Homo sapiens
cggcctgcctcaggcaggaaggcctgcgtgagcctctccaacaatctgagtgaggcctaagcatgccaaggggctgaaggaatcagcgggtgatgcctgagaccacgcacactgaatcgacatcctgctgaaatcagggctccccgatgtgggccctcatctgggtgccacggaaggttctggtttaaatctacagtgtatgccttgaagctagggagaccccaggcagcatttcccaaagagcagcttccggagccctgagcccatgagatgctgtccatgaagtg

SEQ ID NO: 127376 - DNA, 3245 bp, Homo sapiens
gtggagccatcgaggggcacagagctctccgggattgggggtcagggcagcgatgcagatagatctccagtttgggacagagggagaacgattggatggactctccccccctcccaccccgcccactcacacactcctccccaccattactgggcaccaagactgggcatcagctgccgcgcggaccagcctgggcggagccacagcgcggggactgcttagcacctcatagtggctgctgcgtgctcccgagctcctgctcccagcgcaatcttcctggagctcccctacggtcggtgcctacctccgcccccaccaccccgctaattcccgtgcaaattccaccccagtaaccactttcagcggtcttcccacccagcttgcactccagcccatttcctgaacagtctcccttgcagttcccttgctgggtattttcaatcccatcaactttcgaaaataatctctactcactcttccattccatcaacctttgcgtgaacttctgtcctgagtgcgctgtcagcgggcagtcaagacagcgccctcccagctaaaaaatctgaccctttctggggagctcccttgcactagccttcgtgggggcctgcccagggagccccaagtggaggctggattgggttgggcctgagtgagactggcaacttccactttgctccagagagccggagttgggccccagttgcccactgggaacgccactgaatatatgggagggctgtatacgaaggcggggacccagcatggccagggcagcaaggggcaggtctgggagtgagggaatcccagcagtacatccttccacctcatcccacctgccccggcacttaggcctctggccacctgcctcccacaattccacaaccagggtctccccactaccaccctctctttgtttaaccatttcaacctaaagctcctcctctgggcccagtaacacagatttggggaggaggccaccctagaaatggctgcttaacagttaactgggaaaaaattgaagtgtttgaatctgattttatattgagtgactttttagaagtcacatgacctctctgagcctatttcatgtttataaaatagtgatactaatgtctgtttcaggggggtttaagcaaatcaagcttgatgtaggagaagccagtttgtggggcattgaacaaatgtttggccttttcccacgccacaccacggccatcataataaagccctgtggccagtcagtcccggctccatttctcacttatcagcagctacctaactactcacctttatggaactagctgcttgttaacaagccaaacgtacgtttacattcacaaccttttgctaatatggcatttagatccctaagactgtccgtctcacaattgtctggatcacacataaacataactggaacgtgaaaagcagatgaggcagacaggcctagcttcttaccaactttgtaatggggaaaaagttgtttactcccaatcctctgtttctttgtctgcaaaatgggggaaatagtagtgcttaccttattggactgagtaagaatacacataaatcactttgcagtacatgccagataggagctcaatacttggtagtggtacctagaggactggcaagcctatcccccaacatttgaaaacacaggctcagaagaaaaatgtccctgttctgtaaaatggataggggggacggtagcctaataattgtctagaattatggatcacttcctacgtgccaggggctgggctaggcgctttacacgtgacatcttattgcatcttcacaataaaaccagggagggaacactttttccattttaaagaagtaagtgttgacctaccagaaaacaaaacaaaacaagacaaaacaaaacccagggaaataagtaccattattaccctcattttacatatgaggaaatctaggtaagggaggtaacatagcttacccaagatctcacagctagtaatgggactccaggactttgcactccactgcagctctctaaagccttccagaattggacctaggactgtgacttgcccaggtagcggcagggcagggattaaaaccctcagctccctctactccctcctgcctcaatgctatttctaccaccctttattactttacaacagaaaaccttaagacagtggtttttaatctctccacagaggagttctcttgtaccttgattccatccctactcctctgccctaggtccccagggccctacctctgagactccgtggtccctgggctgccggtacaaggaggtgttgcatacctgtgcactgactgccttctggggctggcagaaggaagctactctgacctgggagttgctgaggaaggagtccaaggggattcctgtccaggggagactgtttgagctgtgtaccctccaggatgctgggagtcctggagcttcccattgtaccccctgatgtctgctggctgccatcgtggctctcatttggcactgatatggacagggctgcctagagcgaggggttagaagtaccctctgagccagacatccctttttcctttcctgtcctcctttaagggttataaactattctgaccatcagctatgtaggagtctccacttttctctctgaatggccagagttcaggtggtgggtgggaaaaagggaggtcaacttcagacacctggagagttaagagatatgccaactcagtagtgggctagtactctcttatctaggtaccttcctttatcctttggaaatagatttcccacattcctaagatcatctgaaaatctctggccaatgctgggcacagtggctcatgcctgtaatcccagcactttgggaggctgaggcgggtggatcacttgagaggccaagagttcgagaccagcctggccaacatgatgaaaccccgtctctatgaaaaatacaaaaattagccaagcatgatggtgccaacctgtaattccagctacttgggaggctgaagtatgagcattgcttgaacccaggaagcagaggttgcagtaagctgagattgggccactgcattccagcctgggtaatgaagtcggagtgaaactctgtttcaaaaaaaaaaaaggccagttgggcttggtggctcacacctgtaaaatcccagcactttgggaggccgaggcaggtggatctcttgagcccaggagttcgagaccagcctgggcaaagtggcaaagccctgtctct

SEQ ID NO: 127377 - DNA, 335 bp, Homo sapiens
tccaggcctccacctcccagctcatcaccccctggagcatctcggccctgcccagtggtattttaccaccttccatttgaggggatgcggtggagcagagattgtgttgtattcctctctgtccccacatttagcagagaagatgactgaggcgatatcgttcctcattcacactcctggcacctggtgatctcttagaggcatgctcagcctggactgaacactggtgatcacactagactcaacaccccacctgtcattcctctagttatctctagtcacttataatgatgtgccccagatccgatcaacttggcattcagtagttcaccata

SEQ ID NO: 127378 - DNA, 296 bp, Homo sapiens
gagccagccctccctgggttcaagcccccttaccagttgggtgtccctgggtatatctcttcaatgacaggacctcactttcctcctctgtaagctgtgggtacaagcatctctccttcctaaatggttattaggattacatgagctacacatggaagctgttcgggctgggacttggaggtgtccgccactgtcccaggcatctcaggtgattccttgctggagagcccagctagatgccctccctgtcgtttgctgtttcctgtaaatggtttctttaaagttctgcggctcag

SEQ ID NO: 127379 - DNA, 333 bp, Homo sapiens
agagtaaaaccctgtctcagttaaaaaaagaatgatctcacgtgcccatcgcccagcttggcaaaggttaatgatgtgtggccagtcatgcttcatctgtgtccccacccttggccaccaaccagatcattgcttctgaagtatttctaccagacagatatcaagacattttatccaatgttacaagtaaggaagctggcctggcgcagttgcctataatcccagcacattgagaggcctaggcaggtgaatcacttgaggtcaggactttgagactagcctggccaacatggtgaaaccccgactctactaaaaatataaaaattacacttt

SEQ ID NO: 127380 - DNA, 453 bp, Homo sapiens
gagccatactcctttcctcctcagggctctgcctggaaagttctctgcatgccttcctcgtctagcctggctgaaacactgcttcctctgagcccacgcgcccccctggctggattcctgttattgtcgacagtctcttagcaccacttactcccccccgcacaaccccccagagagctggcatcaatgggttatttgtgagagtctctcactgtctgtctcccccagtgggacatgggctccgtagccccagggactgtccatcttgtttccactagatccccaggacctggcacatagtaggcccttagcaagtgttagatgaatgtgccaacatatgattgtcattgccctaattaaacactttccatttcctactgcccctgggatgaaatgtaaactcctcagtgtggcaggcagttaaggcctgcaaggtccaacagaaacaattcc

SEQ ID NO: 127381 - DNA, 500 bp, Homo sapiens
ctgtgtgaagacagattctcttctccatatgtaatgccactggcaatacaaagtttttaatcatgggagaagctgacagggactctggcctgaataacatagaggttcctctttagtggtttccaagagacctctggggcctgttcagttcctggaggaaacagtccaataagggattgggaatttgcactcctcctcacttctttagagcgcatcaacccttcaagggatttctgtctgatgccccattttcctggtgatggggagaagatgggactacttgctggtggtgcaggagtgtgtgacactgtgctgctgcttgcctcagacaaaactgcttacaagggactggcagagagacggggctttccttgcttagcatcacccatagagtagagctgaaggaggcttcaaccctgccttttcttgggaagtcttcatgtattcaggaaagttttcactctgaagcaggggaatgtaggggccctgactgtgactga

SEQ ID NO: 127382 - DNA, 280 bp, Homo sapiens
ctcgtgttggtgccaagtcagtgctttcattgtttcttactgagatcgggtctagatgctctgtgaacaattgtgcttatggttatgtagacttttagaatccttggtgattgtcattctataattctctcctgttattttaatttaaagtaagtcttgaggccaggtgtggtggctcatgcctgtaatcccagcactttgagaggccgaggcgggtggatcacctaaggtcaggagtttgagaccagcctgaccaacatggtgaaaccccgtctcaact

SEQ ID NO: 127383 - DNA, 226 bp, Homo sapiens
cgtgagggtcttgttataataaaattaacaattaattactttcttttctccttccttcttgtcttccatccatctccttccatccatctccttccttccttccttccttccttccttccttccttccttccttcttacctatctacagcttagggaaaaagatgggacagattactatttagctttaggaaagtcttattttcttttattttaatttaatatttaa

SEQ ID NO: 127384 - DNA, 182 bp, Homo sapiens
tcctgactcttctctatatgctatctcatctcatgcgggtaccgtagctcgatattctgtgatcactgttcgctcaggcgtgtcaaagcatcccaataggaagcagacggcatgctcaaactaggacagttgtaggaggacctatttttaaaagggcctagttacaaaggggaattgcaaag

SEQ ID NO: 127385 - DNA, 451 bp, Homo sapiens
gatcctgattaagaggaagaggaagggttgatctgaagaacatagtgctgtggtggaggttgtgtagagttccatgaggtcactaagggacctgggaacacaggatattgggagagctgggaaaggggaatagggatgagatgcgggagcatgccaaagacaaaattactttgttgtcaaattttgcccacaaaaagaagagggattccacccctccttcacccagtcttgccctgtctcctttattcagctgcactgctggatgcttgcctggttcccagcctttaaggtttttagtctataagttcaacgttgttggaaacagctggcttcctttgggcaactttaaaccccccttgggggccaaagcgaaagggggttgggggcgcaagcaaacacgcgtcgcgcgcggccaggtcccttcctgctaagcgcagaatgcgcaaagggc

SEQ ID NO: 127386 - DNA, 762 bp, Homo sapiens
cactcatattattctcaaaattagttcatttttattattgagtagtatttcattgtactgtagggaggggaaaaactccctcccatcttctcagggtcccagctggccttgaagattaaattggcataggatagattaacaagagaaaagcatataaatttatgtaatacaaattttatgtggtgcaggagccctcataaagaaataaaaccaaaagaagtagagtcagttacttacatactgaattggacaaagactagtaaactgtgaaaatgtgactgtattttgcgggagccttaaaaaatagttattctaacaaggtctgtacaatattctcctggtctcaaacttctcgtcattgaagataaagatgtttgttgccttttcttccagtatagagagtgtctttcacactggaatccatctcctgctcttaagaaacagcacaaaggtcaatcacctttttgcacctgctgtttttcatgtgtctttaatttaaatagtatgccggaatggcatattttaaccccttcagtatgaatgtactactatacttcttctactgttactagatacttgggttgtttccaagttgtttttatattctcttgttggtaactatttgggttgtgtagatttttgtggtttgcttttgctgttgcatgcgtgttgtcgtgaacatctcctgtaagtgtgccagaatttctccaggagtaaaaatgctgagccatcggttgtgcacatgtttaactttccaaagtg

SEQ ID NO: 127387 - DNA, 881 bp, Homo sapiens
attgaaaaaaaattcagagtaaagtaacattagaagctgaaggtcaaggaaaattcccacaaaataattgtttttggctttaataccttccttaggaattatggttagctatggtttctcctgtgagtcttagaaataatttctatttcctcggaagccaaagatttaccaatattttcaattattctgaaattgtatgtgcaataagatttattggtttttatgatgcagataaataattatatgtcccatctcagccttcaattcaaacttttaaaatgtttggcttaaaaaaagaactctcaagcttctctcttcactgactcattttaaatgccctatataatgtgaacgatctcagttcatctcccgggatcattttaactaacacacattgtgcccttctccattttgatgagtggtaacagccaaagcctcagaagtgcgtttttgttgttacagtcgcttctattctcatcaagtaggtaaggtcaaattatatcgctgtcctgggagtcatccttttcatcacttattgcgtgtctctttgttgggtgagtaactccatttattaaactctggaataatgatttatggaagaaattgtggcattgatgagtgggcattcacttcgagaatcttgatgtgttgggatgttaaaaaggtagcaatcttgttttctcttttgttggcatgtctattcttctgactgctaatgcaactcaggtagaattcacatctcagtgtttaggttctcctttaggaaatactgtgaaaggcctagtggcttgtagtttcttttctttttttttttttcatttttttttaggagaaaaatgaaaaacatctctgatcacttctctagtgtttgtttatgaccc

SEQ ID NO: 127388 - DNA, 703 bp, Homo sapiens
gaaaaaacaatcctaaaatttttacggaaccacaaaagaccctgagtagccaaagcaatcctgatcaaaaagaacaaagctgggggcatcacactacttgacttgaaaatatattacaaagctgtagtaaccaattcagcaaggtattggtataaaaacagacagaccactgggacagaatagagaactcagaaataaatccatgtatttacagccaactgtttcagtaaaggtgccaagagcatacactggtgaaaggacaatctctttaataaatgatgctgggaaagctggatgtccataagcagaagaatgaaactagacccctatttctcactttatgcaaaagtcagctcagaatggattaaagacttaaatgtaaggtctgaaactgtaaaactacttgaagaaaacataagacaagaagctacaagaaaacaagaaagcttaaggacattgatacaggcaaagattttatggttaagacctcgaaagcatggataacaaaaacaaacaatagacaaatgggaatatattaaactaaggagctactgcccaacaaagaaaacaatcagcagaatgaagagacaacctgtagattgggagaaaatatttgcaaactattcatccaacaagggactaatatctagaatgtacaaggaactcaactcaaagacaagaaaaccaaataatcctattaaca

SEQ ID NO: 127389 - DNA, 327 bp, Homo sapiens
gcaggggaatggaatggaatggaatgcaatggaatggaatcatccggaatggaatggaatggaatgcaatggaatggaatggaatggaatcaacccgagtgcaatggaatggagtgaaatggaatggaatggaatggagacaaccagaatggattggaatataatggagtgtaagggaattgaatagaatcaatctgaatgtaatgaaatggaatggaacggaatggaatggaatggaatggaatggaatgaaatggaatggaatgcaatggaatggaatcaacccgagagcaatcgaatggaatcgaatggaatggaatgcaatgg

SEQ ID NO: 127390 - DNA, 193 bp, Homo sapiens
agaagtggcttttctgcagattgctgatagtggctagcgtttgcagagtccttgtagcctggagccaacagaggtgatatggaagcaaccatgtgtgtagggccttgtgtactggagcagtaagggcttccctctccgggggctctccagctcagtgattttatggattccttggcccctttgttccttggtg

SEQ ID NO: 127391 - DNA, 317 bp, Homo sapiens
aagcaaattggaggggccaggggctgggcggggggaatggggagtggctgctgctgggtacccggtctcctttcagagtgaggaaaatgttctgggacgagacagaggtggaggctgcacaatgatgcacgtgcactcaatgccactgttcacttttaaatggttagtttcatgttacatgaatttcacctcaataaattattgtttaaaggggtgaggggtaacaaacaggccccacatacccatcaaaataaaaacagtcgggtgggaggagcaggagaggttccccacccctcagagggagggcctaatgtgag

SEQ ID NO: 127392 - DNA, 631 bp, Homo sapiens
gataagaaaaattaaatctgctaatctttgcttagttactattccaccctaaaggtggaaagaaagctatcctagataaggtatttataaaagttaggccgtcaggtaaaataggcttgcttcttgttccgacctatccatgcgggaggccagccatagaggatgcttttttgactctgttccctaatgggttccaccctgaactcagtaattttaactaagaaacagtggttacattaaaaaggacaccctattgaaataaaatgcacctttctggaatttaattggctaccttgaaactcttttgtaaaggaaatttacatctataaaggaaatctcaatttgtagggatgtctgccaatgtacaatagaaactctaacctttttttaaatttaaataatcagtaatgcctttgtttaaggtgcttttctgtctatcttaagtgaacttttacttgagcagtttttttttttccctgggtttgagcaaatgatgaatcaatacttaggccgagaatcttagctctgtgcttatgaaatatacatggtttttttgtttcacctaagggattgtgtcaatttccctctcatagcaactgggaattgtggcaagttctctctttagaaatgc

SEQ ID NO: 127393 - DNA, 175 bp, Homo sapiens
atatatcttttagtggatatgtggctttctaatatgctaattagtccctgaaatattagtcactagttaatattcaaacaattaatatagagataacaataatctattaattatctgatcccttatgtttctcaagttaatgacagtagcaacttgataagttttgttccaacag

SEQ ID NO: 127394 - DNA, 710 bp, Homo sapiens
gctaactgctcgacttgcctcttaacagctctcacatcccccaaatgacaatactagcagccgtagtggtgaagactgcgtgtctcctgtgggccagccacctgccaggcacttgtttggttctgccagtcttgtcgtcagcctgaaagggaggcttggtggtcactgtttttgcagaagaggatgcttgggcttagggaggttatacaaccagatggtgagttgtggagccagcccccgagttgtgtctgttggattctacagtgcaagctgcaagcttttcccatactccagctagttgtcctttccttttagctcttacttggttctgggctacagaacctgctagtctgctgagtctgctttgttagacagccagcaagtaggtctgttagtgagggtttgggttctgtgcataggtttgtaataactctttgcagtgcttggagtcctttttgattcccttccttgcagctttggggcagtattaagttggtctgtgtgtggcagtgtctctttttttccctttcatggtttaggattatcacaccacatgtcagtaattataaaatgcagggctgagctcaggagccattgtgctctatgtggctgctaatccccatgctaaatggcaccaccaaggggccttttatgttcttgtctgttttcatagttaaacattccccccacccccaggccttcagctgtgt

SEQ ID NO: 127395 - DNA, 365 bp, Homo sapiens
gatttggaaatccccaggtcacataaggttacatactatacgctgcatttttaggtttaagtcttgcaatggctctccgcaccagtaaactcacaccatcaatcctttcgacgcgtacaacaaaggccaaggaatgtttatctggcgattccaaggtgtgaggttttacttctagtcgtctgagacacaccttgtcatgtttctgccgccaggaatcatgtaggaatgattccagtcgtttaaacctgagctcttttccttccctctgctcctcctttgccaaaagtgcctactttgactgggtggctttgaggccttgataagccttctgctttcaggagattttctggagccaaagggatttt

SEQ ID NO: 127396 - DNA, 301 bp, Homo sapiens
ccaaaatgcagctagaactggcttactcctctccaccccattgctacccccacagccactctcttctcttgccttctgtgagtcatcgcagttatctattaaaggaaattgaatagtgtcactcccgacactgttgatactagtcagtcaacagacactttctaaaaaccgagttacaggcactgggaaaacagcagtaaatgccttcgtgaagcttgtattccagcgtggaagagagatgataagcatggaactacgcgcagcagggaattcaggtccagagcaggactacgaagaagac

SEQ ID NO: 127397 - DNA, 281 bp, Homo sapiens
aagttgacggccattgttctgtctggttctctctggactgagggtcctcaaggagacattctacatctttctttcaacaacacacagggacacctgatacctgcctgcactgtgcccatccagggatggactctcggactgacgttccagtggggagacagatgatgaacacagagatgaataaactatcgagatcattgcagaattatatgtgctttggagaaaattaaataagtggggtagagagaatcctgcacgtgtggttggggcagaaggtctgc

SEQ ID NO: 127398 - DNA, 678 bp, Homo sapiens
actctctcaggggactctacaacgtcacgttttcttaactatttaatttgtaatgccttctttattttggggaaattacaaaatagtgacacagtctccccagcccaagaaggaggagattttttttccccagtagggcggttgttttattttgactatatagtcttccctagaattgggggaataaatattggtatggttttttaatattgatttccctgggtagattatatttctgactgtaaaatatattattggatgtgcttctcaaatagattttacataatcagagaaattttgaccatgagcctaatttaatacttttttgctccttctgagtttacataaactttttatttttccatggagtttatcagaatcccaaatcctctgcttcagtcttcctttcatcctgatcttcaggatatttttcctggagttattattgttattttatagtatctatatagctactattttatagtagtatctactattttataatagattgtcctggaaaacctaccggtgcatgagagaaaagttcaaggctaaacttaaaggtactgggtagtcaacagctcatgtctctatcagaaaatgatggagactagaaagtaacatacatgagtggttatcattttaaaactagagaaagagtcatggaagttggtaggg

SEQ ID NO: 127399 - DNA, 186 bp, Homo sapiens
cagtggtgctagaataatgtgtggcacacagcaggtactatgcagcacttgctgttagagctgctccgtattgcccactgaactgtgcatgcaggttgacctggtctgtctctttaacccgtgcacctgcaaagtgactagagcatagtcgttgcacaataaatggctgttgaattattcaaacta

SEQ ID NO: 127400 - DNA, 473 bp, Homo sapiens
caaaggaccaagatgtgtatggttttcaaaagggaaaaaagtgaattttgtaaaaagtgaattttgtagaaagcaagcctgacaagagtttttcctgaagggttttacgtgtgggagagtacacttactttctaacctcagaggatagagctagggccaatatgtaaaagtggtggtcaatatgagaaagcaacacatagagttgctcacaaatgtaagggattattttggggaagaaatgagtttcccattactgatgatgttcaagcagaaacaagattacttacttagtgtgtggtgtgtatatatatatatatatatgtgtgtgtgtgtatgtgtgtgtgtgtatgtctctatatacacacacacttttggggattttttgagatgaagatttgctcttgttgcccaggctggagtgatctcggctcattttgctcttgttgcccagcaatggtgcgatcttggctcta

SEQ ID NO: 127401 - DNA, 882 bp, Homo sapiens
gttctgatctttagttattttccaatgacagaagttggagattaatcatttttcttctactcctaatgttttctcaattggaagattaaagagatgtcaacgaagtatcacctgattatttatcaagtgattgttacagagactgagtgccctcaggattacatatctttttttttctctcccacaattgtcatgattactagccaaatccaattagagagatactagagaagtactgagtatttactgagtacttacacattgtatatgtaatacaggtttcatagataatcacctctttagaaatgactggactataaagaggttggctaatgtattcaagatcacaccaataataaatagtggagtttgattttaaattgatggctgactgactctaaactcatgctttttcacattgcttctttcactcaacctaaggaaattgccaaaagttttggtcagaagctaacctcactttggacttttgagaactccaagctgccagccctgcattgctgagtcaatcaataaagagctttctttggacccattaacaaagagagaaagacaagtcttccacaccagagagcagagagcgcgagccacaacgatacgagcccggcacgggccactggacacacgagaaacaagctctggagggcgccggcgccctcaagagagtcttaagcacccgtgggggcgcggcggcccagagggtcgatagaagccgctgcacaagcgcgttccgcgagaaagcgctgtggaacacacagggcggggagctcccagagaaaaagccgggggggaaaaagcgtgtgtaacaccccagagggagtagggagcgcacgggggtacaccacgggggcatcaggcgcgaaa

SEQ ID NO: 127402 - DNA, 514 bp, Homo sapiens
catacactactactactagatcttgcccagcagacaacaaggagccatcgtgaaggctttccatctggagaatggctatggcagagatatgttttagaaagatggcctagctgggtgcggtggctcacgcctgtaatcccagcactttgggaggctgaggcgggtggatcacctgaggtcaggagttcaacaccagccttcccaacatgatgaaaccccatctctactaaaaatacaaaaattatctgggcattgtggcgggagcctgtaatcccagctacttgggaggctgaggcaagaaaatcgcttgaacctgggaggcagaggttgcagtgagctgagattgcaccattgcactctagcctgggcaacaagagtgaaactccgtctcaaaaaaaaaaaaaaaaaaaagaaagaaagaaagacggcctggcagaaggggtggaaggactggagtacaggaagacaagtagtccagacaactggtattcagggctcaatttaagatactgaa

SEQ ID NO: 127403 - DNA, 116 bp, Homo sapiens
ctaaagggactagcttgggctgaagcctcctcttcacacagaccactccatctttgtagcctagagtttggcacagaaccccaaagccctggagaggaacaagggagggattacag

SEQ ID NO: 127404 - DNA, 1097 bp, Homo sapiens
gcccatggagtgcagtggtgcgatcttggctcactgcaacctctgcctcctacttcaagcagttctcctgcctcagcctcctgagtagctgtgattacaggcgcctgccaccctgcccagctaatttttgtatttttagtagagatggggtttcaccatgttggccaggctggtctcaaactcctgacttcaggtgatccgcccacctcggcctcccaaagtgctgggattacaggcatgaaccactgtacctggcctctctatttttaatcatgtattttttcagcaaatacttaatgaataccaactacatcccaggcattgttctaagtgctcaggatagagtagtgtacaaaacaaaacccctgcctactcagaggaagacagagtaaatagataagagtaacaggaatgtgtgttagatggtacgaaccatcagtttgggaaggggatagagaggaggatggaaggggcatttataggtgggtaggtagctcaaggattctctctgaagaggtgaggccttactgagcagcagaaactgcaagcaggcttttgtggttagatgcgcatgtgtgcagtggagagtaaagaaagatgaggccagagtgtgtcggagcagattgtgtaagattttgtgggacctctgttttagtctgttctcacattgctatgaagaactacctgagactgggtaatttctaaagaaaagaggtttgattgactcatggttctgcaagctgtacaggaagcatggctgggaaggtctcaggaaaccttgaatggcggaaggcgaagaggaaggtggcacgtcttacatggccagagcaggaggaagagagatggggaagtgccccaccctttaaaagaaccagatctcatgagaactcactatcacaacagcagcaagggggaagtccactcccatgatccagtctcctcccagcaggctccttctccaacactcatgaaatttgggcagggacacaaattcaaaccatatcattctgttcctggcccctcccaaatctcatgaccttctcacattgcaaaatataatcagcccttctcagcagtccctcaagtcttaactcatt

SEQ ID NO: 127405 - DNA, 203 bp, Homo sapiens
cgggaagggtgcttgcacccaggaaatcgagtccagcctgggcaagacagtggggccaccatctcactatcttagctggctatggtggtgcacgactgtagttccagctacttgggagactgaggtgggaggcccacctgagccagggaagtcaaggctgcaaggagacatgatcatgccactgcactccagcctgggtgaca

SEQ ID NO: 127406 - DNA, 336 bp, Homo sapiens
gtgctttgtgctttgtgcatgtggtaggcagaacactaccatatgtccccacatacttacactagaccttggagcaagagcaagaacagcaaaagcacagcgcttttgaacccaaaagacaagctcccttcttcctgcgttgtccctccagctgcctctgctgaccaggtttagcatcatgtgctctgtaaaggaggaattctggagagtccagtccattattacagagctagtactgaagggtgagtttggagttaagaggcaataaattgataactggcacagaagccaaatataagagtattgactaaataatagctaagtacaagaacacag

SEQ ID NO: 127407 - DNA, 463 bp, Homo sapiens
cagagggaacagcaagtgcaaaggccctgggatgggaacttaacctcatttattaaaggaacaccaaggaggccagaatggctggagaatagtgagcagggggaatggtaagaggtgatgtcttcatgggtaatgcatgcccagtcactgctgggtttaatgatgatgataatggtgaggtaggcagagctgttaagagttttttgagtagaatggcaggctggcagctgtcactgctttctgcaaccctgtgcagttgtagcttctcttgcttttcactagcaggcccagcccagtatatctcttggtctctgacccattgctgatgtgggcagaggcaccctgacagcttcacacccattagctggcaggtagaaaaccagctgaagccctgagtgagagaaggcatgtgccctgaatgacacccttgtttccaccctcatggtgtttgcttgttccgctg

SEQ ID NO: 127408 - DNA, 234 bp, Homo sapiens
attacagatgtgagccactgcacctgacccctttaatagttcttttagtaaagattcattagcggtaaatttgtctttccttcacacactcttgaaaagcagttaagctgggtatataattcaggactgatggttgttttttgtttgtttgtttctcagaacctggaaaatattatttcgctgtctatggctcccactgtttttgtagcaaagactttatagataacatttcct

SEQ ID NO: 127409 - DNA, 257 bp, Homo sapiens
gaggagatgctccctgtcaagaaactgacttcgtgtctgccagtgctctaggtgtcaagctgaggacaggtttggcgccttctttgattgtctcctctgaaagaatagctgatcagcacacacaccttagtgctgctaagggcgtgcagcagcttctgaggatccgtcgggtccacaaggcaggtcatgcactggcaccccgctctgagctccctgagggcaggggctttgttgttttcttccagttgtcccacccc

SEQ ID NO: 127410 - DNA, 539 bp, Homo sapiens
ctgcagaccctccaggctctcccgggggaaggagccccatcagggccagcactgcgccactcccaacaaagcaggcaacctagcctgccagtggagacctcttttccgcctgggctccagctctagagcaaggccagtcacctcagccccaccatcaaacaccaggctccacatgggcactgcctcgctcaactgcgtggtggcgggtggcctggaacgctgctgtcatcactgcacgtggacacatcatcaacctctcagcgtgacgtgccctcgtgctttcaggtaaaacactacagagaaacttcctgttggcaggtggaccccgcactccctagggcctgatccgctccctctcttctgctttacgggcactgacaggaagtatctgatgcgcactcactcacaccagccacgcacatgttgtgagcaatcctgtgtggcctgctcccccctcctgaccggcccctcctgactggccccagcaccgcgtggaagaacatggaggagctcatctgtctgaggataggaagcagcag

SEQ ID NO: 127411 - DNA, 363 bp, Homo sapiens
acccatggctcttattaaatgcatatctgataggagtgtcccctttaaaaatacataaatgtagacggaaacgtacccggaaatgtaccccattgtagttgaatgtgcattatttcacttaaacatatttgcttaggatgggcaagaccacagctttcttgacagggcagcttttcttgatgaataactttacagtggctcctaaaagtgaattggttttcacatacatattttttcctggactcactttgaaatcagcatgtggttattagaagagaatatgccagttcctgtggaataggaaaaagaacaaaactctgaaggatcatagtgactagaatggagagagaagcactttcattc

SEQ ID NO: 127412 - DNA, 410 bp, Homo sapiens
aatgcctcttcctgagtaagttcactgtcaggaaaggaaaatccaaacgctcgaatattctatttttgtgtccagaggctccagcccctgcacacagactcttcctcactctgaaggaaaggaaactgggcgggagacctccctgtcacagaggccggaattgaggaacctgtgtccctccaaggcctgttctccatacattcggcttccattttaggaaatgaggatatagtgcaggctgctttgggattggcctgagggtggagttagtggtttaaaaaaaaaagtgctcctttgactattctccaggcaagcagcaagcgcggaactagactttaattaaattgggaggtttaaacggctgcattagtattacacttcctctggtcattaaagtttactgccatcac

SEQ ID NO: 127413 - DNA, 456 bp, Homo sapiens
ttaatagggccattccccatccctgggacctctgatgcaggtgtttcacagttttgagatcctctgccctatgtaatgcctgaattccttctatggcaaccccagcacatggctattgactctgcatcctcaatggggctgcaggatgatgagggagtggccagactctggcagccaggttgtccttaacattttgcagaacccacttccccacagaggccacccctgttaagaggctgatgaggcttcatctcaagagaatgttgaggtgggggacatagatggagcttgaggctcaatctaggatgcggttcggcaaaatgagtcagtcatgcatataaatgggatttgcttgatctgaatctaagaccatagagcagttacaatattgagaaattcttatttgtgatattttggggagaaaatcaacttttatgttgctaataaggtctcatg

SEQ ID NO: 127414 - DNA, 343 bp, Homo sapiens
gccccattcttcatcgcaggctctgtccttctttcctcaccctgtcagggaatgtaaggttgccccaccccttgtctcctttagcctcttcctgtgctttccctcaatcctctttcactcttactcttatgcctactttctttcctccacattttctttaacccctcctctttctccttctcctctcccctgttttctcctccagccttctttgtcctaccctttttatagcagctttcccctaggaagcactcccaccccagcctcgggctgccatgttcgcactggtgttgttgccttgtgagtgaaatagctcatctgccccaagtgagaagaaagcagg

SEQ ID NO: 127415 - DNA, 345 bp, Homo sapiens
gtcttttgaaactaaggaaagttttattgtttttctagggataaaacaaggtggggttgttttaatggttaaattacatactgaggatagtgagtaacccttagattaatgtaggttacactctaagcctagccacaattgcaaagattagagaactaaaaaattatgatttggggaagaactgtgctttaagaattctctatcatggaaattcagttggcatctcctttcctagagatgccctctgcccctcataatagaaaaattattttcagtaccatgttccattgccttactcactgtcttacttgctgctgtattttcagcacctagtttagtgcctgg

SEQ ID NO: 127416 - DNA, 458 bp, Homo sapiens
gagtcgtaccctagtttactttggagctaagttttgagtgtttttttcatcattagaccagccctgtgagataggtagttttatggccccattttacagataaggaaagttgatgcttgatttacttgccagtgctcacacagctggcaggtggctgagctattatttgaatccgtacagtttgcccagtactgaaattacccaaggcaaactattaaaagaaacattacaagaaataagagcctgggaaatccaaaaaactggaaataatctgccctttaataacagagaattgactgtacacactaattaattacaacgattgagactgcagcagtctttaacttgtcaagggagcatgaattaaactctgtactgccatcaagtgtgccccatggaggagtgaggtgtatgagtgctgactagccacaagtacattaagagaacctttgttggga

SEQ ID NO: 127417 - DNA, 255 bp, Homo sapiens
attaaggggcaacaagggggagaaatcataaaaatggtgattcttttgattgagggaagactctaaggtcaaatgtctctcagttgagagctgattttgggtggaatgaggtgcttaaaagggtaaaggagggtttgcaaaggggctgcaatttcttcttttatggagaagctttgatacaaataataatatttttatgtgcctggggacctaatgaatttctaaaggtatcaagtttatctaatgcatcttgcc

SEQ ID NO: 127418 - DNA, 709 bp, Homo sapiens
gaaaactgagaccaagaggattaatacttctccatggctaatcactggtatgactaagcctaaaaatgatttcttcttatttcatatccagtgttctttcccttcatttggtgttgcttcatgtttctacattatctgatgagctgttggatttctttcatatctggtatctaggttaccaaaaatactagatacattcatttaaaactaatgtaatgccagttctacttttttaaacatctcatcttgttcttcccattgctaatcttattggtaattatattttaatcctaatgttggttgaaattaatttactataattacagatagggaaattgtgtgactgtggattgagaggaggtagggttaagtcttaattccaccattgactagttacataagctttggcaagtcactttacctttctgagcatgtttcttggacctgtaaagtgagagtggtaaaaacctcttactatacttgtgagaattaagtgaaatcaaatgtgtgagagtgcctagcacatctttagactccatagatcaaagatttagaattagtaacagagacagacagtcaaggggctctgtgataactacaatttatccatttggaccattttaatttatattggaaaaacagctttttatggaatcataaagcactattcagtctagaaaataggcaaaaatacaagaaaatagatata

SEQ ID NO: 127419 - DNA, 619 bp, Homo sapiens
gtaacaactactacaacacagagatcaattctgctcaaacttaaagtgaccaagataactcatgactccaggactactgggttggtaacaatgtgtagtaagagcgtttctgttttaataatggagcgcagtgagattatggggtaactcgtggtatcaaatgtgaaccttttatagactcctggctccaagtcctttcactactcccatctccttttccaccccatcaaggtgagatcattaagctcaggaaggcagctcagccaacggaaaacattcaaccttcaacttttaataaagtacaaaatgcttttattttatattttatttctgaaaataaccacatcagggaaaaaagagcaaatgtggaatgggaacctgacattgcaaactatgggaattttattttttaaacgtttctaataaaagcaaatatagtttagtatgactaaccctaaccccattttgattgcttgttttctcacttttgtttaaaaaaatagtaaaaggaaaccttttatgcactcactataatatactgtgaaattcacataaaatttctcatttaattctcacagttattctgctctgtaagtaatctcatgatcctcacttctac

SEQ ID NO: 127420 - DNA, 417 bp, Homo sapiens
tcaaggaccaagctgaaaaaggcagcttcttgcctcaagtttcaataattgccatgcagggcaaagcgaatgcagcagatttatttcagtcttgctcttagagcttttgcctagaagtgacacacatcatttcttttctcatgacattgaccaaagttaggttatgagatcaagggtgaggaggtgcagtcctacccgtccagagagcagagagtcgaaacgtgtgggaaacaacacaaatgctagccactatcacttactgactctggaactgggcaaggcacttatggctttctgggcctcagttttcacatctgtacaatgagtttagtactacccacctagagaattatgacaaaattactgtagataacacaaattattacattcggcactgtgccaggcataagataccag

SEQ ID NO: 127421 - DNA, 733 bp, Homo sapiens
gtaaaaaccacataggatgagacattgttttgatctgaaaactttgctattttcaactttgctgctgagcaatagaaatagacatattttggtccatactcacaacatacacagagacagacaaattcatttcattttaagtgggttttaaaatttaattgtgttttccctctatttatttacattattggtcatgagtttgcagatggcatgagctacttcagctgagcttatttttcatcagaaactaaaggtctgtacattggtccatacgaacccatcaaggcagttactttagaacccagaagtgaaaacttttcagtaaaacccttttctctcaatttcctagtctgtcttatgagtgcacacaagcattttttgcagggaggtacagatccttccactaggcgtttctaactgtaacttagtcatacacattgagccaagcctatctgatacctcctcatcctaagccctgcttcttgttgcttccttgcctgtaactagttgttagctttcttttggctcctaagaaaaatcaccacttgtttatttgctttccagctgccaaaatgcagatgtctctcatttcctgtcagcttcttttccaatctccttgacttgatggatttgtacttttgaaaaattcatgtactgtagttttaaggaatttttggaagagaacaaagtatttgtggtcaactgccatgttctctgttagattcttcaattt

SEQ ID NO: 127422 - DNA, 289 bp, Homo sapiens
atagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatg

SEQ ID NO: 127423 - DNA, 471 bp, Homo sapiens
tgccacatagaagcacaccacccagcttatacatggcagatgtaggaccctgagtttgatgatgattcctcaaaagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaataatggaagagcttcaatcttagttattccacagctatcttgaggctaattgatactgtctgcctcttcagcttatggtatcagtgaatgagatttgaaaatgatgctttcaaaagatcaaatgacagtagaactagaaattgaccaatctaggcctctgggtgtcagtgtttcttcgctaccagtgatcatccaagagttgaatattgtaatacttaac

SEQ ID NO: 127424 - DNA, 342 bp, Homo sapiens
tccttaggagcaaagacagaggtttgggtgcatgggatttatttaagaaattgtctctggaggaagggaggaagggaagcagggtagagccggggaagaagccaagtaaggaggtgtgtgttgctgctggagcatgaattgcaccactattgaattggtcccaccaaaggccccttttgagaatggggtagctgtgagtccttgaaagccaacactcagagcatctgggggacattgtaccaactttacaaagtagatctggggctccaacagtatacactccagtgtccttcctctacttggaggagtcaatgaacgcttcctggaagagctgccattaag

SEQ ID NO: 127425 - DNA, 417 bp, Homo sapiens
ccttccagacgtactgttttctcagcctccaggcctcaacctagaatgccatacaccttacttcagtataataacaagatattccctgaccttccaggctcttcaatgccacctctttttttttttcctctttcaagtcaagggttaattctctctgctctaaaattcccaagcacattttatgtccatagtgcatgagctttatcatgtgtcgcctagtgtaataattgtaaacagatttgctctccctgaatggcctgtcgtctctttttcttgttttgttttgagacacggtctcaccctgttgcccaggctggagacagtggtgcgatcttggctcactgcaacctctgccctccaggctcaagcgattctcctgcctcagcctcccaagtagctgggattacaggcacacac

SEQ ID NO: 127426 - DNA, 412 bp, Homo sapiens
agacatcttacatcgatggcagcaggcaaagagagagattgggctgggaaactcccccttatagaaccatcagatctcataagacttactcactatcacaagaacagcacaggaaagacctgcccccatggttcaatgacctcccacaggatccttcccacaattcaagatggatttgggtggggaaaatgttactacttgtttgggggaagctggttaagaaagtcatcatagggaagataacctggcaggggtgtgaaggattatagtcattctggctgagctggggtgatggtggtgatgatggtggtagcggtggtagtgatggtggtggtggcgcggcagtggtggttgttgtgtgagtggtagaaacagcaggagtaacagtagcagcaacacatagaatgaagag

SEQ ID NO: 127427 - DNA, 179 bp, Homo sapiens
ttcctcaatagtgaatccatgtgaaggatcacggaaagagatacgaagggatattgtcttcattttatctgaaaacagtgcttgtttcagtaagctggatttggatcctctcatataactccttacagattttctctggggaaagaatacttctctctgagcttatgcctttctgctat

SEQ ID NO: 127428 - DNA, 777 bp, Homo sapiens
gatttaaaatgccccttttttttgaatttggaattactatatatttgggtctgtgttctagtggtttgtctgtctagttctatagtagaggagccaacattttaattattacagctttctgataatattttaatactagttcccctcttattctgtcttttcaaatttcttgtggctatttttgtgtgtttatcctaccagatggactttaggataattttgtcaggttaaagaatttgagattatgattggacttataaattagcttggggagaattgagatctttatagtattgagtcatcctgtccaagaagctatacatatatttacccccctttttttagttatctcttacatcccttaatagagttttataatatttttaggtcttggccagttcttgctaagaataaatttatattttcagttgctggcattcataatagagtatttctcccatggtatattctaactggttattatttatagaagagctggtggtggctcacgcctgtaatcccagcactttggaaggccgaggtgggcggatcacaaggtcaggagatcgagaccatcctggccaacatggtgaaaccccgtctctactaaaaatacaaaaattatctgggtgtggtggcatgtgcctgtagtcccagctacttgggaggccgaggcaggagaatggcatgaacccataaggtggaggttgcagtgagctgagatcacgccactgaactccagcctgggcaacaagagtgagagtccatctcaaaaaa

SEQ ID NO: 127429 - DNA, 432 bp, Homo sapiens
ttaaaaggagactcactatgaatccctttagtaaggtaaaaatctttttgtactgcaattaacttatctcaaattatttagttttaagatcacattttatatgcccacttctcctaaaatacagcactcctccacttggcttcaactcccaaataagaatgtaacaaaccttctatttacactgcacttacttcagatctcctctttcctctacccccaggagatcagccatagtgaggagccctctttctagcaactcacacatttggaggcatcaaactaagtcactttgcatttttcctgacttgtgtatctacccaattgctcttctactctgtttttcttcaaaagacctttgatattcacccagcagctcccctacaaggtaatctcccgttcaggccaaatgaatgggtttccccttccaagtta

SEQ ID NO: 127430 - DNA, 531 bp, Homo sapiens
ttttttcccacaggcgtaataccctcttttgatcagacgatcatgaagaggtttgcacagatagatttttttaaataaataatgattacagcaacctaaaagaagtgttgttgggggttagaagctcctgcaaattccgaagtatcagggccagatgatgtggtcttagcttaggaaaagagttagtcttgtccttgaacttggctaaagacattcatgtctggttttacttacatgtgaagagagtaccaagcagtaggggtatttccttgttagtactaactaatgtgatgcttaccaagtagtgctgatgggtgacagaccagagcacccagcaaaggccagagaagtccagaacctggcgaggagatgaggcttacactgactgaaggcagaaggcagcagggaggagaggaatgtgccggagcaatggcacaagtgctcctaggccagtgctgtgatgagctgatcagcactcccattgcctggcttgctcctcctgctcagatgccttctctcacctgacccctg

SEQ ID NO: 127431 - DNA, 372 bp, Homo sapiens
tcaatactcactggatggaacaccgatatacatgactcaaaacagcatcaattattttggggatggcagtttccacattcctacttatattttgaatgtaataaaacttacagcaatttaattttgcatatactgctcattactgtataagatagtctaaagttgtactgggtagcagagagcagcttaggatatacaattttcttctcataattcacagttttcagagaatatattctgacagagactgaatgtagtgaaaaacacatctttcaatgcttaatttcatctaaagaagctctgacaaatacatgaattgaaatttagtgtatcaagtagaacacttagacaatgggcatccagggtgtcaga

SEQ ID NO: 127432 - DNA, 272 bp, Homo sapiens
agaaccacacacgctttaccacgagtctccttggtagctggaggaaagcaaggccatcgaaggtggagcctggggtgcctccatccaagccctcatcttgcagacaggcggctctcctgggctcacctgtgagcccacacgcagagccacctgcggcgtttgcgcagagcctctgcggccaccaggaagtcacacagcccttggtgggtccgcagtggatcaacacagacacggctgcacctgagattcagaagaacgggcggacggtgctt

SEQ ID NO: 127433 - DNA, 540 bp, Homo sapiens
ctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgt

SEQ ID NO: 127434 - DNA, 403 bp, Homo sapiens
acaggggccaccctcctacaccagcctccaccaccccatggctccctgaacccagtcacaacatcgggagcagcccaggtggggtggggaggaggtggggatcgcgagagggcttcggagaggcactccctctcccaccagttctgggacagaacaggacccggctgtttgttcttgatgtacgttaaggagatgcagacagactgggaaagaacggaggttctttctccaactggctatggggagaaggtcagagtagcttaccagaccaactcaaagctacaaacttctttttctagtgcttatatgcattctaagctccacgcctatgtgcggagtgcacctgcaagacagcgtgtttcattcttatcaatatctaatctttaactagtgtccagggtct

SEQ ID NO: 127435 - DNA, 376 bp, Homo sapiens
aggtaacccagctgtcttttccagccagagtggtcggtgaaggaggacaggacagggaggccggcagagggaggctcggatgtgtagagacagcacgtgtgactcgcagcctgccccgttggtgaggctggtcgagacttgccctttgagtcatggggtcacttctccaaagcctgctctcctgggaccctccacaggcagcatcttgtcctctctgctgttgatgggggctgtcctgcagaagggatgctcacaggagctgcctccggtccctggcttagaggcctgggtttaacaggctcccttctttaccctacaggtgcatcaagagcctctctctgtccagcgctgcactgtgtgctgggcccctaaaggg

SEQ ID NO: 127436 - DNA, 120 bp, Homo sapiens
ctgcaggcgactcttgaggaccccacagggaaaaatcaattcagcctggctagtatcttgaggaaaacaccacagaaagtgaaaatctcaacctcagtctttaagtttgaatagaaattt

SEQ ID NO: 127437 - DNA, 435 bp, Homo sapiens
gaagaagaggatggggatggaataagccatataaatacgttggataataagaatcccggttgaaggaatggccaatggcaaggtctggagggaggagcccacctgacgtgcctgagcaggccagtggagttggaatggagtgagtgagcagaacagtccagaatgactttagaaaagtagggaccaaccacgtatgggattgtggaaattttaaggagtttgtcttttactttttgagagacagagaaaaaaaatcggtgctggagggttcttctcttctctggtgtgtttttaaagaattcattaggctgcggtatcaggaacaacccataagagatagtattggagaccaaattttggaaattgaaggtagagccaacagcattggctggtagctaaagaatgactccaaattaactttcatggggaagacta

SEQ ID NO: 127438 - DNA, 759 bp, Homo sapiens
cacagtggctaatgcctgtaatcccagcaatttggaaggctgaggcaggcggaccacctgaggtcaggagtttgagaacagcctgaccaacacggagaaaccccatctctactaaaaatacaaaaattagctggctgtggtggtgcatgcctgtaatcccagctactcgggaggctgaggcaggagaatcgcttgaacccaggaggcagaggttgtggtgagccgagattgcgccattgcactccatcctgggcaacaagagcaaaactccatctcaaaaaatagtaataataaaattaaataaaaaattaaaaataaataaaaagaggagcaatggaacaaatatttagggaaagagatgctttgagccccaaatcactccaggtggatagcaccctaatcttaatttaaatgttactgcttataacagaagagctcattctagctaggcatggtggctcatgcctgtaatcccagcactttgggaggatgaggtgaggggatttcttgggatcaggagttcaataccagcctgggcaacatagcgagagcatgtctttgaaaaaaaaatttttttaattagccaggcatggtggcacttacctgtagtcccagctactcaggaggctgaggtgggacgattacttgagcccaggaggtcaaagctgcagtaagccataattgcaccactgcactccagcctgggcgacatagtgagacccagtctcaaaaacaaaacaaagcaatacaaaaaaaaaa

SEQ ID NO: 127439 - DNA, 297 bp, Homo sapiens
gactgaggatcctctccataatgtgtgcccaataaaaattgattttggcacatattgatggctttcccatgtgcctttttcggttctgttctgatatttttctatacagtaattaaatttgtggttttgttctgaactaaaaaacagtgtagtctcacaacacttgagtggtgagcactgggactcttcccaaagtccttcgacttttttttatgcaaacaaggctggctgtggaataggacaagtgattaggaaggagcatttggtgtgccctctgcagtgggcagcatgctggct

SEQ ID NO: 127440 - DNA, 526 bp, Homo sapiens
cgaaatcaggcaggcacaattaacaaaaaataacttacctgagatctttgtaacacctttattatccctattattacctcatcttctattaatgtccttctggctcactccagccacactggcctctggttaagaatcaaagagccaagcatgttcccatctcacacagactttgtactgtctgttccctctaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgactaaatgaactttgtgaccaggcacagtggctcatgtgtatcatctc

SEQ ID NO: 127441 - DNA, 494 bp, Homo sapiens
gagtcagtttccaggccgctgacaacctctgataaacacacaaaattggatttctgtttataagcgccaccctgtgaagccaccagttggcctgtgacataagtggtttgaccaaggccaaaagcacaccattagggcatagtcggtcagatctcggggttctggagctgcttgggctgcggaagtacagggacatttttactccctgatactctgccaaaggacctttctctcacttgcaaacatccatgaaaatcttacaaagatatacaacttgcatcatccaatgacacacttaataaatctcccttctggaaagaagaaagccatatacacaatcctcctgagcgcagagcatctggtccgcacacatgtatgggatcagatggtaatctgccctcttctgcacccagcagggctgaggtaattggctacaggcaagcagctgctgcgcacggctcagctcacagctcacctggtgcacatgggccatg

SEQ ID NO: 127442 - DNA, 465 bp, Homo sapiens
tatttccacaggcaggacctgaacagggaagctctcaggtacctttgggagcatagaacccaatgtagcagaaagagggctacattcctagtcctagtcctacctctaattcattgtgtgaccatggacaaggtactttcccactttaaacattagtttccacatctgaaaagtggtagtggaggttagacttgatgagattaaactttatcttcaggcttctaatcctctactgcctgtcatgattgtagcaaccttccctgagctttttctttggtgaattcttatagcctcctagtactcattttagcaatatcatatccttgtatgttctctcctaaatgacacagatataaaagtcttgcctcagctacaagagcatctgcttctctcctggcatgccttacctataacagagtcctaataaatgtgtcctcagtccttccttgctgtgttccctgtttt

SEQ ID NO: 127443 - DNA, 481 bp, Homo sapiens
gtccaaagggagatcgccccgtggatctcctctgtgctctgttcccagcggagtctgtgctcggttaccagtgtgggcatcagattataagatgcaccggcaaattacttttatcttctcagacttttaaaagaaaaactggaactgacccaactgtgcatcaacaggtgaatggataaatctgttatattcatattcagtaataaaagagagcaggccactgatatgtccaacaacatgatgagtctcaaaaacatgttggatgaaagaagctagacacagaagagcatatactatgtgattcaatttataggaaattagaaaacagaaaaaaagaaattaacttatagtgatagagtatagatgaggagttgcctgggttttagggtaggaggaggggattgacttcaaatgggtatgagaggtcttttggggactataaaaatgctctatatcttgattaggatggtggttacgtggg

SEQ ID NO: 127444 - DNA, 404 bp, Homo sapiens
tgaagtttaaaagggagagtggcttaaccacactaacagcaagagtatggatgagaatgacacagtacaacatttaaaccaattaaggcaaatattcagtgagtgagttcaattattattattttttgagacaaggtctcactctgttacccaggctagagtgcagtggtgtgatcttggctcactgtagcctcaacttcttcagactcaggcaatcctcccacctcagcctcctgagtagctgggactataggcgtgtgccaccatgcctggctaattattttattttattattttatgagatggagtttcattcttgttgcccaggctggagcgcagtggtgcaacctcggctcactgcaacctccgcctcctggattcaagcgattctcctgacttagcct

SEQ ID NO: 127445 - DNA, 691 bp, Homo sapiens
tatacagagtcatgaagacactgaaaagtgatgaatccacataaccatgacactggaaatgaagtttgagtggcagtcagaatctgggaggaagcattgctaagtgaaaatcttatggagcttgactaaaaatccctgtcaggaaccgtcaaaagctgtgtccctgacatgaaaaatcttgctggaagttgagagaggtttatgcctactccgtgatccgggaacacaagacctttaccaaccaaaaaagtggatagctgttcttctgctgtgaaggttaataaaggtaaacattataatggccagggctggggttgaggcagaaagaaggaagaaggaaagaaagaaagagacaaaggtaataatattagtaaaggtaaataatgttagtgtctctcaaaacaaaaataatttgacagaaaaaagaatcattttatattgataaaagatgtaatccataaaatagatgtaaaattcatgagcttctatagtattacaatctttaaatggaaaattgacagaaatataattgttataaaagacattaaaatatttttctcaagatttgggaaagactaaaaagtaaaacaagattgaatgagtaggcagatcttgaattttgtattttaaaagtggagaatataccttttcatgcaaccatggatcatttgcagtagctgatcataccact

SEQ ID NO: 127446 - DNA, 762 bp, Homo sapiens
tagtcctaaaagagttgagttgaaggacaaacatttttgtcacgtttgtagttagtccataagtatttattgagccatgaaatagcatccttgtcaaagcatgttgggacagtagtgcaggatattaattcagtaccatggctgtatcttggtgaggcacataaattttactatgctgcccaaatcacttaactcatctatctgaccagaaatgaagcaagcttccagaaattgcacaagagcagtatagaatgtagcatgactacacaatattttatttgcaaatctgctgtgtcaagacatcttacactctcaggcagtatctttctttagtaacatttttctccaaaataaaattttcagaatcttatgtttctggttttttgtacaatagaggcttcattatctatagtgcatcatggcatattgtgtttgttgaatgctcctttctccttcctatataggaaattcaatgaacaagagagacaattatgcaatccataaaaattcatacatttgcttgcaatgatattaaactggaaggtcttatgcttcttattctctctgcatctggataaaatggaaacatttcaaatttcttgaagcatctttgaaagtgtttttccacactgggaaacagggagacacagtctctacaaaagataaagaaaattagctgaacatggtgtcacgtgcctgtcctagctactcctacttgggaggctgaggtgggaggattgtttgagccctggaagttgaggc

SEQ ID NO: 127447 - DNA, 253 bp, Homo sapiens
cttaattgagaaaggctgctccagagtcagtgacttcaattccttatcacttccagttttttaaaatgacatatttagatatatggcgatatcccctccccattcccatcctaatgcgatttgaagtatagtttactcatttcctattacagaagatgggagtttaggttttttgtaccaactcctacctttaaacactgcatttcacttcccctctcccctctatattcccaaattagttacatgttaactt

SEQ ID NO: 127448 - DNA, 158 bp, Homo sapiens
tctaatgtacagggattaactctggaataaagagaaatactgatggtatttaagggcataggactagatgcgatcacctgaaatgtgagtataaaaagagagttcaaagactgagccctgagacatttgaacatttagcagtaggaaaaaggaggata

SEQ ID NO: 127449 - DNA, 654 bp, Homo sapiens
catctgctgttttcttagctcctgctgtttatcagctattgttaggggcctaagtgactatgactcttattaccaccctaaacaccctcacatgagtgtgactttgactctcattatctcagtaaacaccctcagatgaaaggggtggaaaggataatggaggctgaaatactaatcttttgtgtgacttgccagtcacctacaggccaccctacaatcataagcatgggataaattctttccttgtatgttaattgtaatcttcaagatctaaacttgaatctatcacattgccctacatcagaaaaaggaaaaaaaaaaaaaaaaaaaaaaacatgtgtgtggggcgcggcttggggccctcggaaaaggtttttaaaaaccaatccgtgttggggcggcggggggcccatgaagggtagagtgaacaatggggcaaaacagtggttccctaaggagaaaaccccgggagcaagagaacaagagggagggagtttctacacaagtagaaaaagaggccgggggaggaaacagcaaagggttgtgggaaaaaacccccaaaggggagcctacagagggacaatcaggggggcacttatacaagggggggctcaagaagaaagccgaataacaaaattagcccgcagcgggggc

SEQ ID NO: 127450 - DNA, 1793 bp, Homo sapiens
gttgtagtatcctgaggaaaagctgattgtatcacttatgactgagattttcatctttagccgcttctgtgtgatacatgaattaatgggtcataacataggagttagctaattttcattttaaaatattactcagaagatatttttatcttaattgtacatttcaacaacataaataagctgttcaagactgtctcccatgcctccaaaacaaataaaaaccccccacaactcaaatgcatataagctgttactatagtataatggtgagttatagccagtgtatgatgggattgttgatagaataatgcatattagagcttttagttcaaaaatttgagatagtgattcagaaagaaaaaaaaaaaaaaaaaaaaaattttgtggggggttgggctcggaaaaggtttttaaacacattgggtttggggggggggccaggtggttatggacatgggcacacagtgggccaaaggaaacccgtggcacagggcaaagcggcgtggtctcccccaaataaaaaaacgccgggggggaccgagggtgttttgcccaatcccagagggggttttcgaggccaacggggtctacaccgggggccaggggagccggatatacgaccgccccgcgcgcgggaccacctaccaaaaagcgaagcgagagaaggaggaaaaagagggagaagaaaagagaagggacaaacgagaagcgaaaggaggaagaagagaaaacaagaaagaagaagagaaaacgagcaaaacacaggacacagatacacgaatccccacaagcacgaagccaggactaggaatcgcagaagaagcgcacacaaccagcaaagaggaaaaaaaaaaatagagacaacaaggcagagagaggaagcaggagaggagaggaagaagcaagaagaagaaaaaaaagaggagagagacagcaggagaggtagagaggaaaagaaagcacagagaggggaaacatgaggcaagagcggagagaaagagagagaagacatgagagagacgaacagaaggaaggagcagcaagaggaggccagagggagcgagagagagacggagcagacgagagcaaaaagagaggaaatagagagcgagagagggagagaagagggcgagacaatacgggagagacagacgagtggcacagagagacagcagagtcaggcaagacagcgacacgagcaagacgacgtgatagagccgagacaggccgggcagagacacatgaggcgtcgagagcgaacgcaagaagcaacgccgcggcgagaggctagaccacggacagcacatgacagaggaccacgagggcgcgcagagatacggaagaacgcgagagagaagaaggagaggaccggacaggacgagagacgaggacacgagatgggagaacgaacgcccaggtcaggaggaagacgggagaaggagagagagaaagagaactacaggggaggtagacaacgagacgacggacggggagaagacagaagaagagacggcgaagagaaagagggacgaagaagcgaggaacgacgaagataggaagaggaagaaggcagacagaggaccgaccggggagagccgaagggcgagagccagacggaacgacggagagagggagacaacgcgggaagcgacggcgagagagtagaggcgagcggacaagagcgagaagaagggtaccgatgcggaggagacggacagagaggagagggaacagacagggcaggaagagggagagcagagagagaagacgacagagcgagcggacagaagcgg

SEQ ID NO: 127451 - DNA, 284 bp, Homo sapiens
ccaaatttcaaatacggaattcgtcttccctaccaggaactgagataccaaaaatcagcctctaaataccatcctctgggcttgtaagatgaaaaaactttttcagatttgtccatcacaggggtagaaaaatacctatttatgagacccagtcacattaacagagcagccgacatggtgttcacactcaggcaccctttgaaaaccggccactaaggctaaaatgtgacattttgtatttctctaggctgtagccaaacctgttaatttatgttagagagaag

SEQ ID NO: 127452 - DNA, 363 bp, Homo sapiens
ctcagcctccctcctgagtagctgggactacagcgcctgccaacacgcccggctaattttttgtatttttagtagagacggggtttcaccattttagtcagaatggtcttgatctgacctcgtgatccgcccgtctcggcctcccaaagtgctgggattacaggcgtgagccactgtgcccggcccaaattttttttttttagtctctttaatgggagagaaattgtcttcatgtcttacacatagtatgtattcagtaaatgctggtttaagtttttgttggttgtgctgttttgttagccatggacagaagcccagtgcaccgaaataacatgacagattgaaggacctcaataaacagtg

SEQ ID NO: 127453 - DNA, 317 bp, Homo sapiens
gttgtaaaggaagtagaggtgcatgatggttctattgggggcggggccagttttcttttgtttctattggtgtctctctctggattgagatctgaccttggccttggctctctcacctcctattttaggtggacgtgtgaccagaaatggacatgtgagctaatttttattagctcctgtctgttcaccacattctcgtagattatctgggcaaaatatctggcaaattggacttgggggtggtaatttgatgatgggctgaattattttggcgaaagatcgtttatattcagtttcacagtggagactcttattac

SEQ ID NO: 127454 - DNA, 780 bp, Homo sapiens
aaagtttcagaatacaaagtcaatgtccaatagtcagtagtatttctatatagcaataatattcaagctgagaacaaaatcaagaactcaatctcatttacaatacacacacacacacacacacacacacatataactgagaaatacgtttaaccaaggaggtaaaatatttctacaataagaactacaaaagatgggtggaagaaacctgaaataaaacaaactaatggaaaaatatcccatgttcatggattaaaaaaaattaaaaatgaccatggtgtccaaagcaatctaaagattcagtgcaatttctatcaaactaccaatgtcatttttcacagaattagaaaacaacaatcccaaagtgtatatgaaattctgaattgaaaaaatgacccagatagccaaagcaattctaagcaaaaagaacaaagctggagtcagcacttcaccccatttcaaattatactacaaacctatagtaacaacaacagcatggtaccaatacaaaaacagatacatagtttaataaaattaaatagagaaccaagaaataaagccacatacctacaaccaactaatcttcaacaaagcgtgcacaaataaacaatgtggaaaggatacctttttcaataaattgtactagaaaaaatggatatccgtatacacaagaataaaactggattcctatatctcaccatatataaaaattaactcaagattgattaaatactcaaatgtaaaaacctatacaattcctagaagaaaacctaggaaaac

SEQ ID NO: 127455 - DNA, 249 bp, Homo sapiens
cagtttttcataggatcccatcctttgccctctcttcttgtactacatctacacacatgccttcaactctcacctcattgaagacttgtgaatctgtagctgtagctcacatctctcaccaactccattccaatgtccccaaaactcagtcttctacaaatctcttttccttctgatatttcctaactcagtaagtcattaagctagactagcctagcttaaccattgatatgagaccctgcctctaca

SEQ ID NO: 127456 - DNA, 329 bp, Homo sapiens
gggacaggacaggctgctttctgcaggagggaggaagggggacccactgagggacaggtcttcttgtgttcccagaggccagcaggggggcttgaccccagagacacgcctatccatgagtacccaaaggggatcctgagttgggggctggaagaaggccagtctctccaccaagggaaaggggctgagggaccctgccctttgctgcctttctaagaagcccccaaatgccccccgcttccagcacccaggccctgtgcacagccgcagcctgagtcatcattctcatttgaatggtggccgagaaatcagccagggggctgcccagg

SEQ ID NO: 127457 - DNA, 469 bp, Homo sapiens
ggaattgataagtcttatgctaagtttccatttaattttttaagacactgccaaactgttttccaaagtggctgtttcattttacattcccaccagcaacagatgaaggcaagcattgatttctgaaattgctttagatagtggaattgaaagtcttcagctttggttacatttggtctttgaactgcaaccttgaaagaaaactgtgaaatacctaaatcatactatatactcttaaagacaaagaatgatgggaaattaattgaaataaatgaggtttagataacagaagggatttgtaacaagtaagtgttctcagggatagtattttcagctttcgtttgctaggaaattaaatcaaccaattaaataaaataactctccataaagatcagttagatttgccatatagattgttcatttacgaaaatgcactttgagagttatgtaacaaagacactggtttcat

SEQ ID NO: 127458 - DNA, 440 bp, Homo sapiens
gaacggaacaagcaacaagtagagtatatcacttaggatgaaaaagtgcactgtgcaagcacagaataagaaagaacttttccatgagaaagtgaccagggttgcagaggactgtgtttcagtgaaagtgaccagggttgcagaggactgtgtttcagtgaaactgaccagggttgcagaggactgtgtttcagtatactctaatttccttgtacttaacacacaacaagcagccttccgaaagcctgacaaagtctaatctcatttaattctcataacaaggcacttttattactcctactttatagaccaggagatggaggcattgagaggtcccaaactttgtccaaggcagaaagtgtggagggtgaacctgacgtagcaggtgtgataccaggacccttactccagatccctaggctacattgcttgggcaccac

SEQ ID NO: 127459 - DNA, 750 bp, Homo sapiens
gtcattttagggatatgtttctgtgtctgcaataggtttcatagttttagcattatcttattagtgaggatctatcattagagatcatatttatggtgacatttgtaatttaattaattgctactgatgttctcgtaatttcattttcattgtacttctgtggaatcataaacaaaaggttaagtggcacatcaggttaatttactggtctttgatgtttccatctgtgatcttacattctacacaaagtataaataaaatggctctcatatggttacagtccagaagcatttctctctcttagagggaactgcatttttagtttaatttttgtgcttctcaaaatccacttaatccatagaacattacactgacatggatctctgagtttctgttttatgaaaaattaagtcagctcagagagggaacctgccattctaagaagtgatcagaccagaatataattgaaaagcaagagtgaagtattatttaaaattaataaaaagattttaaaagatttctcatttgtaactgcctgcagactggacttgacaaaatagttctaatctagagataaaattccttaactgtagtagtgtagtaaccattttccaaaatagtccacactgaactaaaaaaaaatgtttaccactatagatttatttttctgaattacctgttgcataccttttgcagaagtagcagcttaatattaccaatgaaaagacttatacattataaggtcagctg

SEQ ID NO: 127460 - DNA, 767 bp, Homo sapiens
caggtgacccgcctgcctcagcctcccacagtactgggatgacaggcatgagccaccgtgcccggccgtagaattgtttttataagtttctacaaatagcactgttttcatagtaacttctttgcctgtgaacaatggataactgttcgtgctgaagactcaatggtgtttacctaaagaacagcgtagaagtacagtttttcttgcccacccccgggtcttatttctgaaatggctgccaacacctcaaactggtagatctgggaaattcaaggataccaatacaggcatgtttttctttccttgccaaaaactttagttgttttgggcttgcctctctgtgtcctctacctggagagaggcagggtgggatggatcttccgaaggaatgttaatcaagtttcttgctcactaaccttgatgttcctgttgtgttggtatgttgcaatcaatctagatctgttcaagttagtaaatgcttactggggtgaagagattgttgtggtttgtgacaaggccaaattcaggttttggaccccagacaatcacatggcattcggatttattcatgtattccttgttctgttttaagaacatatcagtgatctagagttttgatatcacacatacagatagctagggctgtttggagttgtggttccaggaatgtcccatgtaatttgaaggttttaatgactacttactatgttttgaagtattgcatgatataaagtgaatctataaactgtccccttattaatatataa

SEQ ID NO: 127461 - DNA, 356 bp, Homo sapiens
actatccaactgtacccttaaaataaaccctatcaatgggtgtcttttccttgtaaccactcatctctaagatcatgggttttgacgtcagaccagcctggaatcaaatcttggtcctggcacttcctgtgttatcctttcacatataacctctccaggctttggctgcctcatctgtaaaatggggctaaagccaatcatttcatggagttatgtgagcattcagtgagtcaccattggtgaaagaacctgcttcacaacaataaagaaactgctgaatgcacaaatgctctaaagcagtggtgcaatggcgtgatctcggctcactgcaacctccgccttccgggttcaagcaa

SEQ ID NO: 127462 - DNA, 264 bp, Homo sapiens
aaaggcaggctttctgttcattgcaagagttattattgagagcctatcctttgagaaaatataatgtttgcagaaatagatttgatattctagctatgtaaagaaatgaaactttaaaatgtgagatagaaaaattataaccagaataattagaacaaattacattccacatcaaggcaccttactgtttagacttaagcaattatttaatgtctgcagtattgtcatctgaaaacattctatgacttagagaaaatataccat

SEQ ID NO: 127463 - DNA, 376 bp, Homo sapiens
gaatgcttttttggctccatttattctccaaggtccagctcataagtcacctcctctgggaagccctcctctgcttcctttacttccctaggcacttacggaaggtctcacttccggggtatcccaggatatcatacagtatcctgcaccctcttgtgcaattactcatgacccccagtggtccgtgtgtacccccttaccaggctccgtgtcctattcagctcctcagggctccagcacggaatgggtgagcagtaactattggctaaatggaagttgaattgttgttttgaggcctgctgttatctgcaaggctctcagaaactgctgtgcctcctagcaaaaagccatggaggccacatgaggttaataggca

SEQ ID NO: 127464 - DNA, 921 bp, Homo sapiens
agatgtttccatgtcagtatatataaagggcattctcattagtttggatgcttgcatattattccattgtatggatgtactgtagttttggagtttttaaaaccagggtcctaaaaccaggacattagcttgcttttacttttgttttaaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagcgggcattgcctatgactggacgttttcagtgatggacattcattacttttcaagatagcccagtgcatctttaggtggtttggctcttggtacttccttatatagaataaaaatattcttcaagccttctacctgttggtcttgtttcttcttttgatgatttcttttataaaataattttaatatttgaaggcagctgtcacgtcttcccttcgccattctattcatcatgctttttttttcttccataggttattgcatgaggatctctttaatttcctggttgtcccatttattctagtgctatcccctattatccatactctgaaaatgtgttatctacaatgtggcatttccaagtgtcatttcacctgtgctttttaaagtagggtgtcatatctactcaaataggacaacatctgctgttgtcctatttatgcagggtagaaaagtaatgtaattaaattttccatttctctgaatgtaacatgaatgtgcttttagtagaaactaatttctcagagctgctctgtgtatgc

SEQ ID NO: 127465 - DNA, 409 bp, Homo sapiens
gacaacttgagtcactgaagagttggacctaatgttgcttaccccaggctatataagtgaaattgagtgaaatgtgaaatgtttgatttagaatatagtgattgtatttgttcttttaaatttatatttcttgataatcatactgaatactttcatgaatggtgtgccagatactcttttcagactatgcatcttttgctgttattaaatttattaaattttcataagggtaaaacaagttgacacatttataaagttataaattaagaagtactgtatatttggtaaacaaaaatgactggcttttcaaccaccccctagtcaaatccaccacagactttcctggtagatttaagaaacccagtcttaaactgctgtttgcatatgtcttttgatgttgattattaaa

SEQ ID NO: 127466 - DNA, 1777 bp, Homo sapiens
  misc_feature (13)..(13): n is a, c, g, or t
  misc_feature (1765)..(1765): n is a, c, g, or t
  misc_feature (1775)..(1775): n is a, c, g, or t
gctaggtagaggngggtgtgtgaatcggccgaggaccccacgaggggcctggagctctaaggcccttgggtcctccccaggtcaggccaagtccatgagccatcgctgagcagcccccagggagggaggggtgtgagcgtgggtgggctcccggcacctggcccagcatccacgcctggtgtgtgggcatctgcctgcagaccctcgtccgagggccccgtctctctggacccctcactgcaggtgaatagccacagtccctcccccaggccctgccctgcgtgttggaaacaccacctcctgggccttccccgtttgctcattcgggatccttgtctgggcactgaggacgatgagctccgcctctgttctcgcgtcagggctcggctcctccgtgtgtggggagacaggctgggatagcatgctgggcgactgtggtgagggcaaagacgcagagggcatgagtggggggctgggggggcacctggatgttcagaggccagaaggcaggactacccgcaggtgcccaagggagacccagggccgcccagaagtccagggggagtcctggggcctcggagggatctgagcagggctgcggcctgacccaggatctctctggcctccctggcgtcttcccaggtggcccaggaccgcagtaccagactgagctggactggcattgaccaggccgaggccaccggccatcctcctccggccagaagctgcagtgataggggacatccctagcagttcacaaagctgtggggagaccccgagggggaagggtttccatgctgagccacaggcccggccacggtgcaaagctgtggggggactccgaggaagaagggttttcatgctgagccacagtcccggccatggtgcagggatttggcacgaagcctctcctagggccggtacacgacctagagggctccctggtgtaccctgggacctggcagagtgcagcttctcatccagcaggggtgggtagggccctggactctcctagggcagcactgtttaataggagtgctatgtgagccacatacagagttaagaagaaataagtaaaattcattttaatgaagtattgcgtttcactccatgtactttgaaaatagtatttcaacaatgtaatctatataaaaattgtcacatcttttttactcttttttttgtagagtctgggaaagccagcaggtgttttacatttacaacacttgagtttagactggcagcttctgcgcccaataaccacaaggctgacagcagggaggtgtggggggtccagaacaatataccctctgtgagtgcttatctcatgcccatgctgttcccaggcgcctgctgtctgtctcctcatcctctacctcatcggctctatggtttgaggccagacctcatgcatcaggccagagtgtcctgccgagacccaggatgcacccctcacttggcacagacaaaccagacacaccagcttctgtctttccccatttcagtgggtgaacctggaaccacccagatgactgggctagaagttgacagtcattctcctctcctcactcccctgtcctcccacccagcacacccagccaggcaggtccttagcttccacctcctgaatctctgacctgaatttcactagaaaataaggaatactacgtcaaaatttatgggatgcagctaaagcaatccttaaaggaaaactagcttgtgcttatatgggaaaagaagaaaggtctagaatcttaaggttttnccttaagaancc

SEQ ID NO: 127467 - DNA, 278 bp, Homo sapiens
tgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaa

SEQ ID NO: 127468 - DNA, 157 bp, Homo sapiens
ccggaacatgaccttttcaacctcaatgtttccactaggtggagctactgctccttcatcatgtgagtctaatataaatcatccaccttccctgaattgagcatttggggaagtaagttaagaagcaggtttaagagacaggagtatacagccacac

SEQ ID NO: 127469 - DNA, 176 bp, Homo sapiens
acagtgagactctgtctcaaaaaaaataaataaataaataaataaaaaagaagagcttctgttctaagcactaaatgtacaatcaggtttacagaaaaattggttggggtaaaatactggaaacaactaaatgttaaacagtatgggggggtgggttaagtactttgagtggatta

SEQ ID NO: 127470 - DNA, 470 bp, Homo sapiens
ccacatgttgttcctaattcgatttgttcctcagttgccaaaacttcacaggcagacagaagtgtttctttaaaactttgtcggttgctaccagaaggaaaactgtatttctagatcaactgtctcatccttgacaaatacctgccatggagatgttattactcctatattacagatgaaaaactggggtgggggcaaagagaactgacttgcttaaagtctcacagctagtaagtggtggactctagaactgaaaatcaggttgaactgatcctagatctcattttttataaagctccagtcactcagagtttttcagtccaaatcctagggccagagtgtctagacttttgtagatttgaacagatattgaaagggtaaatgaccaaaggatgaatagaagagagagccaggagcagaatctagtagatctctttgctggggccccataagattcagtagatttaaag

SEQ ID NO: 127471 - DNA, 137 bp, Homo sapiens
tagtgtatataaagtacctaatttagagtccggcatataaaaaacattctaagttagcaaaaattgtgtacctccgctagtaaaacaaattcttcaagtgaaaagctgaactcgctcaatttttaagtgtattatac

SEQ ID NO: 127472 - DNA, 606 bp, Homo sapiens
gtagcgataaggtcttcctatgttgcccaggttggtcttgaacttccgggctcaagcgatcctcctacttcggcctcccaaagtgctggaattacaggtgtgagccaccacgcgtggtctataatttttttttataataaacactttacacgctttagaggagagttccacccgccatgggttggaaactcctgacctctgaaggcactgctgttgcatgacacagtgcttattgttacctcctctgaatctacagatttggaatttagaatatctgaccctccttttttgctccagccctcagactttctggtagtcatgtttgctgagtgaatcttaccagcctcccagattcttggagtcctccatccactgaatggactttttttttttttggccccagatatttcttctagaacaaaaatatctgggtccctacctagtgaagtattggtgtctgatccaatgaattcttaaccagttctcagggcttttatcttaggcatacacagtattcttatctaaattgggaatgatatttcctcccgcacagggtggcagtgaggattaaatgaaataatcagagtgagcatccctaatccaaaa

SEQ ID NO: 127473 - DNA, 532 bp, Homo sapiens
ctgagcccctcaaaagaaaaggagaagcagaagttggaagtgcgtctatcgctttagggacactccagtgctctgaatgagtgagtcttggaatgtgaggcagttcgtctctatgcctctgctcctagaacacacccttcaaaggaaaactttgactttgatccaactttaatcaggggaaggtcattttggtcctaatttcagggttttcagtttctcctggtgtgttgtatgttctcaaactaaacgaggtctccctttgtagtgactgtgatttcaaccacagccactgaatgcaggcctcctgtgcctgctggagtgccaagctgataatatttgtcagtactggtcctgttgagtgatgtgagggttccatagcccctgttaggacaagtaacgggtcactattaagctaggaacttgtctctcattcttttcactgtcgttttgtgtaaccaaagggagtcgttgggggcagagacttctaaaagacctcgcaaaaatcatgaccatccccttccaacgtggagtg

SEQ ID NO: 127474 - DNA, 442 bp, Homo sapiens
ctgctcccacttaacatatacacactcttctcttactccaactcaaaataagaaaagaaggtttctttcccctcaagctaatttcttggtgtacagcaatctttgttcagctattctgcaaccatatgtaaaggaaaggtcattttagagcaggttttcacactctgatctacctggagaagtgaaaagtattgtctggtcattaagtaaaaaaatgacagggtttagaatcccaaaatgtgtaccagtattaagagtttaaaagaatactgtatataggattcaaggataacactaaaaacaacagtgaaactgtcttccaaacaattggaaagaccgtggataatgcagtcactatgtgaagagaaaaaggagattcctaaccgatttctcttcaaaggaagagagagggatatcaatttctcatactaagtgaattagt

SEQ ID NO: 127475 - DNA, 464 bp, Homo sapiens
tagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttg

SEQ ID NO: 127476 - DNA, 759 bp, Homo sapiens
cgccgtggtgcatgcctgtaatcccagcactttgcggggccgaggcaggaggatcacctgaggtcaggagttcaaggcctgcctgaccaacatggtgatactccatctctcctaaaaatagaaatatgagccaggtatgccggcaggcacctgtaatctcagctactcgggaggctgaggcaggagaattgcttgaatccaggaggcagaggttgaagtaagccaagatcatgccattgcactccagcctgggcaacaagattgggagactccatctcaaaaaacaaaaattagccaggtgtggctgggcacggtggctcatgcctgtactcctagcactttgggaggccaaggtgggcagatcacgaggtcaggagttcgagaccagcctggccaacagagaccccccatctctattaaaaatacaaaaaacttcactgggcagggtaacagatgcctgtaatcccagctattcagaaggctgaggcaggaaaatcacttgaacccaaaaggcggaggctgcagtgagccaagatcgcaacactgcactccagcctgggcgacaagaacgagactcagtcttgaaaaataaataaataaataataaataaatattcatgtatgagtttagtcaacagcttatttcattttctctgacaatgctaaatgtatagcctttcctcacccataaaaagttaaccaagggcaggcatgatagctcatgcctataatcctagcactttcagacactgaagtggg

SEQ ID NO: 127477 - DNA, 449 bp, Homo sapiens
atataaatatgtaatcttgcaactgtaaaggcttcttctattactgcaaaatgaagagataagaaatagaagtgatatcaaaagaaatgaaacaaaaaaaggtgatgatgaccaaataagtataaagctcagcttcttgcatccactccatagccagatgaagaaaatactcatgttaatcatttttcttactgtaacacagagatggtgtgaaattcatttcaaaacactaatatttgaaaatacatttgagaaccctatttgtgccaagaaatacattctagcaactttctgcagctagcaaaaagttagaggagcagagcctataaaataatcttaaaataagtaggacattatcttgtcattaaatacttttcagatagaattgtaaaatgtctgagctttaattgcttccactcactatgtcatcctctaggatgcagatcctc

SEQ ID NO: 127478 - DNA, 852 bp, Homo sapiens
agatgatgatcatgggaggtcctgtcctttcaaatatgcgtgtgagttgatcagagcaggggctctgggtacatctctcagtgtcctaaacatcatgtttcagtcatccctttgcagctctgaatgctctgagctttgtcaagcctcactgactaatacatttcattaggttcatttcaaatgacatgcatttgtatacattttaccaggttggttgtatgaatttattttagctgggtgtggtgatggatgcctgtaatcccagctactcgggaggctgagacaggagaatcacttgaacccaggaggtggaagctgcagtaagctgagattgcaccattgtactgcagcctgggcaacgagcaaaactctgtctcaaaaaaacaaaaaaagagcagcagcaactgactggttggatcaggaaagactctgagaaaggactcctgacctggctcttccagaatgaggatggattttccatatgaaggagccgggggcaggaccttctgggtagagcgtgaaaagaacacagtatgtgtggagagcgggaaattgtgttgaactgtctagaaaacagagccacaggaatgcgtgttgagggcttgggctgtacagtggagagtgccctccctggccagggagttggacattcatcccaccacaagaccccatgaagagttcctcaacagctctgtgtcctcatcaaacctgtgtttgcagaacagtggaggaagagagctgaaggaggggagaggccctgcacctgccaggccctggcctagactacaagggtgagcactgagccatgctctcggggaaccttcactggagttgagggcagtgagaatgttt

SEQ ID NO: 127479 - DNA, 309 bp, Homo sapiens
atatttactgaatctggcaatcctaaccaggtatgatcccagaaagaagccactgaaatggggctttggtgctggatcactcaccatccttccttcattgaggaccccaggttggtaatagataaagcacaaatatcacctgggacaaggaattggtctaattgctcaaactttcattggtgatcaactggcatggtatagcggtagaaaggaaggcattagctgatgtgatgtgtcagatgtttgagatttgggcgaaatagggactgaaaggataataaaatcaggtggctactgctaagcttgatt

SEQ ID NO: 127480 - DNA, 620 bp, Homo sapiens
gacaccgtggctgtgggggatcagctctgtgtgagccacacggaaaggggaggccaggattatgaagcggtttgtaattggtggcacatcacgtgatctgactttaaacatactttaggtgactgtccacatcaagtgtggatggcactggcatccatgcaggaagaattgcaaattgcatggctcatacataaatatcgaacggggaagggtctgcgagacgataggacaaactagaggaaagaattgcttatagaaagaatcaaacctgaagttacttgttagcagctctaacaaagccatttgattgaatagggatatttgtgacattttattctaaaaatatggtttcctcttggatttgtgtcaaaggtgggaagatttttaaatagcactcctcaacaatgaataggaacaggcatcttaaatgtacaataatttggtggcatatatgaaggtgtttttatatgagctaacgcccaattttttattagggaggatcagggggttcttgactaccttataaagaaggcagatctgggtaagaaactagagtgtgtcccttgtgggctccttgtttctgcgtgtccctttcatgctggttttacaagattttgctc

SEQ ID NO: 127481 - DNA, 614 bp, Homo sapiens
aaaattggttagggtggggagatgaacaaagataggttaacaggtacagatacaattagataaaagttataataagttctatcgttctacagcagagcagagtgactatagttagcaacaatgtattgtatatttcaaagtagctggaagtgaggactggaattgttctcaacacataaaaataataaatgcacaaagtgatagactcttcaaataccctgacttaatcattacacattctatgcatgtaacaaactaccacatgcaccctgtaagtatgtaaaatataatatatcaataaaaagccaaatattttaaaaattacatgccaattttttttatgtgtgttaaaacaaaagtcaaaagacaagcgaaaacctaggggataatttgtaactcataggagacataggactgttttccaaaatatatagaactcctataaatcaatatttttaaaaatcagcaggtctgacacagtggctcatgtctgtaatcccggcacttcaggaggctgagacaggtagattgcttgagtccaggggttcgagaccagcctgggcaacatgacaaaaccccatctctacaaaaaatacaaaaattagccaggtatg

SEQ ID NO: 127482 - DNA, 289 bp, Homo sapiens
ttatgtgtctggggctgatacttgctgtggctcatcctcagctgtgactgctaactggaacacagactctccatatggtctgaacttgttactcatatagcagctagttccaagagcaagcatcccaaaagcaagagtgaaacaggcagaagctgtaaagccatttagtaccttgtctcgaagtcacaaagtcaaactctaatggttgaggaattacaaaagactgttcaaactcaagggcagtgaacattgatgctatctcttgatggaagaattggtgaggtcacat

SEQ ID NO: 127483 - DNA, 281 bp, Homo sapiens
agtgtccagcacattgaggagagtctctggatagttacctgaggccttccgaagtcatagagtctagaattgtgcatgacttccttccaggctatttaagatcaaaaacatccaatctagcttctcctgtatgcttcttttcttgactggtgcatggacaaagtcccttttgtgtgtctttcaatctgccatattgcaaatatgtacacaaagtcaatcgtgttctcaaggagaaaggggacatagctttcttctcttttttttttttttttttttttgag

SEQ ID NO: 127484 - DNA, 320 bp, Homo sapiens
tgccacccccacaggggtggtgtgatattctgcctctcctaggccctcagtctttgtgggattattgttaaattcacttgggtataagatgaggcaagagattgtagaggaattggcaaaaactcttcaaagtgttcacttttaagtgtttttatagagctctgaatcagtatcagttttactggccttttacaaaaataaagacaggaagttatgttccttcgtatggcaaaatcctattatcgtaggtttttacctattttgttctggtgaaaacgtaatatgtgtgtttaattgtgagtacggtgtgcccattttta

SEQ ID NO: 127485 - DNA, 216 bp, Homo sapiens
taacccttctcttaactaaccataatcccttgcagcattctgacacaagtaaagtgtgcgaacggcatttccctttctcgtgtgcttgaaagtctaataaagaatactaaaaatggtcccacgtttcactttcatgtaattaactaaacactaacatccattggaaagggcctttctgaatgtaatatactcccaaagcacttcagaggcagctat

SEQ ID NO: 127486 - DNA, 733 bp, Homo sapiens
caggtttccaaagatctaatattcacagctgccaggtgaacatggttctggttaacttaggaagaggtaggagagagccttggggggatttgaaaagatcaaaagaactaaaatgacaatctcaaattactataccctcctttttgaaagtgcaaaggctatttttttcatcaatggattaatctgaactaatgtggagaacaaaggaacctctgtacctttctctcccacatggttctgtagctagttttatttcgttttgttcacctcagagaaaactgaaagaccaatgtatgatctttcaactctgttgaatgtgtgtgagatttttttcttttttctttttctttcttttttttttttaaagacagagtcttgctcttgttgcctagcctggagtgcagtggcatgatctcgactcactgcaacttccacctccccggttcaagcgattctcctgctccagcctcccaagcagctgggattacaggcgcccaccaccacaccaggctaattttttgtatttttagtagagacagggtttcaccatgttggccaggctggtctcgaactcctgacctcatgatctacccacctcagcctcccaaagtgctgggattacaggcgtgagccaccgcacctggccaagtgtgtgtgagatcttttattaagtttttacaactcccttaaataatcctcctcattggggaaaaataaaaaataaaaaataaat

SEQ ID NO: 127487 - DNA, 1081 bp, Homo sapiens
  misc_feature (1081)..(1081): n is a, c, g, or t
ggaggcagcatagcagcggggtaacaagtataaacccttggtttgtacctcgaatcttgcgcctgtttcttccccttactgccgtttgggttatctattgctgggtaatgagcccaaattatagtggcttaaaacagtaccattttggccaggtatggtggctcacgcctgtaatcccagcactttggaaggccgaggcaggtggatcacaaggtcaggagattgagaccatcctgaccaacatggtgaaactccatctctactaaaaaaaaaaaaaaaaaaaaaaaaaaaaaaaaaaataccgcgcgggggtggcacggcggaggtggcgccgtgtgtacaaccccaactctacccaggagagagcgggagaggagccaggagaagaatccctgttggaaccccggggagagggggcgaggcgtcggcaggtgagaacctaccaaagagacgcgcgccccactggggagagacgcagccacgccgtgcggagcgcaggaaagagcggagagaacagcgcggctcgccagacaaacacacaacagaactcaaagggtggcgcgccaccgttgctgtggttcaaatcacacgaggcaaacacacccggggagagctacagagcacatgttgggggcagaacgaggacacaaaatatggcggggcaccacacgatgcgtcaagcccacagcggatcgacgcacaagagacaaatacctacactctcagaaggggccgaacacacgcgctctcgcagagaagaaaaaacacacgatggccatcacaacaacgaccggaagagcagaaactaacacgaagacgagccccccaaacgaagaaaaaacaagggacggcgggacaccacagacatagtgagtacgaagaagtagcggcactagaacgacagaacaaacaacaacggacacacaaccagagcggggaagaaataaaaccacactattatttagcagagaagacacccacgaaagggagtctgactcacacacaagaagagacaagacccgcaccaacggagtgggaaccacacacaaacgaataaacaatgtggggcgaccaccccaan

SEQ ID NO: 127488 - DNA, 718 bp, Homo sapiens
gtagggaaggctgcctctttgcctccatgaactgagactttctactgcccacactgtagcctcctttattctcccctctgcagactgctaagagagagctctttggcatacaaaataggcctcggacttccttatcagggtgctttctttcatttcatagagccctccccggccagatattcatgtcgcagatgtatgagctcctgcagtcattatcaatcactgaatgcttaacaaatatttaatgaatggcttctatgagcaagcgagacgtgacattctgtaatggtggttggggcggggggtgggggtgcatgcatttttggtttcgtttatttcatttttggagtttatgaaatgtcttaactgttaagtcacagaaaaggtttcccacataaaaaacataaaaatctgttctatctgatctgcttttatgcatttttctaagcccctggttttctaattagggggaaagaagaggaagttttattctcatacccattatggcatgtgaccatggttcaattatatttttcttttggctggataagggtaatgaatagatctttatcaaataatttgatagacattgttatatccagcaacttttgctaatacaatgcacttggaatctcatctgtgtttgaagtttgcaccgacatctgcagaaactcagagagaagctccctagggatcatctctggtatttatgacctgc

SEQ ID NO: 127489 - DNA, 477 bp, Homo sapiens
atattttactaatatttttactaattgctaatcttttgaattgtagattcagggaagcagagccctacaaagaagtctcccttcgaagaccctggcctgactccatttgagagagaaaattggcccacatgtgggaggactgtcctgaggctcctgtgaggccaggccaagaaaccttgagatggccaagaacccttgagatggcaaagaatgctttctcctgtctgctaagattgccctcagagttctggtttcctgtctgaggacctacatcttcttccagccattggctggacagatgtggtctacccacagggctgtggtctcagccttgcaagcctctatggaacaaccacattagaacatgatgtgcataggaaaaattatcagtgcatataatggtgataatatcattttgaagtccctcaactcgctgccttcttttacattttcttgtacttacctttcccccaatct

SEQ ID NO: 127490 - DNA, 231 bp, Homo sapiens
agctctagggcagcccctaccctcagcctggggatacccaacaaacgcttccaagccctgagactccatgactcgctgggagtgtggaattggtaaggagcttaattctgctttgtgtagtctgtttgtgtagcctgacttatctctccactacacacatacacatacacacacacacatacatacacacgcacgcacacgcacacagaacctgggctttctttttttttt

SEQ ID NO: 127491 - DNA, 737 bp, Homo sapiens
aacatagggagaccctgtctctacaaaaaattttttaaaaattagctgggcatggcggtgtgcgcttgtagtcccagctactcaggaggctgaggcaggaggatcacttgagcccaggaaattgaggctgcagcgagccatgatggcaccactgcactgcagcctgggcgtcagaacgagacctgctctcaaaaaaacaaacaaacaacaaaaaaaaaggctttcttaaagagacttgagaacagaaaggggaacagatacataacttatatatttatttgttcatctttccaccttcctggagggtggaggggaacaggtctgtatttggagttttgaatgctaaaagtgggaatacatgtactgtttgccatgatctgttcaaaagttaagccaaatgccttagattctcctgaaaactggaatgccactgtaaactataagccccacttcaaagataaaagatcttgatgaacagggctgggtctgtggactgggcctctccccaccacacaaggaagggtggtgccagttgaaggaaaatcacttaaatccttgctgtctcctaataaggtgtggtcccaggtagggctgtcagaattagcaaattaaaacacagggcatctgtgaaaattagaatttcagataacaacaaataattggcataggctgcataatgtccctcaaagatatcaggtcctaatctccagaacctgtaaatgtgatcttatttggaa

SEQ ID NO: 127492 - DNA, 378 bp, Homo sapiens
tcatcctgactgttgcagttaagccattgtcatctcatttactaaattggtattgacgacctcctgtgccccagacgttattccaggtgctggagatacagtgacaaagagccctctcggagggctcaagtaaaggaactaggatgaaaagtgctgagtgtcatgctaagggaagcgctggctgtggaagtgtccctcacctagcctgggatcggggtggtggttgcaggaggcatccaaggaaatgacatttacacggaggtctgaggggcagcgaggtggtgggaaggtggctccaggtaggaggtgagaagagagcgcacaaagtcaggttgtagcacagtctggctgggaagagaagtcggctggtcaggtggg

SEQ ID NO: 127493 - DNA, 279 bp, Homo sapiens
acttttctcatccataaaatagaaataataaccataggtacttcaaatgttgtcaggattacattagataattaatgcaaaaacctcagcactattttcagaacatacctaatctttcaaaaaaaatgttaagcgattttaattattatccccactgcattagtgcctctctctccttttctgggagaaagtcctcacattatagcatccccctcctcccatcaaaataggcttttaaaggccgggcgcggtagctcacgtctgtaatcccagcacttt

SEQ ID NO: 127494 - DNA, 199 bp, Homo sapiens
aggaacccagtgacctcaaataatggcagcaagtgcctttgaaggagcagaagcagcaggcagagtagctatctctcagggacagcataactgggactcttgagggcaggcggctggactgaacatatgctgcaagttgccacgggattctacttggaagcaggatactcagcactgacctgcacgcaccatgccctag

SEQ ID NO: 127495 - DNA, 410 bp, Homo sapiens
cgtgagtcagatatatcttacgcagataaagccactaaacttctcctttctttctttgtgctagtcaccgctgcatttctcataaaggttatggaaggaaaaaaaggaaccatgacttgacttcctttgtatgtttctaagtttctgagtatgataagccagtctggctaataattcccatggtgaattgaattccagtcattttcaggaagctggctattttcaaagttcattttatactaggacgtgattgccaattcctgaatgggaggctacaaggttgtggaaaaaagattgagctagatgtagcagtcctgaaaatcatgaaactttcttcatgtgaatgaggtctggttacttacagtttaaatgtaatttttctgttttttaataagagagctgttatagac

SEQ ID NO: 127496 - DNA, 645 bp, Homo sapiens
gtagagacggggtttcaccatgttagccaggatgatcttgatctcctgaccttgtgatccgcccgcctcggcctcccaaagtgctgggattacaggtatggtggcatattcctgtagtcccagatactcaggaagctgagatgcaagggtctcttgatccctgaaggttgaggctacggtgagccatgatgatgccactgcattttagcctgtgcaacagaatcagagcctgtttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaagctccctggctcaagcgatccctcccctcagcctcctgagtagctgagactacaggtgagtgccaccacactcagctaatttttaaatttctggtagacagggtctccctatgttgcccaggctggtcttgaactcctagactcaagtgatcctcctgtcttggcctcccaaagtgctgagattacaggtgg

SEQ ID NO: 127497 - DNA, 393 bp, Homo sapiens
cacctactgaaaccaccaccaacctcaggcgcttcccctggtgtccgcctgggatgtgaatgctccctcccctaagcgccatggaccatgtgtttcttttgcaacccctgaaataggctgcctctcatgcctgcttgctgctgcttccttctaagcagccacggcaatgataggctgcatgccctgctctgttcctcagtctcctgagcagtgagactccctagcaatacagagcaagtcctctggcaaggtaacactttccttgaaattccaaaaattcctattgctcattaaatgactaaaaagccatctgaatccctacatttcaatgtacttattttgcatggttgcacagcattcacaatggcattatactgacaagctaggaagtat

SEQ ID NO: 127498 - DNA, 384 bp, Homo sapiens
gtactgggaatgggttgcttttcctgctgttaaccaggcttttacctccgtcctagggtgcagacccttgaagtattgagagagtcaggtcacgtgaatagcatgcagattgtagactccccacaaaccaaggggtgctcctgacccagcttcatctggagctattgccctcacaaggacagaagcaattaaattgtttgttctgctacagagtaaatggtctactgagaacttgtttgtacttttatatgtttttatggttaatgttttcagtgacccatgttataaagtaaaccataactacttctgtaagcatgttatagtagtaaagcaaaactgtatattcctagatatttatatcacttcactcaaaccctcggagta

SEQ ID NO: 127499 - DNA, 717 bp, Homo sapiens
gcactggggagctccacacacgcggctccgcagctttgcgcgcccttctaccgcgagcggctgagtatccgcctggctcccctgcggggttcctccgtggtcttccggagattctttctgaagcagctttagaatagtcaagcctatttttctactccatttctttttgtaatgtggggtcacctttccgctctagaaattgcttttcttacgcgattcccaccccaactctcgccaagggccctggttctcatctccccagtcttagcttctgacaagcctccaagaaactgcgcttttttcttttctggagatgcagagtatgaaaatgattttgcaagacttttccaggtcatgaggtgctctctgagaaatctcttctgttccctaaagtagtaagtgactcaactgaagcgaagcaataattattaaatggatctctagtggcctaggggcattaacacatttttttcctttgaagttattatacaattaaataactttagagtggtagttcccaaaatgtgtgactttaggcactagtttgcctaaatgctgctctagcaagtcattcacttcaaaaatattgagccacttctatatgccctggctggcactctaggaacagtggtgaagaagacagatatatttacctgtcctgatagaagttacagtttggtgaaaacgataaattagtaacaagtgcaaataagattt

SEQ ID NO: 127500 - DNA, 483 bp, Homo sapiens
tgagataaaacatttaaaagctagcagatgtctcagcacttagtaaacattcaattttgtatttatataaaagtgatatttgtaaaatcacaaatttaagtcaaagaagcaggatgtgcacttgctctgctgccttgtatatcaaagtgacattccagaaaaggagatgctgtgcatactggtacgtgggtccgtcggggaaagtctgatggctaatagcttttaattagttacactgcccttaaggccagaaataatgtgaataagggccgtatgcagtttttcttgtttcaaacaacagtgtatataaggttatagtgtttgagctattcagatgctggatggtttaagaaggtagatttatttctgagatgtgcttcagaaaagaagtgtgattttcacatgggtcttcaaataagacagctaacctttgaaaggattttaagaataaacatcatgtaactgtttttttttttttttttt

SEQ ID NO: 127501 - DNA, 496 bp, Homo sapiens
cccaatctgtaagcaggggtggactccagcgctagctggtgtccccgtctacaggcctttgttcaataaacctgtgttgccatagagccatctccattccgttccttctcccttccttgctctcagttctgaaacccgggacgacgcttgggttcacttggaggaatccctttttgcaacctgggaagcagtgagcagcggcagctcatcccaggtgaattcccagatcctaattagacccttcactcccagccccgtcttcctaccactttcccttttctctccttcttccactaggaggctccagcaaggatcactccaattactggacatcatatccaacaccagtctccgatttctgggtgagttccccctttccccctctggattcctctcatatttccagaaaagcccagtgccaggtgagagaactccccagtcaccactgggtaaccctgacctgccttctcaggggatgtcctcagaatgctcactg

SEQ ID NO: 127502 - DNA, 476 bp, Homo sapiens
ctttagggatggactaaatggctgacattgtcacttataaaagtgtcttaaacttgacagagcttatgttgaaaaataaagtttatattttttctttttatcttttaattccattttcccgtgacctttttgaagttcccttaatgtaagagagagagctaatacataatgatcaaactggtttatttcagaaatggaaagttaatttaaccttcaaaacttcaattagtaatgcaactaatctgtagtgacagaaagtagatcaggtgtggagcaggggtaggagggaaggggctggagacagggattacaggagggataagaaaatgtttggggccaggcatgttggctcacacctgtaatcccagcactttgggaggccaaggtgggcagatcactttgagctcaggagttcaagaccaacctgaggaaatggtgaaaccccatttctacaaaaaatgcaaaaattagccagg

SEQ ID NO: 127503 - DNA, 448 bp, Homo sapiens
attggggaacattctttccccagacaaaacggtttccctacaagacccttattatatgtcattgtacacaggcatttacaaatattgtcttaaatgtagaattaaaatctatactccagctctaactaagttagcaagcattactttttgagtttgaccaaagtagttcattccaaaacatgaaaagccacaaacatttaatcttaggttcctatttttaacaacaatatacagaaatcttcgcaatagcgaaatattactgaaccaccagtgttgttaaacacaaaaataaattagttaggcttgatatacttttccttccctccctcagattccccacctgtttttcagtttcaggaaaaggcagccactgatctccacagcactcaccggaattacctctcttctgggatgataaaggggccatgcctttatttatttatttatt

SEQ ID NO: 127504 - DNA, 329 bp, Homo sapiens
ttcactcagtcagcctcactatttcttaaactacataggaaaaaaaaaatccctctattgttacagataaacaaagctggacactgtttagagtagtcagaacatactttaatcaataatatgtttttgcaataaggaagagattccagcatgaactgaactcaactttgatttgtatagaggttactgggtcttttaaaaggagaatgaaggagtgggggtggggggttcaatggaggctcagtagagtcaggaaaatgaaaaattacaaaagcttggtcagtgtaaatgcaattaggcccttgtgtttggtagctggcaagtaacga

SEQ ID NO: 127505 - DNA, 285 bp, Homo sapiens
cacttagttgtaagtggcctgtacggcttgggatggtggggtctggcttagggaatcagttagaaggattccttcttctccacttcttttggacaaggagaattaaaaaatcacctgtcaccttttcactattaccatgtacgtcagatatttttagttctgcaggtggaattgttaaggtgattgagaatgaggtcttttttttctttttggagcagcaatagagcagaatgaaaggtgagatggtcttaaggaatctgttaagggaagaaggtggcctaggct

SEQ ID NO: 127506 - DNA, 370 bp, Homo sapiens
caaaatggattaaaaaacaggatgcaactacatactgtctacaagagatcacgttaactcatagaaaacacacaggttaaaagtgaaaaaaaaaatgaagaaagacattccatgcaaataatcaccaaaagagagcagggatgcctgtaacaaaaacagccaaaatagactgcaaatcaaaaactgttacaagcaataaagaaggacattacataatgataatgaaagtataacttcaccaagaagacataacaattataaacatatatgtgccaaacatcagagttcaaaaatatataaagcaagcactgacacaattaagaagaagaaacagacagttccttgataataataggagacttcaatatct

SEQ ID NO: 127507 - DNA, 464 bp, Homo sapiens
gaagaaaccaatggataggtgagtagaagagagagtacatgagatcattcaaaagacagtcacctagaccagagactaaggtagggaccatattaaataatagatgggtaaataggtatatagatagacagaaagatacataggtataaacaaaaccatcttaattcttctgagagttgctggcaagtgaaaagaatcagttttggctccagatgtaaatatggggaaaaagagaaattatgtgttgaaactgacagattgctcacttcaaaaagatgaaatttgttatattgtaacccaatgagagagaagtcagtctctggagaggtcaattctatttgttctcaagaaattcactgagatttgaaggattagtgtagaaaggagtgttattcatgacaggaagcttttggtattcttcctaatacctgaggaacagaccaaatcttcttgcttgttccaag

SEQ ID NO: 127508 - DNA, 378 bp, Homo sapiens
aatacacttacaaaaataagaaaagtcaagctgcagatgtcaatccaagtagaaatgtcctataagtactctgaaaaataggactagaacataagcctgagatcatgtatacaaatacaggagtctcctgactagaatggacagctaggtaagatcaaatgtacctagatagcgagtataggggaaaaaggaagactaaaacacagcagctttttaatctactgtaaatataatctgttccatctaaaagaaatgttatatccctctaagaagaaaattacaggtaataaaaataaagacattcggaggccaaggtgggaggatcatttgagcccaggagtttgacaccagccaacaaagcaagaccctgtctctact

SEQ ID NO: 127509 - DNA, 705 bp, Homo sapiens
agggttttttttgtcttgttttgttttgggttttttttgagacagagtctcgctctgtcaccaggctggagtgcagtggcacgatcttggctcactgcaacctctgcctcccaggttcaagcgattctcctgcctcagcctcccgagtagctaggataacagacacatgccaccacgcccagctaacttttgtatttttagtagagatggggtttcaccatgttggccaggatggtctcaatctcttgacctcgtgatccacccaccttggcctcccaaagtgctgggattataggtatgagccactgcaccgggctggttttttttttttttaattctgcgtcatttttttcatataactcaatactttgagtttatttcatacttgatatcttccacaacaaggactagcattattcccatttcacagatgaagtaagtgaggcccagttatgtgactttctcagagtggcaaaggcagatgttaccccagccctatttctacctctgccaccaccaatctctaactcagccctcgggccacgttcccacacactcttaagactgtgttcaaatcctaattctgtttcctgccaacatgtggccttggatatatcacttgccctttctgagcttctggagaacatcttgccttcatgatagtgttgttatgaggactaaatttaaggactaggattcttgagt

SEQ ID NO: 127510 - DNA, 359 bp, Homo sapiens
agcaggtgtaggatacacggataccaaagcctggccaacatggtgaaacccaacctctactaaaaatacaaaaacctagtgggaagcggtggttcacgcctgtaatcccagcaactctgaggctcaggtgggaggatggcttgaaccccggaggcagaggctacagtcacccagatcacactgctgcactccagctggacagagtgagacttaagaaaaataaaatctccaacctggccaacatggcgaaatcctgtctccactaaaaacacaaaaaaaagctgggtgtggtggtgcacgcctgtgatctcagctactggggaggccaaggctggagaattgctggaacctgggaggca

SEQ ID NO: 127511 - DNA, 517 bp, Homo sapiens
tttcccacagcagtcagactgaaatttctacaaagaaagtaggctctatcgttttctcgttgatgtgcttcccatttcaaccagaatccagggcccctgccccctcattcattgtgatcagtcacagtgatcttttttttctgtactttaaacacccaagcttgctccatcacagtgcttttatatttgctgttctgtgtctggagcagttttgccccagagcttcaatcactgtctcttcgtcattctggtctaaactcagacatgaccctctcagagaggcctttcctgaccacacttcatattgtcatattttaactgaatagcatttgtcagtgggtctacttcatcactgtctctttcctagaacacagttttcttgcaggcagggactggtggccatgtgtccccagtgcctagaaggtgctttgggggactgactggctgactttgcaggatgaaccccctgcttgctgcttcagtgcctttttcatggttgtgccttctcttccctaca

SEQ ID NO: 127512 - DNA, 219 bp, Homo sapiens
tcccaaagtgctgggaatacaggcctgagccaccgtgcccggctagagtccttaaaaatatttttttggttgttgaaggagtcatcgggactggggactgcctgggaccccttctaatttccttctcctctgtgttacacacagcggtgctctttttattgatacataattgtacatatttatggggtacagagtgatacttccatgcatgtatacaat

SEQ ID NO: 127513 - DNA, 699 bp, Homo sapiens
gggccgggagggacctgagtagtgttacggcgctgttagttttctccttacttggcacgagttttgtaatacctcctcgccccaggcgctctgccgtctggttacgagcctcactgggatcagaattcattcctttcttagacaaatacttcttgattgcttattatttgccagagagtgttctaggttctggggatatggcagtgaacaaaacagacaaaaatttctgcctttgaagctgggcatggtggcgcgcgctgtactcccagctactctggcggctgaggtggaaggattgttggaaacctggagtccagcctggtcaacatggcgagaccctgtctcttaaaaaataaatctgccttggagcttacattttggcaggatgagacaggcaataaagatgtttagtaacgatattgtattagaaggcaataattacgagaaatagtagagcatggatgggacaggatgatgtaatagagagaaagcagtgagtgtaaggaacttgagcttttacagtaggaaggccccaaaagccttctcccccagctccccttcccttaaaaaaaaaaactactgatgtggaaagtggcatctatgggaaggttatctcctaactggcagagcaaggtcacgcagtgagtcagcctctgcgctcactctccagactcttctaaacaaatctcaaggatctgt

SEQ ID NO: 127514 - DNA, 711 bp, Homo sapiens
gatttttgttgtagagtaaggcaaacatatttcattgaataaggtgcattgtatctcgctgtgaccaggtgattattttttgttgtaagtacagaaataagcactctcctataatgaccaaaattacaatgattttcacagttatgggcttacctgtgtcctgctgttaatcagtcatgtcatgctaatcatgtctttaactctttttgaattaaacccatttactaagtacagcaagaacaaggcacagggtgaaacttaaaagcacatgtctctttgcttttcttcagttagtggaaaccacacattattctaacttggtttttgttatatttcaaaggcagtcatgttcagaaaagaggcttattccctagatttccctttagtttgattacaacttcatttacaaaatgtaaatggattttcacacaaaaaaagccattcttcgagaaaataaacatttcttcgtgaaactggttaatgttgtaatgtactgttagggtactctgtaagttagagaaaatatcaactgtaccttgagcttaattagaataatcatttcatgtatgatcagtgtaagctaaatatcctagatagtgacaagatgcatttataaacattttcttatatgcagaattaataaaatgcaatgatagggcaatactgccacctagagaggaaaatgtaataagccttattaagaattaaatc

SEQ ID NO: 127515 - DNA, 718 bp, Homo sapiens
gggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggc

SEQ ID NO: 127516 - DNA, 549 bp, Homo sapiens
atattactacagggtaaaatattggacctgaaatgaaagctcttcttcaggttgaattgctaagtatgagtctaggcttcttggaggaagaagaaatatgcactttaaccaggaagtgaatggagccattggaagagtgttgtgtagatgggtaatgatttcacacacacaaatcttatttattcatttttatgaaatcagatctctgtgttaatatatttagagaggaaaagacttggactcaggcagttaagaaagaaagttctaatggtactttagttgcgaaaagaaagacaagagaagcataaggttagagagggagaaattaatttgtaatggacgtgtaggatttcctgtgcagcacccctttctctgattcttctgataaaaccaacttctccatttagggattaaatacttgccctccaccatgccaacagtgtggttctaacaggggctactatgtggatggatcaaatctgtcagttccttctatcttcttattctccagcccaccacactaactggggccaagcaggggagacataa

SEQ ID NO: 127517 - DNA, 424 bp, Homo sapiens
ctgaaactcaagtcctgtagagacctaggaaactactcccctccacaagatctcatcacttccttgccaaagagctgttcttaacacgaaggccccatatccctaaggggcccatagatagaattcaggaggcctgtgaatttggatgggaatgaaattacatctttgttttcaatattctcttactgaaagttagcatttccttcaattacatatggagcaaccaaccacaataatattagcaataactgtgattttgtcatcaatagaaatcaacagatgttttcatatcacattacattgctacagatatctcaaagtattatttacactcatcattacttctaaattacggtaaaaaatagaggccaggcgcggtggctcacgcctgtaatcccacactttgggaggccgaggcaggcag

SEQ ID NO: 127518 - DNA, 335 bp, Homo sapiens
tgcagttaaggtggaagggtctgtttgttttcagaaaaaaaaaactaggattaatagcaaggcgaaaaacacttgatgtcaaatctctcagaaaaccaaataattttttggtttgatttgttagttttggctgccgtttaattccttaagaagctagggtaatagttgtgtactttcaggccatttccaccccttctattgtgaagatggagctccccacactagtcggtgtagtgtttctctgctaggccagccaagtagaaaactccaattagccgacaactggttaaagtgctgctgagactagacacagggggagaaaatggctcttgtca

SEQ ID NO: 127519 - DNA, 156 bp, Homo sapiens
gattactgattgagcctccttactcatattagtatgttcagattttctatttcttcttcatgatacagtcttggtaagctgtatatgtctagaaattcatccatttttttctagattatccaatttgttgatgtatagttgttcatagtagtctct

SEQ ID NO: 127520 - DNA, 171 bp, Homo sapiens
agaagaatgttttctatgaaacaggagaaacatgttgaaaaagaaatacagaggattagaagaaggggttgactgaaaataattcacaatgagcagatccttgcaaacatgcccctaaaggtcgaggatgctgagaggctgaataaagggactgacaaacccagtttctca

SEQ ID NO: 127521 - DNA, 707 bp, Homo sapiens
ttttcatttaccagtaataaggaatgaacgaaaattactcaaatttggctttggaacatgtaaaagtacccacttaattctgatgtacatttgggttaagattcactctgttggtctctcaggttctatgaggtcaaggagcttgcttgtcttgttcactatgaaactcccaaatgttcagcatattgcctggttctcaatgaatacaaaggaaggcactgttctgagatggtatgaggactggaccaaggaaaggaatctggcaacttcataacctttggagtgtgggcactggagaggcttctagcgaacaaacctgcagagaaatgcagcatacaattctcatgggcttctgtcttgggctcatgaatgaaactgataatcttcaatcttaaaatttcccaaaggcacacctttttaactctgcctacagtaattgctcatgtacatattaacagctctcaaaaacgtgggcctcattgactaattgaaacaatctgtcttgatatgtggatgtaatggttgttaatataagagctacactctggaagaacagaccttaaaaagatcattttctgagccgggcgcggttgtcacgcctgtaatcccagcactttgggaggccgaggcgggcggatcacgaggtcaggagatcgagaccatcctggctaacacggtgaaaccccgtctctactaaaaaaaaaaaa

SEQ ID NO: 127522 - DNA, 340 bp, Homo sapiens
cagctaagtgggcacacaggagagcagtgaggccatttgaggcctgagcctggtcctcaggactcgactctctctccctgccatcaagcagcctgccccagccctgccagccatctccacactcctgacagaatgaatgccctcgatggtgttcctttcaagttgcccaagggctttgtgataggcacagagcctctccctgggccagaactcagcgtcccggcctgcggggaagttctgctgggttctatgcacgacttcagcctggagaggacggcactcttctgggtggaggccgccggccagggacccagcccgtaccagtgcggtgacccgggga

SEQ ID NO: 127523 - DNA, 616 bp, Homo sapiens
tatgtttttttgtgtatgtgttatctctttacattgcctctctgcaacaggagctactaagaattacatacaaacacacataagtatgtgaatatatatgtatatattataggtgttcatttttgtttgggtataatttcagacttacagaaaagttacaagaatagtgcagagaattcctgaatacccttcatctagattccccaaatggtagcattgggctacatttgctttattctttctttccctccctgtctcctatgtgtatatgtatccatatgtgcatgtgtgtacattatgcatgtatggtgtgtctatgtgtacatataaaatattttcttccaaaaccatttaagagaaagttgtaggcacaataatatatctttcaccctaaatactccatatagttcatttttgtgttcaaaaattgcttgttggtggttatgctcttcatttgaaataagttaggttcattgtagtgatacctgttttctaaattagtaaattgataatttgcacagtagaacacataatgtggcctggtagttagataaacaaaaaagctgcttaataaaaatggatatattctggaggccagggttggttaaaatatggt

SEQ ID NO: 127524 - DNA, 289 bp, Homo sapiens
gacaaccatgctgaccgctctctttgcattcacagccgcggactccagggaggccctagggctgcatcaatcctactcaatctccccagtccacgcactcttccacccccaagtgaccagtcacatcttttcttctttcaaatctccaacacctccttccctctctcctcattctcaactgaggaccttccttcctacaacacggagaagatgggaagactcagaagagactctccatgtacttctgccacaccagctaccaccctacctgtacctacagagcctgccc

SEQ ID NO: 127525 - DNA, 420 bp, Homo sapiens
  misc_feature (13)..(13): n is a, c, g, or t
ggcatggtcccgnacgtcacgttcgccatgcacccctttaacgtgatctctcctgctgctcccgcacactgcagaccccgggtgaggtgggcgtaggtgtcccgagagaagataccggggcagaagcaggggtgcttccatgggcagtgagggagctggtcaggaaccgtgtggtaggcgacaaggtgggaccaggttgcctggtggtaaggttggtgactggagaggtggggatacccgtcacccccgaggtgagtgacacaaagcctgatgtgggaactcgggtggtgagagaagtggaccgcgaggtggtggatgaggggctgccaagttagcaatgaatgtttcccatttcttcttagtttatggactttccataaactcaggatggcagtttggttggttggagaaggatatggt

SEQ ID NO: 127526 - DNA, 737 bp, Homo sapiens
caatgaggggcagagaattatggtcatttttgaaatcagtctacctcagtcaacaaaagcaggttcttttaaaacacttttgaagacagatcaagagaaaggaagatacaggtaaccagtcaagaataaaaaaatgagacatcgtttcagatcttattggtattaaaaataaattaggcatctattttaaatcaacaaatttgaaaatttagacaaaatggatacaacttaaaaattgacatacgaaggaatagaaagtctgaatccataatttaaaactttctgtagtgaaatctctaggctcaggtagcttcaccagtgaattttattcattatttaaggaagaaataacagccatatacaagcctatctggagagtggaaaaaggaggaatacattccaacatgttttgctaccagaataaccttgataccaaaacctgagacgtgtattatgagaaagaaaaattgtgggccagttctatttatgaatggacatttcttaaaaaaaaaaatcaccagaatgccaggaaacaatttgctcaagttgattttgcattaaattggtttaacatttgaagttgaaattgaatttgaaattaaatttgaagttgaagttggttaacatttgcagttgaaatccactgcaataacagaattaaggagaaatgttgttttaatagatagtgaaaaatgataaatttagatatccacttgtagttgggaactcttagcaaa

SEQ ID NO: 127527 - DNA, 744 bp, Homo sapiens
tatcttaggttcattgtctggaacccctgtaacaaaagacagattaagaagaagaaagcatactaatttatttaatgtaagttatacatgaaaaaaaatgaagacctgaagaagtaattaaacctgggtggggttttgctgctgtttgtggtggtggtggtgatggtgttttcgaggcagggtctcgctgtatcgcccagcctggtctctcacaggagggtcttaggcctgcttcaggggaaggtcagaaaagtcttcctaggttttaggacctgctgcagaggggaaagaagaggaatggccaggggaggtcagagaaaccttcctgaacatgctgtttctcaaattccttctgcttaaactgttcgctatgctaaggtgccagatttgggagtagcgtgtcctgaagaccatcaactttgcaggtggtttgatgtggttacaagtgcttaaaaatgccctctgttgcctcatctttgaaatgggataacagtgatactaatagctcctgtccaacagaggcattcagtgcctggcatgtcattagtattatatatacataacaaataatatcctgtctgtttctttgaggagtttcagacacactatcaagaaagcctgctgtgttgaagtgtaagagtgcagccccgcttacagcgcttcttggttagaaaggcccaggctaggctgggcatggtagctcatgcctgtaatcctggcactttgggaggccgaggcaggtgg

SEQ ID NO: 127528 - DNA, 746 bp, Homo sapiens
ggcataagagtatggacatacagagatgtgaattagagaatgattgcaagaagcagtgaggcaaaaaggattaatgaaacattgatctgtcttacatacacagctattgacagtaccttgtgtgtgcatagcactattctagattcacctaatcttcaatgataatactgtatttaccatttaacaagcctgtaataagtgtcaggcacttctctgattacatcacatacatatgtgataagttccatattaactctagaaggtggggaaacataatcatctaaatttaccagatgaatatgtagaggtacagggagattaagtaatttgcttaaggtagctcagctggtacgtggtagagtcaggattttaatggtggcagcatgacagtaggattaaagattcttaaccagtcagttgtcacgatctctcagattttaatagaattctaaaaaggatagaacaaaatataaaatggcaggaatcatagtatcttctaacaagaactagacatgtcccattgaggatgctctttaaaaataaaacccattaaaattttgggttgtttactcaaagcctatagacattggcatattatattttcttagataaaaactgagatatcctaaataactcatgcccattctctagacttgcatagggagctgtctatgataatatccataacagttatcttgtttcacaattttattactatctcactcttcttactttgtgaagatgaa

SEQ ID NO: 127529 - DNA, 728 bp, Homo sapiens
aggaacttaatgaagaacataatcattgccagtggccagtttaaatattgacttgcagatattttttcaaaccttagaatttgaaattcagaaacaagtgaaacctgagtaagagacgtgatagaaaaccaaagaatgtcacgaccatggtcagtgttttctgtgatagatttgttactgaaaaaattgtggttaaggaacatctggtaagtcaatcaggttttaaatgtattgagaaagcataagaaaagttgctaaattattttttaaaatgacttaaactaccttctaattcatttggtaaaattcagaagtttatgtactatgttgttatccctgcaaggctatacctatgaccaattcattaagtacaaaattaaggcaagttgtttagggtcaagtagatgaaacttttgttggttttatatatatatatatttggagatagggtcttgctttatcacccaggcacagtcatggctcactgcagcctcgacctcctgggctcaggtgattctcctgcctcagcctcctgaatagctgggactataggcacataccaccacacccagctaatgtttgtattttttgtagagatggggtttcaccttgttgcccaggctggtctcgactcctggattcaagcatttcgcccatctcggcctcccgaagtgctgggattacaggcatgagccgctgagtccagcccttttttttttgggggggga

SEQ ID NO: 127530 - DNA, 433 bp, Homo sapiens
tgggtccatttatatgaaattctgcaacagactaaactatagtacaaaaacttcaaaacagttgttgctatggggatgagaatgagagtgtggactgaaaaggggcatgatgaaagtatctggggtgacaagttctatatcttgacagggatttgggttgtacaggtgtatgcatttttctaaactcatagaatgtacacttaagatttctgtatttcaatagatataaattttatatcaaaagaaaaattacatatatttatttgcatgctgacatatttagttggaaaactactaatgtctgcaatttactttgaaatgcatcaaaaagtaagccagataaatagatggatagagggacacacagatgatggatgtcagataaaaacaaggaagtagggtaaaacgttaatggaaaaattctgatggtgga

SEQ ID NO: 127531 - DNA, 421 bp, Homo sapiens
ctatgggcggggactgggggtcgggaaaagccttttcactgagagtgtccggctcctgggtctcactccatggcttgcctcagtgccccgcagaagtccctgagaaggcaggcctgcggggcaggggggctgtctgaggggctcagtcaccaaacaagccccagttccatggcaaccattatacccattcatcaaggagatgtagagggaggtgcttcctggttcaccccaccctcagcagagacagaccccagatctgggcccaggactttgtgcagggaggggaaatgcaggtgaccagcccctattcctccatcaaaccaggcttgaagatgggttaaatcagagcttttcattccacaaaagagaaattttaatggggtcagaacattgatcttctaatatttgaaagcctgttaac

SEQ ID NO: 127532 - DNA, 474 bp, Homo sapiens
  misc_feature (16)..(16): n is a, c, g, or t
aacgctctctctgtgnggggacgctcctcggtggggacgctctctctgtggggttggctcatacacccactgaaggaatgtttttaaattaactctgaagccaaaagccctccagggttaagtcccaattttggggttcacctgtgtcagcctggtgaccctgaaggaaggaaccatcaaaatgaagagaccatgaagggagcatcaagatgagcgggttgaccatcaagataaagtttggagttgtgatactgtaatgctatatactagccaaaggctcttttcagagccatgttttcttggtgactaactggttgtacactgaagctttggaaacctttgcctggacccaaattaatggccaattggcaccatgtggtttctgtgatttccctgtcatattgacctttctgggtaaaccaggaaatgaaagtggggcctccagctagtcccatgttcagattatgtccccat

SEQ ID NO: 127533 - DNA, 448 bp, Homo sapiens
gaacagtaagtgcatcctgcacaggggaggagctggtagtgtgtctgtcttaggagattaacaagaagactgtacttcacaggagaagaatagaaagtgtgtgcttcacaagagaagaacaagaagtgtgtcctgcaaaaaggagacacagaaagtatgtcctgcacaggggaggaagaaaaagtgtgccctgcacagaggataaacatgaagttgtcctgtacaagggagacacaggaagtatgttccacacagaggagaaataggaaatgtgtcctgcacaggggaggaacaggaagtgtgtccttcaaagaagagaaaccagaagtgtgttcttcacagaaaagaaacaaaatgtgtgctgcacaggggaggaacagaaagtatgtgctgcacagggaaggaacaggaactgtgtcctgcataggagagaaacaggaagtgtgtc

SEQ ID NO: 127534 - DNA, 455 bp, Homo sapiens
aaataggggagactgccaatacctgtgacctggcacagtgaattggcaagcagatcagaaagagatcttaatacattgtgaataagtcctgatttctagagagatctccaaggttgaattattaaaaccctcacatttacctcctcttggagctctgttggagttaaaagtctctactgaatcttaaaaaggacgcaaatgtcaaaaagagacaaatcccagccaagtgatgggaaatgtgatttcaggataatagcatctgctcattggtcattaaaatacattatttccaatgaatgcccttaactctgcaggatgggaacatagctttaatcagacaggttcccagatcagagtacatcaaaacacaagcagcagattctgtgctgcctgatcaacagaggaaagaaattcagaacattttcttttacatttaaaatgctttatgagggaaa

SEQ ID NO: 127535 - DNA, 108 bp, Homo sapiens
atcgcaagagaccgattatgagggtgtccaattttcaaccatttgggagaaatacagcagaacattggtacagcagtgtgttagtaagacgtaatctatcactgctcc

SEQ ID NO: 127536 - DNA, 348 bp, Homo sapiens
aaaagaaaagatgactgaacaaagatgggtcaataaacaggatggctggaagtagaaatcttttaaaataaaatgccttaccacttaatgctaataagttttattgagaacttgtaaggtgtggctcacgcctgcaatcccagcactttgggaggccaactatgttttaaaaatatccatacaataatttggaggctgaaggggaaggatcatttgagccccagagttcaagcctagcctgggcaccacagcgagaccccatctctaaaaaaattagccaagcatgatggtacacacctgtagtatcagacacatgagaagctgaggtgggaggatcacttgagccca

SEQ ID NO: 127537 - DNA, 350 bp, Homo sapiens
atgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggcggcgagacggacgagacggagcggtggtgcgccctcggcggactggagaggcctcgggaaaacaagcaaagaccccaaaag

SEQ ID NO: 127538 - DNA, 485 bp, Homo sapiens
cgtcctgtggtttccgggatcttcagacgcaaacggcttgcaaagtttgccactgcagcacctctccaaagactggaaataactgacatgtccagcaagaggggactggctaaattaatgatggtacatccaggcaacagaatactacacagctatcaaaaagaatggaaaagttggccaggtgcagtggctcatgcctgtaatcctagcactttgggaggctgaagcagggggattgcttgagcccaggagttcaagatcagcctgggtaacctagcaagaccctatccctacaaaaaggaaaaaaacagacaaaaagaatgtttatataatgatgtggaaagacctccaagatctagggtgaggccaggcgtggtggctcacgcctgtaatcccagcactttgggaggccaaggaaggtggatcacttgaagtcaggagttcaagcccagactggccaacatagtgaaaccccgtctctacta

SEQ ID NO: 127539 - DNA, 637 bp, Homo sapiens
tgagaagtggctggatttgggctatattttgaaggtggaggcaaagagctctgcagatggattgtatgttgtgggtgagaaaagagtcaagcatgactctgcagcagggttttcgccaagcagccggagtggagagatagaacagtcactggaggagacaaggcattctgggagtagtggtttcagtgggaagaccaggagttggatgttgggcaggtgacattttcaacgtacagtggtatctgagcaaacatgctgggtgagccaacacaacacaccactggcacagggaagatgtccagcaaagcttggctctcctctctcaagctactgcccagacaaaaagagtcctcatataaacttcatcaaacatccctgcagacttccttattgcaaggtgcttttggatcccaggatggaagagggccaggagacagggagcaggatcatctcttggcaggtgtgagggggagaagggccagggaggcagggtcccccctacttagacaactgcagggccacgcagggtggggcccgtgcaaggcagggaaccccggctactggcagacaagccccatcttctctcttaggaggaaagaaagctccacagagcaggccaggccagccccagggcccc

SEQ ID NO: 127540 - DNA, 456 bp, Homo sapiens
ttttattcccaaatgctgttcgagctctcagaaataacagctgctcactataaatgcaaaatcatttgcagtcataattaagttaaggatctcaagcccatcttggatcattgagggggactctaactccagcaacaagtgtccttgtaagagacacacagggaggagaggagagggccgtgtgaagagggaagcagaaattagacgatgcagctgcaaactaagaagagcctggagccaccagaaacgggaagaagcaaggaaagattctccccaagaggcttcagagaaagcacagccctgctgtcaccttgattttggatttctggcctccagaactgtgagagaatacatttctgttttaagccatcaagtctgcagtaatttattttggcagccccagggaactaatctgaaaaagtatgcatagtctcagctcctgggaggctgaggcag

SEQ ID NO: 127541 - DNA, 308 bp, Homo sapiens
aaaatcagagacagacaccattttctgaatccccagactgggttccttccagaaccagagccccaaatggcagacatgaggcaggctaggggagtgggcagggcacgacatgccctcgcagtcacccgcggcccaggtagtggccttctcaaaagctgccttggccttgcccaccaatgaaccttccgacccggaccccctgaagatgtagcggtgacctctgcttctgacagctcgccaccacctcagtctctcctgcaccccaacctcaggcctgcccggaagggaggtccgagccacaggggcct

SEQ ID NO: 127542 - DNA, 342 bp, Homo sapiens
ttgtaataagccaagtttatagtttacccctgtgaattaattcaacatacataattcaactgatgtaaaaaataagtaaataacttacttgtcatttttcttatgcagtctagtttctgagaatattttaaatttatctgctgtagcttttgatacttacttcctggtcacaaaagatttataacctttaattatcaattactcacactttaaaagtttcttatttctttgaaagattggaacagactatcaaatcatggctgttatgttcctttcttaaaattcaatgtagtcattacagaaactttctgcatttttagtattttttaagaataagctgac

SEQ ID NO: 127543 - DNA, 811 bp, Homo sapiens
acagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatctgtttcctggccgtagaggtggcctgcactcctcagcctgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgaccatgaactttatgaattcaaccaggtgaaagattacaaattgataaatcaactttgtcagctcgagctgtaaaagccaaaggtaccggtgatgatcccataccctttaatacagtctcatgttgaagatttcatgtagaaggccttctcaaagaacaacacaacggggggtacacctgcaggcgaggccacgagtacccagctggcgacgaaccggagatcccagaaatagaagacagctagaacaaaccgagacggcatcacacagcaacatagggcccaaaaagacacacagacaaaaccacgaggggaatgaagagagatggcgcaaaat

SEQ ID NO: 127544 - DNA, 315 bp, Homo sapiens
tatataaatctacctaggtctatagtctctacaacacctaaggaaggtgtccaaagtttaattcctgagcaatgatacatatactgatcctggatcagagacttctgagggcctaatggagacccaattttatgaaccataaaagtcttccagctgttactgcatccccaggaaccaccatagagagacttttgttttgactgtgtatcaataagtaatttggctcagaatagtttttcgccagtccttttctataagtcaacaaataaccacttgcaagaaataagtgctctctgctctttatcccagtgattt

SEQ ID NO: 127545 - DNA, 573 bp, Homo sapiens
tagggggctttccctccaatcccttcagaaataaccaccagctactatgtacagagttcccgctctgtacagcacttcagacacgttatcatatcttatcctcaaaacgccactctggggaggcatgactgtgcttccatcacgcagatgaggacgctggagtcccaggaggccgagtgacctcgaggggatggtatgtgacagtgcctttgttggaaggaacaggacatcggcccttagaagctgagccctcatccaaagcaagttcagccagagaaagaataaccaggggcgctgagccatggtggtacaggcttggcccgcccacagtgccccgctgtgggccacacgggtgccagacggaacccagtgagagctgaggatggcctcggccagggcccaccaagactctgtcatgaccccagacctctaatctcccactggtgggtgggcaaaaagccctggcagtgttacggtcactcaggaccatccctgggtactgagggcaagaaacaggccaggccactgattctccagaacttgatttctggagaccagatgcacagtggaaga

SEQ ID NO: 127546 - DNA, 697 bp, Homo sapiens
cagtgagccaagattgtgccactgcactccagcccgggcgacagagtgagactctgtctcgaaaaaaactaatgccaagataagttctaaagaagttttaaaattgctgtttaaaaatatacacaggccagccgccatggcttatgcccctaatcccaaaactttaggagtccaaagtgggaggatcgcttgagcccagtagtttgagaccagcctgggtaacatacagagaccctgtctctacaaaaattagaaaattagccgggcatgatggcgcacgtctgtggtctcaatcacttgagaagctgaggtggatcacctgaggccaggggttcgagaccagcctggtcaacatggtaaaaaccccatctctactaaaaatacaaaaattagttgggcgtggtggtgcacgtctgtagtcccagctactcgggaggctgaggcacgagaatcgcttgaacctgggacagaggttgcagtgagccaagatcgtgccactgcactccagcctgggtgacaagagtgaaactccatctcaaaaaaaaaaaacttttgcgtttagtttgagatacttgtggaagacagggtctctgaaagtccaaagagtggcaggtatctgcccctgtaagtgggatcttcactctaatagtggccttaaatgtcattagtctttctttttttttttaagatgcccatt

SEQ ID NO: 127547 - DNA, 274 bp, Homo sapiens
aaaaaacaaaaacaaagcaaaacaaaacagaatggatgacagacataagagctaaaactataaaacttttagaagaaaatatagcagtaaattgtcatgatcttgggtttggaaagaccttgggcaaaagtcttcttaggtaggatactgctgtggtttggatatggccccaaaagctcatgtgccgggagcttgacccccatgtggaagtgttgggaggtgggacctttaagaggtgtttagcttatggaggctctgccctcacgaagagatg

SEQ ID NO: 127548 - DNA, 518 bp, Homo sapiens
cctcttcaccctaccaacatatctaaatagttaaatgatgtataagaaatcaaattcagcacataaaagtatgctcaaaggtgtcaagacacacaatgcaaaaatacagttcctattgaagctaaacctatgcaaagtcaaggggtgtctcttaaagtgcgctaaatagtttcattactcagggagtggcattacaaacaaatcaaataaaaagttaaaataaaaacaaatgtgaaaattaagtccaaaaaacaacttaactcttactacttaatttacctgcaagaaaaagtttagtaaatatttttaatagtcattatgttacagaaaagcaagctaggataaatgggttctaggcaaaatcaatggtgcacccaaggaaagaaacaacttaaaaattgttattttatcattcctatctaatgtttcatttgtaactatgagtaaacaggtgtttgagaacaaattctaaaactaacctttgggtcacattcaactctgaaagcttagtataaata

SEQ ID NO: 127549 - DNA, 458 bp, Homo sapiens
tcccaatacgcacacattctctctctctcacttttctagttgtatcagctgaagagcgtagaagctgtgccatcccagccattatgagcatctctcatgcccagatcttcgtttctgaatttctctttccactagaagaaaccatgagagaaatggcgagcctgagatcctttattgcaccaaaagcaaggaagtatggaaggagagctgagggcttgccaggacattggctgacatggtctctcactggtcaaacttgggatggttggaacatcaataaagaatattaatgatcatggattataagtacattaaaaaaacccatatgagtccacagtgatgagagttgggctggagcagggaggggaaagctctgctttataggaacatgccagataacaaatatagaaggagttagagaattagaaactcctcatgttataaccttaatgtaatca

SEQ ID NO: 127550 - DNA, 130 bp, Homo sapiens
cgagaccagactgggcaacatagtgagaatctgcctctttaaaaaaatgttaaaattagctgggcaaggtagggtagtgtgtgcctatagtcctaactactgaggagactgaggtgggaggatcacttga

SEQ ID NO: 127551 - DNA, 748 bp, Homo sapiens
gcccttgccatgtgctgggcactatttactctatgaactttatatgtattagcttatttaaaccccgcacaaacctatgaggtagttactattatcaccctccatcactgacaggtgagtaaaatgaagccccgagagcagaggtaggctgcttaagggaggtggctgggggcagagctgggatatcataggtgggaataattaagctcgacctagagctgaattaattgctggtgcactctggcccccccttctgctgcgtgactgtctcttgttctctgccccctgctccccatacttccattaaaaagcccatataaaacagggctatgtagcccattataaaacagggctaatcacagctcctcttttccttccctcctctattgctcactcccctcctcaacagggctgagtctccaaggagaggacggcacaggcaaggcttgggtgctgggggccgagggcgaggtcgaaggtgtcactggcgctctggctgcctgcacgggcaggaaggcttctttgccggcctgggagtcaatctccttcctcttttccctctcacgctcttctaggttttgggttctcttcctataaaacagggaggagtttctcaggctctggtgtgagggagagaatagagaagttacatgaaagtatgtctgtttctggtaatatggtggtctgtgcccacttcagcttaaaaacaacaacaaatgctgcatagaattaaatcttttcaaagcat

SEQ ID NO: 127552 - DNA, 587 bp, Homo sapiens
gcggcacgaggacaggcccacgctgggcgcagggggactcatctggctgatgggctgctctgggaccggtctccccctctctgctgcacctgggcatgggcacctgtgaccccctccattccctactcaacacgacaatctgagacaccttgcgggagctaaagcaggtcgtctgggccagggcttcccaggagtgtgggactctgctgacaaataagtggatttgagtcacatcccaaacacagcactgagcaccatcaagtcatcaagtcaccccggaagaggactggtttgcagtggcctttcaattctatgaactgcacccaggagcaagtcttggtttggtactactgtgtctttcacgtctctctaacatttgctaagcttccttatcaacggaaagggaaggcaggaagcccagagcttgaggagacaatagtctccagctaggctttaataccattgtacagcttgttgtgtttatttttgttactctctatttatggcaagtgatactgctttttttcatttacaatgggatatagagtttctttataaattaaattttaaaaattgaaaaaatagtg

SEQ ID NO: 127553 - DNA, 443 bp, Homo sapiens
cagggtaggcacacccacccgtgcctgtggtggcccgccctaagactctatccaggacagccacctcagcctcactatcccctggccacgtcctggccgttcagtcccaccgtgacgcagcttacaagctgcagaaccgtctgcctctcaagccagtgttcctcccactgtaccacagttgcttccgttgggtccagactcttctgaaaactccccttttcaattttactcaaacagattttggccatggaaatggtttgtgactttaacgggcaagctgtgatataaaaagtaaaccatgggttacataacttcaggggcaggttaacttttccagaattctggtctcaaagtaaagatttagatttagttgaggctataaaaattcaggaaaaaataataaagcatttctacacctccctccttccccttgcgagcccccc

SEQ ID NO: 127554 - DNA, 587 bp, Homo sapiens
atagatgcaattgttcccagatgttttgcttttaggcaaaaccttgtatagatgactgtataccctcttacagttgatgcttaataaaacaaaactaccatggttttataatggaatggtaagctcaaacattttgctggtagtataaaaaccaagtgcctgtgattacctatacattaactcctgaagaatcaattataatctcagcaaccttgctctttgaccattcattctaaagcttggcgaagttaatgagaacagataataggagtgctaatgcaattggaagacttttttttttttaaacaaagtaaggaagggatacatttttaaataaaacattgcattttggtaaaaaacacagattatgagaacacattgagttagaggaacatcatattgattccaagaacaaaaagcatggtggagaaattttgtaaccatgcaaatccagtgtgctctgttctcatgagttaaaaagaattttcctcctatagaaacttgttatttaaatgtgtgtcacatgtaaataacagtctaatgagagcaatatagagggagaaatatgtaagcaagggaaagtgggc

SEQ ID NO: 127555 - DNA, 237 bp, Homo sapiens
gggccaaacagaggagtgagatcacctgacttaggtttaacaagctcatcctggacgctgtgttaagaattgacttccatcataaatgtagcagcaggaagaccaggcagaaggcaaaaaaatgatagtggcttggactaactgtgtgacagttgaggaggtaagagataatcaggggccaggtgtggtggttcacgcctgtaatcccagcagtttgggagaccaaagtgggaggat

SEQ ID NO: 127556 - DNA, 498 bp, Homo sapiens
tgaggatgtactgggatactaggtgagttttgcatcctgtcttgaccgaggctatctgaatattatatatagtttggggagaactactatcttcccaagttgatagaaaaccttgaatagcagggcatcatggctcaaattctgaggtccccaagatgcttcttagaattggaattagagtgaggcaaacaaggtgcccagaggacaaactctaaggaggtgaatgcccagagtcatgtgagtgcagggctggtacccgagagtgagcacttgcttagggtttgcatcctggacacccactttcctgtccttagccctagttttggtacccacaatggctctcaaactattttttcccatgattcccagtaagaaatacattttacattcaacatgtagtacacagagacacacatgcatgtacacaagcacaaacacacacacagacataactgaaacaaggattacaagtgacagtgctaacaatactaaccttta

SEQ ID NO: 127557 - DNA, 687 bp, Homo sapiens
ggtggaggcggggaggcgggcaggcgaggtttgagaacaatgacacaaagtgaaattatatatagacttatttaaaggcttattttactataaaattaaaagtgcattcttctaatttttaataaagtataaaacagaaaaaagcatatactatatgataatactagcatttactcaatagtaataagaaattcagatttttagaagtctgacttagttatacattaacatacacctagcaatcacattaaaatacacaaggctttcctaatagaagttttcttataaaacaaaagtgcttttccttagataatagccattatgttcaatttcagtactacataataacataccattaatgtatacaccataaataaaaaacttagaagttctcaagtagaaaatggtaaaatatcacttgcagtttaacataaatatgtactaagttattattaattaataacaatcttagggcatagttgcttctttaaaaatgtttaaacatcagaacaattcattcctattaagtaggttttgctttttgctttcaaacttcttggcatttgcgatttctcatttgcgactgtgaaagtggcactggcccctattacaaacctgcatttaaaagctgatttagaggaagcaagttgattatgaaattgggcctctttcaaggttttgaattaa

SEQ ID NO: 127558 - DNA, 1454 bp, Homo sapiens
  misc_feature (2)..(3): n is a, c, g, or t
  misc_feature (545)..(545): n is a, c, g, or t
  misc_feature (690)..(690): n is a, c, g, or t
  misc_feature (927)..(927): n is a, c, g, or t
gnngctttagaattagtcattatgtgagttggaagaccatttgattctttattagaagttagcaagtgtgccagattagaccttcacccaagaacgtcatgagggttaatgagaggtttttaaaagataatagttatctttgtttcatgtttaacaactttatgcattggctggtcattccagctccacagaaagctcttcagttgagtttcaattacagcccgcaattccagatgctacaacattttaactgtggctgccagatatcagtgagattcacaggcctggagtacaacattctttacaatgtgtgcttcatattttgaaggccatctgtctcattttcatctacaattggctctgccgaagttttgcatgccaaatgatattttttaaaataagcttttgtgctactttaaaaatgtttcaaaaatatcttcgagatacaattcacacaccatgaaattcagccatttaaagtgtacaagtcagtggtttttagtagattcacaaagttgtgcaactatcactacagtctaaatttngaacactttcattactccataaagaaaccccatgcccattagcagtcactccagttcctctcctagtcctgggcaaccactaatgtaatttctgtctctaaagatttgcctgttcttatgaggagtggcggtgtacacctgtagncccagctacttgaggaggccaaggcaggaggatcatttaagcccaggagtttcaggctgcagtgaattatgatactgctactgcactcccatctgggtgacagagtgagaacccatcctctaaaaaataaagatttgcctattctagacatttcttataaacagaaatatacagtattttgggactgctttttttcacttagcataatgtttttaaggttcatccatgttgtagcangtataagtatttcatttcttttttgtccaaatcatattccattagaagtataaccatatttgatttatccatttatcgtttgataggcatttgggttgtttccacatttgcctactataaataatgctgctataaatattcacatacaagtttttctgtgaacacatgttttcatttctctccattattattataggctgaactgtggctccaccaaattcataatttgaagtcccaacccctagtatctcaggatgtaactgtatttaaagataaggtgtgtatagaggtggttatgctaaagtaaagctgctaggatgggggctctaatcccgtatgaatagtgtccttataaaaagccatcaggggcctgtccgcacagggaaacaccatgtgaggatacagaaaacaaccatctgcaagaaaggagagagatcttagaagaaaacagacctgccagcactgtaatcttcaactgccaggctccaaaactgtaataaataaatttctgttgtttaatttactca

SEQ ID NO: 127559 - DNA, 271 bp, Homo sapiens
ggttttgggaagatacttgggtgggcggttcaggctgagacaatgaaatcaaccagtggaggccactcagtgtggctgtggtagagccatgcatagacacaggccatgcactccagtgctgccacgcctgcctgccctggaagaggtctgacaagactcaaggcatttggcctggcatgatggctcatgcctgtaatcccagtgctttgggaggccgaggcaggagaattgcttgagcccaggagttcaagaccagcctgagcaaccatag

SEQ ID NO: 127560 - DNA, 214 bp, Homo sapiens
agtgcttgaataagttatatgcatcatcaattttccttaaatattttgttgctgtcggtttgggatattttcttttcaggaaggcaagactcaatgaagcaaacaattattgtcttccaacctgaaagaaaaaaaagtgactttcctcagagtgaaatgtagttaaataaataagttctcaggaagatactttagctagaaaatccagtttgta

SEQ ID NO: 127561 - DNA, 332 bp, Homo sapiens
aattccaatgattgtgctgtaaatgattatttaaaaatctcatttgctcctatagtataaatttgtgttaaatcagcataaacacaccaaaaagtcttaaataattagaatgatttttcttatcttcaatgatgatggaaagagaaagatacaaaggcattgttaaaaggaattaatgaaaagtaaaacaacttcagggatctggcctgaaattagtataaatctagtctagtttcctttagacaggaaatacaggggcaggatcataaggcaatatcaggtggatgataagctggaaagaatagatcagaccaaattaaatatagatggag

SEQ ID NO: 127562 - DNA, 344 bp, Homo sapiens
cagcaatggcttcatgagttttcttgttttttttttcccacaattattcttacgctgtattcatttatcttgagatagcaggcagccacagttacagacctcaatctgtggtgtatatcaagcaattcaactttttcttgtaatgtcatgatttttctctaggtgggagcacttccggcatcactagtggctcttcaaatgagtctcatgggtgttattcaaagtttgcattaaacactatgaaattgtactaaacactatgaaaaatatgcaaaacccacaaaagatcactttttaccatgatgagcagtttgccggagagacaaactgctcacacagagatg

SEQ ID NO: 127563 - DNA, 1396 bp, Homo sapiens
aagctggaatatatgatatttgtaatgtactttcctttttaacagcaatctaaacttttaaacatgtagcagttatttttgtctatttgctatacctgaaatttataaaatgtcataaggatttatttgtgtagctcttcctacgtttctgtctctagcaatatggttgattagataatctgaaaacctttcttcttcaaatcacctagaaattatagctaaaatataatgaacatccagttaaatgaacagctgagctttcaagaaagtaggggaaacaaccaagatacaaaagtgaagaaaaaactgaaaaacaggagtttgtgagctgacactatggctgctccatgggtggggataagagttactgttctgggcattgcagggatttgagtcttaatgcccatatgagaacaggttacaaggcctggagactgtacaaagtgaggagttggattcaacatctaagcataaaaccaggattcttaaaggactgtaccttcagcaaagaggtagatgaggagaaaaaccaatctaccagcacatggagacttcaaagaagcttgtttgtgttattgtgggctctgaataaggctaaaaataagactcctttaagaatacataaccatggtcctgcctcttgttgtcttggggttcaaattaatactcctttcagataattaaactgtcatacagcgactacaaaataattatgtttaaaatgatgagaaagttaaaataaggaaatgaaaacataagaaaataagagagttggaaagaaatctggtaaaacttatgcaaataaaaaatacagtcattaaatttttaagaaatcagtgaatgggttaaaggaggaatgtgaatggaagctaaaggagaaataagtgagtggaagaaatatgtgaagaaattacccagaatgcaggaaagagagaggaaaaaaagaaaaaacaggaaatcttgagagacacagatgttgaaatgggaaggtctaacttaatgtctaatggaagttgacaagagaaaaagcaatatggagatgaagcaatatttgaagagagaatggctgaaaatactgaagaattaatgaagggtagaagtccttagatttagaaagcctaggccagatgtggtggctcatgcctataatcccagcacttttggaggccgaggcgagaggattgcttgaggccaggaatttgagacaagcctgggcaacatagcgagacctcatctctataaaaaataaaaataaaaaaaaaaattgaaagcctaatgagtcctaagcagaataaataaaaaattacttttcacctggacacatcacgataacaaagtatagcagaatttttatgtgtagcattctactactaagatgttgaaatagagtcacctg

SEQ ID NO: 127564 - DNA, 392 bp, Homo sapiens
  misc_feature (57)..(57): n is a, c, g, or t
catttcatcatcacctgtatgcatcgactgctcctactgcaggcaggggattcacanatgcaagcaaggcagccaagacccagctcctgacacgccattttcagaataaattaaaggggcctggcacagtggttcacacctataatcccagcacttttggaggccgaggcgagaggattgcttgaggccaggaatttgagacaagcctgggcaacatagcgagacctcatctctataaaaaataaaaataaaaaaaaaaattgaaagcctaatgagtcctaagcagaataaataaaaaattacttttcacctggacacatcacgataacaaagtatagcagaatttttatgtgtagcattctactactaagatgttgaaatagagtcacctg

SEQ ID NO: 127565 - DNA, 398 bp, Homo sapiens
gaattcatctagtctaggagttcttaagagtcctcctttgggcttaagaagcttatgaattacgttaagttttacacaaaattttgtgatgtgcagatccttcttaaaaaagaatccaggccagactgggcacggtggctcacacctgtaatcccagcactttgggaggctcaggcaggtggatcacaaggtcaggagatcgagactatcctagccaacctggtgaaaccccttctgtactaaaaatccaaaaattagccgggtgtggtggcgcgtgcctgtcgtcccagctacttgggaggctgaggcaggagaattcaacccgggaggcagagttttcagtgagccgagatcacgccactgcactccagcctggcgacagagtgagactccatctt

SEQ ID NO: 127566 - DNA, 195 bp, Homo sapiens
gctgctggattttgtaaaacgttctgtatcagggctttcctgtagggtgccagagagacaagagtgaaactagggttcatttaaaaaccgctgttggtaatctgtaagtaaatcagatattcccgacatagaccctggctgggtcatgttgggctttgcattaaatattaagactgtagaacaatattttatgca

SEQ ID NO: 127567 - DNA, 412 bp, Homo sapiens
tgttacaggtagctctgcatcccccagtgatgacagcccctgatgctggccctgggcaggcagggaggggacgaggagctgtgcgtaacaccagctttggagcagcagtctgtgatcaagccagtcaaaaggaagagtatggaaaagcatgccccttcgcctgcctggggtgtgttgttagcatctggaagtcagactgagttcggtgctgagcatctatggatttagacaccaactaaagtcatgtttgtattccttagaccagcgctaagatctccctatcccatagatgccctaacattacatccagtgttaccgcctgggaagggaaataaacataggcaatcatctgttaccaaaggtggaagccaatgtctcttgtgctttccatataaaacaaactcaggacttg

SEQ ID NO: 127568 - DNA, 943 bp, Homo sapiens
agcggtggtggaaaaagtactacaccaaggtgtggtgaatgggaaggtggaatattccctgaagcggaaaggatttacacttgctgacaataattgagaacctgaagaaaacttagattttcctgagttcattgaactatttcttaatcctcaaaaaaactggtaaaggaaaagatagtacaaaaagaaaatctttatccgagagtgaatctgatgacagcaaatgaaagggatgctgctgaaaaaccaggagactttgccagaactcttgatcctaagcaaagaattggtgccacagactgcagtgaagaattaatgtttctaatggaatgcaaagactcagacgaggctgacttggtgctggcaaagaggcaaacgcaaaggggcaaacacgaagtgtcctcaaattgcaaattatttttatgaagagagactaacttggcattcctgtccagaaaatgaaactcaaaaattgttgcactgcagtatactgccatatagtgtgtgtgtgtgtaaaacctaggtcttgattttcttattagtgtgaaatactctatttttaaaaaaatagagatagagtctcactatgttgcccaggttggtctcaaactctgggctcaagtgatcctcctgccttggcttcccaaaagtgctgggactacagacgtgagccaccctgcctggccagctattttctaatgaaatctattttctactgcaaaatcttgttttgaagtagaatcaaaagagtttttggggtttgtttgttttgggtatttgttggggtttttttcatcaatagcacttgttacttttgaacaagtaggaaaagctttctgtagctgcttcatttaccagaaaagaatatttggttccatggtatattatttcctcttttctaaatgttgggaacattttccataatcattactcaatcataact

SEQ ID NO: 127569 - DNA, 350 bp, Homo sapiens
ctgagccagggagaccacgaacccaccggaaggaagaaactccgaacacatccgaacatcagaaggaacaaactccagaggcgccaccttaagagctgtaacactcaccgcaagtgtcaccggcttcattcttgatgagaaggcttccactgcactactggaagaaaccattgctttgggaattttctatcctgcagccctcagcaaccctctgctggaatgctgccactatgactgctagagacacttcatggaagcccacaggacatgtcaccttttctcatgggctcatttcatgggccaggcacgagcttctgttcattccacctatgggtttgaaggtcaactct

SEQ ID NO: 127570 - DNA, 419 bp, Homo sapiens
acccaagatgttctgggttattaagatgagagataatatatgttaaagtacctagcacagagtccaaccatgacaggcactcaataaatggtagccagttatcatcatcaccatcatcatcatcatcatctcaaggaatgggctaaagaaacgtgacctcatccatactgcccctacttcatagcctgtcctaccaagtaacctccataggggtatcatgtgcaaatgcttgttcagctcctgtccacttcagtactgtgggtcccatcacaatttccttgagctcccttccatgcagacaaaaatctcatctaggagtgttcaggggaggtcactacaggcaaacatggcaaggatgaccataccatgttatggagctcacctctccagcctggccaaaagcagaacacaccacaccg

SEQ ID NO: 127571 - DNA, 449 bp, Homo sapiens
atagaaactatatgtttgccaaattctagcacatgaaccaagcatagaaactcagagagaagttcaaaggcagttagaaggtggggtagggggaaatgttaactttgaaaatagtatcctaaatgtgagagagaacagtccagaaaactcctctgaaataatttataatgaagaggtaacatttaatgagaacacagaggagaagtgctgtaaatggaaaataacagataggaagcagtggagaatcttaaacttggaggaaccttagtggtcctctggggttattcttctaacctatggtcaaacaccttttaccaatgcatgctaggaaggtgtttgaccgtggattagaagaataagcccagacgaccattaagagaaagcgaaagagagagagagagagagaaagaaagaaaaagagaaagatatatatatctgtaattacataa

SEQ ID NO: 127572 - DNA, 654 bp, Homo sapiens
tgcatagaaaccgtgtcctaggattctgattcaattggaccaaggttgttttttgcaatttgacttttaaatactgcagagtcaatttggctgtgctaacagaattgagatctgctataataacagtagcaagcttattgagcacttaggctctttacatatagtaactcaatcaatcctctatgaaatacatgccttttaatgcccaatttgcagatgaggaaactaaatacagagaaggtgagtcaattgcccaaggtgacatagcgagccagtgggagaaccaggatcagaatgcagactgtctgactccagagttttgctgaaatagaatttctaaagcttggtattttgttttattatttgctttgaagataacatccaattaaattaaccagtgtttcccataattattttttatctgtagaacttgaaagtcacgtacaggacttaaggtgtgtgctgaaaatattaaattacgggaaaaaattatttattttaaaattattttattctgcttcctgagccagcccagcatgcttttcctggcttgttttctttctactgctaccagaggaagaacagagaaatgatgtcatttgatttttccccctcctgagtcaatgaaagaataaaataaaatatatctctcat

SEQ ID NO: 127573 - DNA, 308 bp, Homo sapiens
cagaactgtgtggggaggtccacttatccatagggttggtgctgaaatgttaggttgtgcagaccccaacctccctgacttccttcagtaactgacagtgtagcattgttcttgattagtttggcactccattacgtggaggcagcacagtgcagacagacctaatggctctgccacttactagctggtttgggcaaatgaattttcccttctgtgcttcagtttcttcatctttaaaatgagaataataatttataccacatagagtagctactattatgatattgtctgtggccacatccttctct

SEQ ID NO: 127574 - DNA, 281 bp, Homo sapiens
cacttaaattattcttaactatttttataccattaaaattttacttttaaatgtattctcaattgtttatttctagtatttagaaattccattaattttacatattgtattttatgtattgaccttgcattctacacattctgcaccattattgaatttgattcttattattcacagctttttaaataaatgtattaggattttcttcatacacaatatacatacataagttctgtgaataaaaatattttttcttttcacttttcaatttttatgctttt

SEQ ID NO: 127575 - DNA, 202 bp, Homo sapiens
ctatccttactacatgtgcacctatgattattactaaataaaaatcttcattaaacttatgtatactctcaaattcaccttagaatttgattgattttttttccttctcttctttttccttttgagacagggtcttgcttgctctgtcccccaggctggagttcagtgacacaatcatggctcactgtagccttgaactccg

SEQ ID NO: 127576 - DNA, 542 bp, Homo sapiens
tccttctttcctggtagaatcacaaaactcttttagatattgaatttatttctttcaaaccttttattctaataaaggctgaaagaaaatacaatagacccatatatcctttgctcaggttcaatggttgtttgttaacattttaccatatttgctttctctttctctctctctgtctctctctttctctctttctgtctctctctctctctctctctctctctgtgtgtgtgtgtgtgtgtgtgtgtgtgtgtgtgtgtgtgtgtgtgtgtatgtctatgtgtctgtctgtctatatttggctgagccttttgaaagtacattgtagaagtcatgacacttgccaagcgtggtggctcacacctttaatcccagcactttgggaggccgaggcaggcagatcacgaggtcaagaaatcgagaccatcctggccaacccacacggtgaaaccccgtctctcctaaaaatacaaaaattagctgggcgtagtggcacatgcctgtagtcccagccacttgggaggctgaggcaggagaatcgc

SEQ ID NO: 127577 - DNA, 339 bp, Homo sapiens
aggtgggtgtctgtacttccctgagtatggccaggagagaacgtttcctgttccttctggttctttctccagttccttttcaagactccattgtggagtcctcttcctgaagattttcacaatttttttctctctgaatccctttgtggcgttatcaattcctatagctacgcttttcctaaagctttaaataaaatctctttgccgattacttctaaatgttttcagcctcagaaccacatttgtggctgcatgttaaacatctccacatgaataatctgtggacaaaccaaaataatgcatcttctacgtaccctaagtcgacttctctttctgcgt

SEQ ID NO: 127578 - DNA, 456 bp, Homo sapiens
agctgcttttgcagatagacagaaccctggagttctctactttgccattttcagcccatgttatgcattatagtggacataattttggttgttgaataacattctaactagcagatgtactgtaatttatttatcatttttctaatgttgaacattttgtttgtttataattttttgcttttttagataaggctacaatgaaaatctttctacatatagcttttaccatttcccagattctttaggatgcgttcccagaaatatagttactaggtctgagaatatgaccattttaagattcctgatactatgatcaaattgtcaaaaagattttacggatttttatttcaacctcacgagtaatcttaaacttagaatttttctgaaatagttttgtcactggcaaaagtctgtgagaagtgatacatattttaacttccttttaatgttttaaag

SEQ ID NO: 127579 - DNA, 708 bp, Homo sapiens
gatattagaaatctttgtggtttcttctgatttcagccattggagtcaaagtttccaattcagtattacgattaacaccaggtggacatttatagacctattgaccatctagataaaacaggtatggtttatatggagcaactggaccccattgtcttttaacaatcacatgatgcattatatagaagacatgcctttggggtgtgcttgaataccatcactgaactccagaagaatggattgaaaccgagttttttcatttttgagttgtactactcaagccaatgtagaaaatagtgagccagcctcataagtaatatatttgtgattagaaaagtaatgggtgacagtcctgtggatgcaacaataaagtattcgccagagcctatgtttgcactctttgatgacttgtgtacagtgtgttctgatttcagaatcgtttggcaaattttacactaaaccagaaaggggagtagcattttttttaggtgtaacattgaagtaagtatgagttgaaactttagaaacaagaaattaaatttctaaattagttatatcagatataataaatttctggtatattcagttcctaccgatgtctatacaggtttctttcttttctttttttctttctttgtctctctcttttttattctctttcttcctttcttttttgtctctttctttctttccttttcttttctttgc

SEQ ID NO: 127580 - DNA, 597 bp, Homo sapiens
tgtctgggtataaatctctgagttcatcctacttagaaagtgttttttctgcttctttcactttctcttctcctttgggacccgcattatgcatatgcttaggggtatcacatatttctctttattctgtatttgatgatatcctgtatttgatgagacaatgtcatcataacttccttttttttttaagagatagggtctctctctgtcacccaggctagagtgcagtggcatgatcctagctcactgcagcctcgaactcctgaactcaagcaatcctcccacctcagcctcctaagtacctgacactacaggcatgagccactgtacccagctaatttttattttttgtagagatggggtctaagttgcccaggctggtctcaaactcctgggctcaagtgatcctccctgctcaggctcccaaagtgctgggattacaggcatgaaccactggacccagcctcctttatttctttaaccatggtggggttttttattatttgtttgtttgttttaacctgtttgaatatatttataataggtaccttcaggtctttgtctgctaagtctgacatctgggccctctcaaagaca

SEQ ID NO: 127581 - DNA, 331 bp, Homo sapiens
agaaagagcaagcaagagtagggaaaactgccttggaaaaccatcagatatcctgagaactcactcactatcacgagaacagcatggaggaaccgcccccatgatccaatcacctcccacctggtccctccctcgacacacaggaattatagggattacaattagagatgagatttaggtggggacacagccaaaccatatcacctactaaaacaaaaatggagtgggagaacttaaggggctgggagagcctcctgcaatgttacctgcccttcaggtgcttctaattcacactaaagttggagaaccactgagctactgtcttaaagca

SEQ ID NO: 127582 - DNA, 405 bp, Homo sapiens
tccctacataagagataaaataagaagaaattccagtaagaaggaagaaaatggtcaacagaagagcaattctgacgtccacgtttggtcttcctcagaagattgactaactgcgccaggcacggtggctcacgcctataatcccagcactttgggaggccaaggcgggtggatcacttaaggccaggagttcaagaccagcctggccaacatggcaagacctcgtctctattaaaaatacaaaaattagccaggcatggtggtacatgcctgtaatctcagctactcgagaggttgaggcatgagtactgcttgatcccaggaggcagaggttacagtgggctgaaatcacaccactgcactccagcagggagaacagagcaagactctgtctacaaaaaaaga

SEQ ID NO: 127583 - DNA, 132 bp, Homo sapiens
ccagggcacttctggcccttgtgtcacacagacttactgtcttactaggtgattcgcttttttctcttcactcctaaaacatacagtccctgaaaatagggatctttgtttcatgaagccagacaaaaagca

SEQ ID NO: 127584 - DNA, 532 bp, Homo sapiens
gctggagtgacctcagtggtaggcctgggaggggacacctggtttgctctggggcagtcgtagaaggctcagcacagtgctggactgcaggtaggactaagcttggattataaggcctgggatcttctcataatgctggtctgcagccactgtgtggcctgtgacaggcctttccctgggtctcagtctttgaaaataatgatacaccccccaccacacccggtcatgggttgcaccttgggtttcaactcaatgactgcttttcaggaggtccctctggggctccttagggttatggctgctccaggctggcaaatccagatcatgcaagaggtggcttaaccctctccctctcagggacacgaagaagatctgttgcttccagattgcaccaacacacatgcctagaaccccagtaatgaagctggaacctctgctgtgtggtcagacaaacccaaggataaattgcccctgcttcttgggatgacactaggaattcgccattcttcacgaggcagtccctggggcctag

SEQ ID NO: 127585 - DNA, 597 bp, Homo sapiens
tgacaaattctttgtttatctggcaatgtcttcatttctccattaattctgaaaaagggtttaactagatagaacatttttggctaaccatctatttcatcctctcttctggcatccatgttttctgctgagaagtcaacagctaattttactgaagttcattcgatagatgattttcagtttgtggtgaaattccagtttattatcagaattctaaaattggtttattttagatgtattgcgcatattttcattgttttagagggagacagagttcactgaggcccccactctgccgttttggaactgatctcatttcattttaattatttaggtagcatattttaatataaaccaactttcacttaatagttattttttctaaaatttcttaactattgtctgtttggctaatttttcagttgaatgttagaatcattttcttaagctccaaaaagaaattctgatagaacttgggatgttattttgccaacagatcaccttcttagaacattcaggtttcccattctctcccacttttatactgttcagcaaacttaatgaatgttttcatgtagattgcattgtattttcctt

SEQ ID NO: 127586 - DNA, 493 bp, Homo sapiens
tgtgtccctcgaggttcctgtgttgaagccctaacccctgggtgtgtttggagctggggcctctaagggaataattcatgtaaatgggcttgtaagggtggggtcctgatctgatgggatcagagtccttatgagaggagatgccagcgagcctgctctctccctgccttgtgaggacacagtgagaaggcccctgtctgccaaccaggaagagaggcctccccagaaaccagatcagctggaacctgatctcagacttccagcccagggacaggggatagaggtcagttgctcaagccacctggcctagggtattctgttgtgacggctgagcagactaagatacccatggcgttcaaggcttcattctttccttgtgttcccaactgccagcattgccacccgtgcagctgctggggctggggccacctctcctgccgggattcacccacaaggccctgctcattctgtttcctaaacagtcctctaatct

SEQ ID NO: 127587 - DNA, 571 bp, Homo sapiens
gaaacagaaatggcaactgcctagagtggtgtacaacctgtgtcatggcaatggcccttgtccgtgtccagcccacattgcctttatcacgtcttttcatttgtctattttttcccttccttcaagaccaagttccaggttcaccttctccataaacatgtggctcacatgatcacctgccatgctcaccttctccgatcacccactgtccttaactgacttgactatgtagccattgtcccatagtcaagttgtctttgagatggtcttcccattagaagtgcaggtccctcaaatgcagatccatgtgttaaatacttctgtacatacagtccatgcatgtagtactcaatcaatgttgataaaagttttaatataatgaaataacatattttcttttttcatttttttctttttttttttggagacagagttttgctcttgttgcccaggatggagtgtaatggcgtgatctctgctcactgcaacccctgcctcctgggttcaagcgattctcctgcctcagcatcccaagtagctgggattacaggtgcccaccaccatgcccggc

SEQ ID NO: 127588 - DNA, 266 bp, Homo sapiens
ctacagggtcaatccagaagttcctcagaaaagcacaataattcaatccgctggaggagaggatgacaacaggggcctctgcaaagagcaagtgatcctttgaagaaaacaaagcttcagtttcctcaagaagttcttcagagaaaagcaaaacaataacaacaaactttcctttagctcttcccaggcagcgggaatttcagacagaagatcagcatatttgccctcaaaagccacagcttgggtgtgcccatgtgaccagctcc

SEQ ID NO: 127589 - DNA, 1051 bp, Homo sapiens
ggatactgtctttattatatacaaagggtatttacaaattgatcgtaaaaatttcagagccatttgagtaaattagtcaatgaaattaaggcacagtgttcaagaggaaacacggcaaaaaattaatatggaaaaatgtatttcctagctgggtgtgttagctcatgcatgtaatcccagcactttgggaggctgaggtgggaggattgcttgagtccaggagtttgagaccagcctgggcaactagtgaaaccctgtctctacaaaacacacaaaaattagctgagtatggtggcgcatacctgtagtcctggctactcgagaggctgaggtgggaggattgtttgagcctgggcggtcgaggctgcagtgagctgagattgtgctgctgcactccagtctagatgacaaagtgagatgctgtctcaaaaaaaaaaagtatttccttactagtaaaaagcaaaacattttagaaataagtaaaatttggtatcatttttacctattagacagttaagaaacttaaaaaatgagaattttttttaagtaaaagggaatattgtagatattcatatttagtgataatttaaggtgttaacaacctttttggaatcagtttgccaatatgaatgcagtactcatacacattcaatacttaatgaaagtgtttaggctgttagatccaagaatccctctgtactgaaggaatatgaagaaactgtttacacaaaaataaatagtggctatttttaatagaaaagactgtaaactaaatgttcaaaatttatataatagtgttaaacaggaaaatttcatggtgtgagtattatgtatcatctaattaagagatagaatttgaatacaggctctgtaatttattagcttggtgatcttagtagactgacttaactatcgctcagtatcttcacttgtaaatttgagataataaaacccacctcataggttttgttgtgtgggttaaatgaattatgtttttaaagtacataaaaaggttactgctcatgatggctcagtatacgagagagagata

SEQ ID NO: 127590 - DNA, 628 bp, Homo sapiens
gagcatttggatgagcaaagaggaggaaagcaagcattctgtgcaacgatgttgactgaaacagaagtatgtagaaaggaagcaccaaacttactgcaagaacagtgagtggacccatttagctggagtgaaggctttgtttagggaagtaagtaaacataatgttttgaggtgatcgcttccaccatatcgaggtttaaagaccagctagggaatgtgtatcttgtagttagagggaagcgactcggtttcttcagtgagggagttacatgatgacagcattccttttaggagataattagggtggtgtgcctgattcagagaagctaggaatgtttggactctagccctatcttttccaagttgatgtcatggtagacaactgcattctctccccagacactcttagatgttaatattggcaacactggaagaatctgttgagcagtttttatgaaatgtaatacgagatgtacttgcttttcaccttcagcaattttttcaaagaagagtgaggaaaagtttgaaaatatgtcacattggacctctacattttatggtcataataataaaaatcccacattttctaaatgaaataaagcaatgagttagagttgagaaaatagga

SEQ ID NO: 127591 - DNA, 570 bp, Homo sapiens
tataaaattacttttcttttaagctttcttaccaaaaatacctctttataactttctttacatctcttatttcctggtcctttttacctcattttatatataatccttaaataacctctgaattagacaaaaataatttacctttgaataagaacactttagaccttaagaagaatctgcccatgactcttgaaactccacagagaaagaaagggtgagtgatgcctttgttctgagtgttttaaggggttcaagtcatttgatggcttctctagattttttttggtaccagacagtgaagggggaaggagaaatagtgtggaagaaaagaaaatgaaagaacaattgtgtttttaagacaggaagctgcaacagaaaccaagcgcataatttgtttgttttctttttttcagttatgaggaattttagcagcttcagaggtctggctgctcataatttggaattctcatttgaatttggccaagttgggtacagttggtcaaatctgatgggagaaacaccagaacaacaaaaaaccccaacaatatgattactgagcactctaatgct

SEQ ID NO: 127592 - DNA, 618 bp, Homo sapiens
ggctagttatatataataattacctgagtatactttaatctttccataaacaaataaaaataaaaatagccttgctatcatgttttccctgaacatagagtagcagttatattactgtgtgaagttagcacatcatatacttaatatattctggaaccagtagtacttggaaattttcatattctcccacttattgtttgtatgtgtaattacatttcatgttatttgtgtatttgcattcaccttgtgtttttggtgcttgtaaaatgtttattccattttccagattattcctctcgccattctgtttctgaatgacaaagaaacacataactattgacttcagacaaacctaagcacatgaacgagggactctgctgccctgggatattggataattaggatgatcattcctgttgtcttgaaatggcgcatagatattccctccatagcagcttttccccaagacagaggattttctagctcttttgttttgaataaaccggtgaaacagtgcagggtgtatttggttcccagggactgaaacatgaatctaaattttacaatcctagtaactggaaaacttgtttttaagaaagccagcaagttagacatcta

SEQ ID NO: 127593 - DNA, 506 bp, Homo sapiens
ttcacatgtcctgggagggacccagtgggaggtaattgaatcatgggggcggttaccccaatgctgctgttctcatgatagtaagtgagttctcacaagatatctgatggctttataagcggcttttccctctttgcttgtcacttctccttcctggcatcatgtgaagaaggatatgttcgcttccccttcttccacaattgtaagtttcttgaggcctccccagccctgtgaaactttgagtcaattaaacctctgatctttataaattacccaatctcaggcgcttctgtatagcagcacaagaatggactaatacaataccctacagcctgaggaggaggtagataggtgctgaaaagttggattgacctgattccccatgaaattgcatcacactctgcaaacaaatacattagtgcctttgagggctctagaccctggctcacatcagctccatctttacgtgatatttgcgttaatcacagaagcagaacactatgttg

SEQ ID NO: 127594 - DNA, 532 bp, Homo sapiens
cattaagttaccacttgttttgctttgctgtagttatcagagaatagtcaatcattcaaaaaggctactaaagcattcctcctgtttttttcagtatatctctgtaagattggttttttcatattttaattaaaattacactgcagctgactgaatgcacaagcaggtatgaagtcttctattacaacagacaataaagaaatttacaaaaatgtaaagcaatgccattcctctcaatacacttttggaaaataattattttttatacaacattacttggaaaataattattttttatacaacattaccatgtgctggtttattgtttttccacagcactcccccccccaacacacacacacacagggtctcactcttatcacccaggccgaagtacagtggtgccatctcggctcactgcaacctcgcctggggtgagacactggccccaatactgtccatcatgtagaaatgaaatgcagacagattaatatgtaaaaaaaccagccatacagaaagaaagacccaaaag

SEQ ID NO: 127595 - DNA, 667 bp, Homo sapiens
ggggaaggcaaagttttcaagcttaaacattaatggtggagataatatgaaagctttgattatatttgcatttttctttgaaagtctctgcactaaaatcacatttgaaagtaatatgtaaaaagaaataatacgtttaaaataatacaaaataatatgtaacaagaataaaattccagttaaaagccttactgggtttactttatttttggaaaaataaattttttcttagtcttcttgtggccatatattctctggctgtgtcagtcaaagcccagccttcacctgcgaacctgctggaccatgctgtacacacaggtgagatgcagcaactctagagaagccacttgaaagaaagaaagcacgccagggggtggtgaaggtcttcattcctattgatctctagtcccataccagtgcagctggcaaataaatttggaaaaaaataagttttaggggtcagcagtcccctgaagagcagaatggagcggaatggagaaaggaaaggcaaaaaatagatctgtgagcaaactcgtaaatgagcagcatacttccctatcattataaaattactgttctgatcaatacgtgctcatgatagtaataatctgcatgtacctagaactttacaaagcataattacattttcattaatttgtcctgataa

SEQ ID NO: 127596 - DNA, 492 bp, Homo sapiens
atttttatcttctctatgctatactctatagccaaagcagctctgtataaagcacagatctattcatatcattctccagttgggccacatttaattgttcttattattaagaaagaaaaaaaaaaaatatcacccaaggcatttcagccctgcagccaaatctttgaaacacctcaggcaaccttctaaaagtggagaaaatgagaaggcttgccttcacctcaattcattttcccttcagatatctgagtcctgtaagactcattaccattcccgtgtggcctctcaccttgctgacttggcctctgccatctcttctgcctggaacaccatcagtctccgccagctgcacttctgtcacttaccacagcccagattctacctcttcaaggttagtctggggtcttcagtgatattttctaacactcaacacattaaacaaattatttttctaacgtttagagttagaaacagtctccctcataagtgcgt

SEQ ID NO: 127597 - DNA, 154 bp, Homo sapiens
aatgcaagtaactctaaggaggctagggttatccctaaattattcccctgagacagacttctatcaagaaagcttctttatcatctgtaatattgaacctctgtcctctctttgggggaatataagtaataattgactatgcatcttattggca

SEQ ID NO: 127598 - DNA, 295 bp, Homo sapiens
ctagtgattcgtagccagggcagttgtgtcttaacacccccagagaacatttggtaatatctggagacatttttggttgtgacaactgggtacttggtgcttagtggtatttagtgggaggatagagatgctgctaaacatcctacaatgcacaagacagccccccacaagaaagaattatccaaagtcagtagtactgaagttgagaaaccctaacctagactactgccagagtccactaatttgtcgacctatttccacttttactccctcctcatcctcttccttagcctac

SEQ ID NO: 127599 - DNA, 692 bp, Homo sapiens
cggtacttcagtgaggattgattttgtagctcagataggatggttgtttttactggtcattccccatgttcatttatcctaatcttaccaattatgcacttctgggtaccaattgaactgtggaaggagcaagtgggatgcaagggaagaggaaagggccatatagaagttataggacacaataactcatggtgggtcacaactttatttcaagcagcttcttctctgaaatctggtatgcaaattctagatttattcctagatttaaaccttaaattctagatttaaaccttaaactatatacagtgaaagcagctgatggtggtaaaacaaactgtaatccaagatgaatttcagaatgagaaaatttagaagaaattaggatataattccttaggtttctgtgaaaaataagcaaggcaggagtgatgaagaaatatttggtaatgaaagtcaagagaattacaataaaataaattacttaggacatgagtttagttactgcagttttatgtggatgtttacatttttaactatttcacctgttatattgttttattaaaagggttccttttttcagctttattgaggtgtaattggtaaatggatatgttaattagcttgattatggcgattatttcacaatgtatacatagatctaaatatcaatttatataccttaaacatataca

SEQ ID NO: 127600 - DNA, 464 bp, Homo sapiens
gcctcagtttcctcttctgtgaaattagattaatagtatcttgcatgtaatattctgaaataaaattagaaaatacatggaaagtactaagaaaatagttggcacaagataaatgatcaatcagtaaatgttgctgtcatctttaacattttatatacgaatccacataactggacaactgtacttgtttttagttcatcaaatattgtgcaatatgaaaatatattctctgcatttaagtgatttacaacctagtaaatagaaatattcataaataactatagtatgaacccaaatgaaagaaatctttataagatcattacccctgaaattattgaccctagagggaagacgttacttctaacttggagaatgatggaatactttatgaagataggggcttttgagctgggcttcataaagatataaagggtttcagaagtctaaagacaaagggaaaggaa

SEQ ID NO: 127601 - DNA, 183 bp, Homo sapiens
ctgcctggccttccaaaggttaggattacaggtatgagccacttcaaccagcctatctgatttatcgtacttcacatcatgttttcatgcttcatctatgtcatagcatgtgtcaatagtttgttcttctttattgttgttatttatttctttttaatttattttttgagatatgggctttct

SEQ ID NO: 127602 - DNA, 867 bp, Homo sapiens
cccacaggcagtgcactgccctgagagccctggcatcccattagttgccagtgctccaagatactagcctaggatcatgtgcccggagggaggcaggtgggcggatacatgcgcacactgcatacctgagacaaggagccaggcctgggatgacccagctgccatggttttgagaggcaggccagaaggcccaaggaaggggggtgatgtgatgggggaagcactgggcattgtgaagacacagaccagggacctgacctattgtggcaggtcagggaaggcttctcagaggcagtgacatctcacaagggttctgaaggaagagcaggagtttgccagcagcattgtttctcccgttcgccacctgtctctcataacacactttgttcaaactcaattttgggagctttgttctcccaaataaattctggatcttctgttagagacaggaaggcaaccgagtggcccagacctgggttcgagttctgactgtctcttaccactagccaggtgaccttcctttccttcacggtagcaagccctataagaatgaagccatatatctggccaccagcgggagctcagtgcctgcgaatccctgctcattccctgcgatcagggtctgtgcctgccttcgtacctgcctgagcattgacgtacagggtagtgataagcataggccctgggcttgcgtctctcttccaccgttaactgctgtgtgaccctggtgactaagctgccttctctggaccacagttttcatctgaaaaacagggaaggagttgatgatggtatagtgccctcctcacaagcttgctgatgattcagtgttagacacttataacagggcctggttcacagctctca

SEQ ID NO: 127603 - DNA, 475 bp, Homo sapiens
ttgcctcagcctcccaaagtgctgggattacaggcatgagccactgtgcctgaacaaaactttaggttagtttaaaacttaactacaacagaaccggctataccaggaagagcagcagaaagggtgccatgaccagagggagacagcaaggtgtcagtaaacgccaaacacaggaagtagagcttggctgaaagatgtgcaaggagtctttcatgtattaatagattcaaactccagcaggtgacaatgtctatcagcttcaggatatgaattctctaaatgggtaaaaaggatagagagctgtgaactcagggacattactgaacataattatgattccaataatgtgcagggccagacagttatgagatgaaatggcctcatctcaacctccctactgccacattccacagtagtatgcatcattgaaagtactgggatttttaaagggcacttcaaaaacgctacttttttt

SEQ ID NO: 127604 - DNA, 300 bp, Homo sapiens
cccatgaagcctgccggttggttggtttgtttttggtatatgtgtatgtgcatgtgtatctgtgtatcgtactgatctgtgaaatctaaatgtctgaaaactactgattatgtagaaggatcatgggctttggattcagcaaacctggtttaaattctttctctgctttgttcttatcttcgtcatctttaaaatggggatgtgaatgcttatctcctagggtggttgtgagaattgactaagataatggatatataatggtttagtgccggctgtataatagaagctgaataaatgtat

SEQ ID NO: 127605 - DNA, 398 bp, Homo sapiens
gccaagtgtcacagctactagacacagaagcaggatttgaactaggagcctggactcttactcagtttgctaacctgaattatataatacagataatttccagaataaattggacctcagggtcttctctgtcttgtgttgtaggggcagaaaggttgtgataccttttctcacccctcttaagggtaatagctgacacacctgtaacaaaatacaggttaacaagagaaaagcgtaacaaatgatttaatcaaaattttacgtgaagaggaggcagagcaagatggctgaatggaagcctccaccgatcgtcctctctgcaggaaccccaaatttgaaaactatccacacacacaaaaaaataacttcataaaaatcaaaaatcaggtgaacgatca

SEQ ID NO: 127606 - DNA, 238 bp, Homo sapiens
gggtgacagagtaagactccgtcttaaaaaaataaaaaagaattttgtgcaaaacttcaagatacggaggaaacaatctttaaatgttttggactgggataagttaacgctaatctttctacttggaaatgtgaagtgaaaaacattccagtgcacgtaacactaagtcataaaccatgctgcaaaggtgtgaatgcgtgaggctttatagggtgtccagctgccttgataaaaagcc

SEQ ID NO: 127607 - DNA, 362 bp, Homo sapiens
gtctgtggaaaaattgtcctccagggaacctgtcactgatgccaaaaaggttggggaccactgccttaagacagttgaggttcagagtaatactcttgctggtggtcctgcaagaacctcctagccccagcagttacagaatggcacactcaggttagtacagcaagtcagggagattggttctagccctttaaagaagtggattatcagggaatcagccctttcactgttcctcatactgctaatgggaataatatattcttagcagtttcaattcattgtgaggaagattaaaaacactgaaagaagctaggcatggtggcatatacctgtagtcccagatatgcaggaggctgaggcgg

SEQ ID NO: 127608 - DNA, 610 bp, Homo sapiens
accaacagcattagaaacaaaattcagagccatactctttatctccagaaataatgtctatgaaacctgagtggtgtatgtttgtgtgtgtgcatgcatacgagcatgtgtgtatgtgtgtatgcatgtgagagagagagactgactccgaagcttattttgatgcaaatccttcattgccctcactgatgagctatgaaattataatttcaggcttatctctagctattaataacaaacaataagaataaattaaatttatatcagatcttataattactattatttttcacacaccatctcatttgctctctgacataaccatcctcgaagcatcatatgttcttccaatgagacacacagaggttactggtgttattctggagttagatcccaaactcttagtttagaggtagatattttcactttatatgatcatttgtccatcagatagtgatatatgtcagataagtcagagcacaactctgacacccatggaatccatggagttacggattctgtctccaggcatatacagatctgattacatcactgtagattatcttgctaattctagactcctacaatgtagaaaatcatgcagtaagaa

SEQ ID NO: 127609 - DNA, 379 bp, Homo sapiens
ccacacactagaacaaggtcagaaataggagacacttcctagacaacactgcccattctctgcaggcacgattctctcaggagaccgcctcccctcccccaggtcagagtgcagccgtgcggccactcagccatgccacaggtgggcacgtggcccagggatctgctagtgaaggggagagaaggaagggtgtgcggacacaggccgctactgcgatgacgacggctcttcaggtttccgcagctgaggggcgcagtgcctgacacggctcaatacatgtctttttcttcataggcagaatattttcgcaagctctggaaaactccacctcgagagaatgcaggcttccttcaccacgttcagaagtcggacccggaac

SEQ ID NO: 127610 - DNA, 222 bp, Homo sapiens
tgcttgagatcaggagttcgagaccatcatgggaaacactgcaagaccctgtttctacaatttttttttaatcagccaggcatggtcgcacatgcctctagtcccagcaacttgagaggctgaggtgggaggatcgcttgagcccaggaggtcaaggctacagtgagctatgattgcaccactgcactccagcctgggcgacagacagagatcttgtctcta

SEQ ID NO: 127611 - DNA, 271 bp, Homo sapiens
aaaaaacccatgaataaacaaatgtgtcatttagacctaagaaaaatttaaaagccagaagagtcttctaaattttctctcttttgaggataaagtcctcacatgctccattctcagccttgagagggatagagtaggagtttctagagcttgattgcctgtagtcagtatgaggtggaaaatgtattttctgttagtaagtagaaaggctgctctaccttaatcatgccaattatatattatttaatcatacctgaccagtgattggaat

SEQ ID NO: 127612 - DNA, 2077 bp, Homo sapiens
  misc_feature (1)..(4): n is a, c, g, or t
  misc_feature (7)..(7): n is a, c, g, or t
  misc_feature (10)..(10): n is a, c, g, or t
  misc_feature (747)..(747): n is a, c, g, or t
nnnnacnagntggcacttgcctgcccagcctgagatgctgtatgagggcggtgaggtgggcgtccccaacccggaggcagggacagggagggatgggataattggcatgcttgcgtgggctcctaatctctggatctcgggccttatggctaaacaccttatcctcactgcacccctctgatgggcctgccgagcaggtggggcaaagatgttggtgagatgaaaacacccgcacagtggggcagtatccttcctgcttctttctgggattcattttatctctgaaataggaggcacttaagctcatgctggctttacatactagagaggttatgtaaattaacgggagagtttacagagggctttgatctctttatttattgtttcaattaaagaccagtgtgatagtacagagggctttgatttcagaagaaaagagccatgtaagggtttgtttgcccattttacagataaggaaagttgagtcccaaaacgaacatctggcctccagctatttggcaaagttgggagtaaggtcctgagcactcctcatttgggacatgtttgtctggcacatgccagcagtgccttctgaaatgggagccccatgagcagaggaggtagcagcttggtggaggcctccggtctccttcccagactcagcctccgtgtaggggggactcctggcccgttagaagcttgacatcgtggcaggcactgttttcacatgaatctcccctgccgagntggccagagcttgggcactcgtctcatgagctgtggccgtgacgttccgcctcttggtcttgaccgtatgtgacgctgcctccctctgtgatgtgcattgtcacgtcactgcaaatctgaagcctaaatcctggcatgaagacccctgtcttgtgcacctgggtgtcacctgtcccgccgtgcccacacagagccaagccttaggaagtgcccttggggtcctggtggggactcaccctatagaaaaaacactgcctgcgttctcctcctgcttctgcagtgactgggtgacaaggcccttcctccccctgggtctttgcttttcctctgtcagatggggttgcctccccctgagttcccccagagtgttggggaaaggggaaaataagataatagatgccaaactagtcagacccaggtagcctagttaaaatgaaaacttcattaaaaattaagaattggctgggtgcggtggctcacgcctgtaatcccagcactttgggaggccgaggtgggtggatcaccaggtcaggagatcgagaccatcctggctagcacggtgaaaccccgtgtctactaaaaatataaaaaaattagccgggcgtggtggcggctcctgtagtcccagctactcgggaggctgaggcaggagaatggcgtcaacccaggaaggcggagcttgcagtgagccaagatcgcgccattgcaccccagcctgggcgacagagccagactccgtctcaaaaaaaaaaaaaaaactaagaatcggccgggcgtggtcgctcacgcctgtaatcccagcactttgggaggctgaggcaggtggatcatttgaggtcaggagttcgagaccagcctgaccaacatggagaaactctgtctctactaaaaatacaaaattagctgggcatggtgttgcatgcctgtaatcccagctactggggaggctgacgccggagaatcacttgaacctgggaagcggaggttgccgtgagccaagattgtgccattgcactccagcctgggcaacaagagcgaaactccatctcaaaaaaaaaaaagaattggctgggcacagtggctcacacctgtaatcccagcactgaggcaggtggatcacttgaggtcaggagttcaagatcagcttggccaacatggtgaaacccccgtctctactaaaaatacaaaaattagccaggctagtgtcaggcacctgtaatcctcaagaggctgaggcaggagaattgcttgaacccgggaggtagaggttacagtgagctgagattgtgccactgcactccagcctgggcgacagaacaagactccatct

SEQ ID NO: 127613 - DNA, 388 bp, Homo sapiens
ctcaaaaagaaaaaaaaaggagaccggctttacagttattcaggtgagcccaagcttatggtagagagcagagagcaaagtagatggagcttcagacagtaaggaaatagagcaggcagggcttagttactgatgctggagagggagaaggcaagacagactcaggtttcttgcttgagcaactgggattgatggcagcatccttcactaagatagaaaatacaacaggaagagtttccaggggcagggacgggggtaaagaagtcagtgatggatatatgagtttcacaggattactggacattccaggggattagttgactctgtcagtctggatctctctggaggagaggctgggttgaagatagagaacaaggagttactagga

SEQ ID NO: 127614 - DNA, 525 bp, Homo sapiens
  misc_feature (1)..(1): n is a, c, g, or t
ntgcatcgaagatggacaagggagattattaggtctaaggaacagaatgacgaaaaatgagaaaagtgaacatagctgctataggttaaatgttatcccttggcctcccatagtgctggtattacaggtgtgagccactgcgcctggccaaaatccaaactttttgagcaccaacatgacactcaaaggaaacgctcattgaaacgtttcagattttgaatttcctgatttggcatgctcaaccagtaagtataatgcagttatccccaaatctgaaaaaatcccatatctaaaactcttctggtcccacatttcagataagggatactcttatctataccggcaatgaaaacaaatgccacctcctgtgataagtccctgtaaccaatggtctttgtttcagaacagtttgcgtagactcctcccttgtatctttaaaaacttctccttgccccagcaccctcagttgtacctatggtctgtcatagcacacatatcccacactgtaatcccttgccgttcccg

SEQ ID NO: 127615 - DNA, 592 bp, Homo sapiens
gagttctgatgtgcagtgattgtgtgaagaggcctctgtagaatttcaggagccttttgaccccaccattgcttggccagaccagaataaacccaatgtctagccagtgctagaggaagccctggtctcatcaggcttaaaggtgacagtaactgtgatggttaatattgagtgtcaacttgatgggattgaaggatgcaaagtgttggtcctgggtgtgtctgtgagggtgctgccaaaggagattaacatttgagtcagtgggctggggaaggcagacccacccttaatctgggtaggcaccatttaatcagctcccagcgaatataaagcaggcagaaaaacgtcaaaaggtgagactagcctagcctcccagcctacatccttctcccgtgctggacacttcctgcctcaaacatcggactccacgttcttcagttttgggactcggactggctctccttgctcctcagcttgcagatgagctattgtgggaccttgtgattgtgtgagttaacacttaatattacctcccctttacatatatgtctatcctgttagttctgtccctctggagaaccctgactaatac

SEQ ID NO: 127616 - DNA, 289 bp, Homo sapiens
actgagtcagatattgatataatcctattacctaaacttcagacttcgtctggatttcccaggtctcccacacatgccccgcttctgttccagcatccaacccaggacaccaggtggcatttaatctgtgtctcctactcctgtccaatatgtggtgactcctcagtctgtcaatgtcttttgtgactttgacacttttgaagaacagttattttgttgaatgtcccctaatttaggtttgtctgatgcttgtccatgataagactagggttacaggatttgagggaga

SEQ ID NO: 127617 - DNA, 290 bp, Homo sapiens
aaagagcgtctccccatgctctggagatggagaaggcgtgcctgatcttgccagcttcggtgaggaggaggtggcatagggctctgccttggagagttggagcagcagtttgtcagatggcaacgcaagaacaagtgcagatacaagttcactatcaggctgtggccaggaagcagtcagaacaagacagaaccgcaggggcccgggaaagggcctccctgtcacccctgggaagtcaggcgtccacggaggggccggcaggacgtgagagatagtcagatccgcgtgtt

SEQ ID NO: 127618 - DNA, 258 bp, Homo sapiens
ggttccctttccctgagcggcctggtgacccagcttgctgcatcatcgccctggggtcacactgcatcataaaggaaaggatctttttttgttctggccaaagcaaaatacatgcaataaagcatagacattagccactctgcttagcactcaatatcaaactggcaaggtttagatttaccctcagatgggccctgtcatctttaacccaacctctgactaggagttttaacacatggcttttgggcaagatggcca

SEQ ID NO: 127619 - DNA, 152 bp, Homo sapiens
agatgttgatcaaaagacacaaagtttcagatagacagaagtaataaattttagcgatctattgggcagaatggtgactacaataatgcactgcatattctgatactgacaaaacagtagtttttttgtttgagacagagtcttgctttgtg

SEQ ID NO: 127620 - DNA, 315 bp, Homo sapiens
ttgtgaagtggagtgggggagtaacatacaattttttttttggtatgtcattacttctgttttatctcaacacttccaatttgttcattttagtcaaaataatttgtgaacacagaggtgcaagtgcagaaagtctgaaatgaatctgcattctggggattggctttccattagcaatctttgtcaatgttcaaggaaggaaatttgagtgattattttaatgttctgtcatcgctagcaccagcctggaccttgatctttatgctgttgtctttaattttcagtggcagcgaaccatggcttttctttaaaagg

SEQ ID NO: 127621 - DNA, 740 bp, Homo sapiens
tgaccatctttttttcctggtggaataccatgcaatcaaagagaccagaactagggaaaaggctaagactaggaacaaatcagacttttaaaaaacataacaccatggcaaattataagttctttacctacgaaacctttgaattaagtgacctaatctttatataaattccaaaaaataacttaattgttttatgtctaatatataggttggaataggcactcagaaaattatttttactttatctcagttttcacactatctctgtgaccttaaactcgtgatgtgagcctcagttttcttatctttgaatcacagctctgtcacttattatctgggtggccttaggaaagttatttacattctttgtgcctcagtttctccatctgtgaaatagggattaaaatatatattaagcttacaggtgtcatgagggttaaaataccaagaaaaaaaaaaaaaaaaaaaaaaaaattttggggccccttggcccccgaaaaatttttcaaagacatattcgttgtggggccccggcggcccccagtagtgtgtagtgcagaccatgtgggtcaaaggttgtggtccccaagggaagatcccgggtcagaagagatgggtgggatgtctcccccgtgataaaaaaaggccggggggagcccagcaggttgctgaacaatccagatggtgtcgagagcaaaagcgggtcgtctacagggagttcccaagagccgatagaatac

SEQ ID NO: 127622 - DNA, 350 bp, Homo sapiens
agaatgggagggctttgagttcacaggcctggtccgcctggatcaaggctgaattctccgtgcctaacacacaggctgacacacgatagctactcaatcagtacttattgaaggagtgaaaattctagaaggattttctcttgaacctcaagttacatctacagtccctgtaaccaaggagtgagcacaaaagccctctgatgcctcatcctgactgtatttggtatctaagtaatgaaaactgttaatgtctcaaaacagaaaaataatcaagatgccgcacaaccaatcatcatctacaggaatgcaaccgaagtattcgtttggcccaaaggtgtttttctttctta

SEQ ID NO: 127623 - DNA, 355 bp, Homo sapiens
tagctcggttccccttttggggtctttgcttctaaaaaataattaccggtcaaattaaacctacgctttcctttattttaaagtttggataggcttccagcccccacacctttgacctctggcctagttttcaagagagaaaagaacactctcaggtgacaggctcagaggctgggtcagccatcagatgaggtttgagcccagtccaggagctgtgtgctagaacctcagtcccacctaaccatgtctgggccttgcccccaaaagggctcagagatggctctgactgtcctcttggcactgtggggtcctagagagcaggggccctgcacatccatcagcaaagacccaaaag

SEQ ID NO: 127624 - DNA, 445 bp, Homo sapiens
ctggctcagcccctcactggctccgtgcctagggtggagtctctccccccgggtctcagtttatctgtgaaataaaggcgctgcaccagatggtccaccagattcctcaatctgtcagttgaagcttggagtctcatttaaagaatatcagttaccagaagctggaaaattgatacagccatttttaagggataaaatggcaaaagccacattaaaaaaaaatctcgtatacactattacctttagagaagcctcctatactcaccagggtgcaaggcagtatgcacaggggtgctgaagtcaccaacggataataaaacacgggaaagatagggcaaagggcaaataagttccaaaccagctacactctggaatagttgggaatatagccatcaagaaagggctcatagatccccgtatcctgacacagagaaatgtccatgat

SEQ ID NO: 127625 - DNA, 416 bp, Homo sapiens
gaagtttcattgtctttcttttaaaaggatgttttgaatataattattcaaaaacatggaattttaaaaatattgacaagggtttcataatagtgcatgattcatttaagaagcttagagaatgcaatgataggcatagtcactttttaaagcatatgaaggatttagatgggaaaccatggcccttttaattcatgaggtattccatcatcccatcatcagtattcagggggcgactgtcctgaatcagtcacgagctcccctgctgcagatcctgtaatttgaatcatgtgtaataatatattatcctactgggggccttctttcagtaggagaatggtttatacattctgctgtaagagaacttttggcttctagccgactcacagctattactcacataggcaatcacgatc

SEQ ID NO: 127626 - DNA, 428 bp, Homo sapiens
gcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaacttt

SEQ ID NO: 127627 - DNA, 522 bp, Homo sapiens
gcgaattcactagtgattgtgagctgagatcgcaccaccgcactccagcctagcagacggagactgtcttttttaaaccaaagacaggcgagatacagtgactcacacctataatcccagcactttgggaggccgaggtgggtggatcacttgaggtcaggagtttgagaccagcctggccaacatggcaaaaccatctctaataaaaatacaaaaattacctggtcgtggtagtgcgcacctgtaatcccagctactcaggaggctgagatgggagaatcacttgaacctggggggcaggggctgcagtgagcccagatcacaccactgcactccagcctgagtgataagagtaagactctgtctcaaaacaaaaaaatccatttgtttaacgttcaaattaggtactctctaccaacactggtggccatttacagtaatggagattaaatgaccttcaggtaaaaagttatcattcttggctgggtgcggtggctcacacctgtaatcccagcactttgg

SEQ ID NO: 127628 - DNA, 621 bp, Homo sapiens
actaacagaaatcttcatgtgagaactacactgaaagtttgaatttttcacttttttgcatttgttttttcttaaagaatttactcagaaagtattgatttttttaattgcgaaaaaatttgctgaatgcacttttggtttgaacttcattttaacattaatactgctgatttagattataaggaaagagattaagtctcatatgaaggaaatactgtcttcaaaatgaaaccttggtttcaatgactttcagataccattttcaccaacttaagtttgtaaacgttctcaaagtttccgtggacttgccaactggttttcattgtttcagaagaattaaatcaaagttcctggtgtcagatcagctcagcactgaagtttgttaatttcagccaagcttattctacctcttatttaattttttatgtttacctaaagtataacactggaaattaagaaatcatatcaaatatggtattcattatatgaaaacaatgaaagcgagcaggaattaaaattttgctagtaatttccttcttttcagtcctttaaaaataatgaaagttggaattgttttattactctcagatactttttagtatagaaggaaatttcttcaga

SEQ ID NO: 127629 - DNA, 621 bp, Homo sapiens
ttcaaacaaattcctaaacacgtactgaaaactgccaaacacatctctgttgggtttactataggttcactccagaaggaaggtaatgtatgctgtttgtttatttgtttgtttgggggagagtttacttcctgctccagccttgccccctacacatgtgccacatgctttccttactctgtgctcacctctccactgcagtcctagggcacatctggacaccaaggtgtggtgagcctccagaagataacctggcctcctcaccccaggcaatgacccaggagtagcggaattactagaagaaccacagcccagcagagaagtcatcctcttcgcttattatgttattccatagtagtaactgaggcactgcagagaaaaagtctcaagattaaaacctcaaaaactcaggagtgaaaagtggaacaagcgaattatagaaaagcctggcttgaaacacactccaatcagacatttccgttttaccaagagtggtacatcacagtactctatggatgccagctaccgtagttctttttcctttaggagagactaagatactgggaaatgaacgttgtttggtcaggaataaaatggtgaaagatactgggtctgtctggg

SEQ ID NO: 127630 - DNA, 237 bp, Homo sapiens
ctttaaacaatgcctgtaccatacataaccctttgtaaagatgcttagctaaccccctccccaagtggctatgagttttgcattaaaatcggagatatggccacctgcacatgttttaccctaaaagcttgctacataaaagtactttctgcagggcagatgtggggatctaccattttgtggcagcccggaacatcgcttctgctcctaagtccctattaaatatttctttacaag

SEQ ID NO: 127631 - DNA, 364 bp, Homo sapiens
ggtaggcagtaccttgcttgcaatatgaactcctctgactagagaatactatatgagataattgatggttaaagagtttatgaaggaggccaggcactgtgtcttatgcctgtaatctcagcactttgggtgggggccaaggtggttgagtttctttgagcccaagagtttgagactagcctggggaacatggggaaaccccatccatacaaaaattagccaggcatggtggcgcgtgcctgtagtcccagctacttgggaggctgaggtgggagaatcacttgagtttcggaagtcaaggctgcagtcagccatgatcacgtcactgcactccaccttgggtgacaaagtgggaccctgtctc

SEQ ID NO: 127632 - DNA, 153 bp, Homo sapiens
tctaatgaattatgcaagtcttaaaatgtctcaagaaaaagattactcattaggattttcgaatgaataaattcaacataattgttggtgcaactgctctctcatgtaataggtaccaaaatctgattcatgttttatattggagggacgggt

SEQ ID NO: 127633 - DNA, 375 bp, Homo sapiens
gtccctaccccttctcccataaattcatatgctgaagtgctgaccccccagcacctcagaatgtgaccttatttgggcataaggtcattgtagatgtagttagtaaagatgaggtcatactggagtagagtgggctcctattccaatgtgactagtgaccttataaaaaggaaaaattgtacagagaacatgaaggcagagactgcatgatgcctgtacaagccaaggaatgccagagattgccagcaaaccacctgaagcttggagagaagcctggaacagattctctctcacagccctcagaaggaaccaatcttgtcacaacttgatttggggctcaattccatgagctcctacaaatccatcacccacgta

SEQ ID NO: 127634 - DNA, 215 bp, Homo sapiens
aagctttatcacatctcattactggttcagaaactacaaccacgtagtattttctaaagggaagtcactgttcaaaaatgcctccggcagttgctcacaggtggaaaccgtgtgtgcatcgctgtgtgtgtgtgcatgcgcgcacgcgcgcatggaggcaactgtgcatgccggcctgtgcacgtgtgtgcaagtacacgagacacaggactttc

SEQ ID NO: 127635 - DNA, 376 bp, Homo sapiens
agtcttgctgtctcaggggtggcagaggcagaaaagatagagaaggtaggaagggaggtgggagaagcaggcacactcagtataccttttattgaaaaaaaaatccatgtataaaattcatgtataaatggacccaggaagttaaaacctgcattgtttaaaggtgaacggtgtcactgtaactattttgcatcaacacacttataaacacaaatgcaacatgagcactgaagttgagagcctgtattcttatatatctagatgatacagaataaacttttgctttttacttttagcttatttccaaaatataaatatagaatcaaaacactttaatggtaaattgtcttttttttttttttgagatggagtattg

SEQ ID NO: 127636 - DNA, 784 bp, Homo sapiens
ggaaaagctgtattttattcaccttatactttttacagtcgaaaactttttcttttcttattttagaggatcttaagttttaacctgagcatttaatgttttcttttttcagacaatccaagaaggttcatgtattgtactttgttgtaaacaaggaattctgcaggcttttctaaaaatgctagattagctgtttttttttttcctctgtgggtttttagttgtaaaatacaacttactttgttacctttcttttctgtgcagttgaaattacgtagtgttaggctagtaaaacttgtgttattcaggttgactttccacagctcactgatgtcctttaaaaatttagtaatcttaacttattaatctttcttttcgcctcaatataaaatgtcctgccttgaggagatgccttggaacccagagtcgatagaacattttttgtaacctgtgacttccattttaaagtagaaagttatgaaaagagattctgccaaaattcttcaccttacctcatatttgaggtttagcgttttaggaaaaaaaaaaaaatcatggaacatgtggctatcacaggctaataaaaatctagccccacccatagcattaaatgctcattctttgttcttttttatgaaaatcatcttaacttgattttacacaggaaactggttttaaaaaccttgagaaatcaggataatcacagattaagactacttactccatacctgattcttatctacctctatgagagaccgggatagtggacatcagaatccacaaa

SEQ ID NO: 127637 - DNA, 272 bp, Homo sapiens
tgcagggacctctctgatgagctctgattttgaagacatgcccaggagaggaaaggagacatcctaacggaggatgagtccagaaatgggaagcacatctgatgcggggaatgcggcccatgggaagcctcctgaaaacttacaagtagcattaaaaggttctaagtttggctgttggcaacgggcatctcaaacaacagctccttcaccaagttacaaattcactggtctttcacataaaccccacgctatggtggccgctgtatgccatg

SEQ ID NO: 127638 - DNA, 348 bp, Homo sapiens
ctagttggaaggttgctaggtctctttgggcaccatctaaactccatcttgtctaagccaagcactctttctgctggtttttgtcttgctccccaaaactgtctaattagggtatcttcctggttaggtgacatggatacagttatatgagtggcatattctttacaaacaatagaaatctccataggaggggatggggggattaagtggggagcgtttctttctttttttttttttttaagatggagtcttactctgtcgctcaggctgaagtgcagtggcgcgctcttgactcactgcaagctccacctcccaggttcacaccattctcctgcctcagcctcccca

SEQ ID NO: 127639 - DNA, 427 bp, Homo sapiens
actataagttcctcctaaagttagtttggcctatgcccaggaatgaacaaggacagcttggaggttagaagcaagatggagtcagttaggtcagatctctttcactgtcatcatgttctcattacaatttttgcaagcgtgctttcaaaactgccaccaggctgtcttttcaattctccattcactccacctcctaaatcagcatcgccttccagaatccaggctacagattcgcatccagggagcagactccttttccagatgaccacatttctccgtgaattgaacgaacgcatctgcagtgagtggagtctgcccatctcttctttttcttggcatcctttgccaaagccctggcacatggacattcttggtctgtgttgatagtgcctggataatttaggggtttgggacatgactacagata

SEQ ID NO: 127640 - DNA, 271 bp, Homo sapiens
gaaaattaatatccctagaagaaataagagaagatattgtattcatgaaacaagagtagtatagtatatgaaaggaactttcagaaaacaagaactcttagaaataaaaaataaagtgaaataaaaatctcagaagatagaactgaagaaatatccatgaaggtggaaaaaaaagacaaaaaagaaaaaggaccctaggaagcagcaggatattccataactgaattttaggtctacagagaaaaaaaggagagaaaatagagagggccat

SEQ ID NO: 127641 - DNA, 711 bp, Homo sapiens
gtcattaagaatgttggagagatttggatttctagcataaaagaaatggtggcaacacttctaaagtggacccatatattaatagggacatatacctgtatttaactttttaaattttgaaatagttgcacttatagaaaagttgcaagaatagtacaaagaaatctcaaaacccttcccctggttttcccagcatgttagcagtttgacacatttgctttatctttccacatatatacataatactatctttctgaaccatttgaaagtatgttgcaaatgtgccctttactcctaaataattgagtgatattttaaaagaacaaagaggttcactttctaactacactgtaattggcaatatctggaagtttcaccataaaatactgttttctaatctatggatgttcaattttgccagttgtcccattagtacagtttatagcaattttccttattctggtctaagatactctagatgtcctgcaagtggttttcatgtctctttactctgttagaaaggttcctcagccttcctttgggtttgatgacattggtgtattttgcaacgagttcacaggccctttctaattttttcccagaactgtcacgtccaacttctgggggtttggtcctggttgttttctctccattggaattaagacttccagggttctatgttattccttggggggggggaaatttttccca

SEQ ID NO: 127642 - DNA, 292 bp, Homo sapiens
ttgatgacaaatgtattgaaagagagatgtgaaaactaacacgaaaccttattaagataatgagataagtaatgtcaacaggaaggccaaggaagagaagtttgccaattatttttaaagttttctcttcagtgcacaaaagcaccacttgtcaatgtcatctaaccaagagctgccatccctaacttcctattcccagtaacactaggctccctaggttaattcatgtgaactctaggcccagatgaaatgaaccactactgactagatgacagctctaaagccaggacat

SEQ ID NO: 127643 - DNA, 297 bp, Homo sapiens
tagaaaagattttatatactctacatacaattctccatacatccacattcagtgacaaattgtaatctttcggcctaacagttctagtgtaattttagataataaaaatattcaccacttacagttctagcttatgctaatagacccacagtcatcagagatgctgagactaagcaacagacttgggactcagaaaagtaacactattgattgcactgccttttgaaaatgaaacttgcaatgaaagactctaacttacaccccagaacttggaaggaggagcaattaccatgaatt

SEQ ID NO: 127644 - DNA, 257 bp, Homo sapiens
tcaactcggttcttcttgactttgtcctgtagtcccgtcagaggtggatggtggatgagatgagagagactcaggggaggtaaaaactgctcctgacctttgcccaggactttcccagagcctcagagcaggatccctgggtctggcttggcacccctgggggatgtgcttgcaggaaggggctgtcaccgtgcctcatagtgacttccactgggtcttctctggctggtggtggcggcagttgacagcggcgggac

SEQ ID NO: 127645 - DNA, 429 bp, Homo sapiens
ttgtgtgtgttccttgtgaccaaccactcatttgaggtcaaccattataaactcatgtaggaagtagagcaacctatacagacataaaatagagagagaatgatgattttcagttttgaatttcatgctatgaatattaaatctggacaaaataatctgcatagtgaaaagaagagggtggagttttgatggcaactatcatggccaccaaggctaccttatagctaactaaacacctctcatgcttttcactattccatataaaatacgcacttttaacttgcaattttgtttcttaagaaattttagtggccaggcggggtggctcacgcctgtaatcccagcactttgggaggccaaggcgggcggatcatgaggtcaggagatcgagaccatcctggctaacacagtgaaaccccatctctacta

SEQ ID NO: 127646 - DNA, 426 bp, Homo sapiens
ttagggggcctgcgctcttttggggcttacagacaagctaaatgacaccatggggcagcaaggagacatatccagaagtttcttgaataagccaatgctatttaaaaaggggtggggggaactgtgctacactggaagacatttaagcaacatatcagccaaatataacgcattgtcctgagttggatactagggtgggccaaatacctgtaaaaaaaatattttgaggataactggggaaaacggaaagtgatctgtgcattagatgaggtacaagtttactgaaacaacaatttcctgaaatggggttgggaatggtggctcatgcctgtaatcctagcactttgggaggccaaggtgggaggactgcttgaagccaggagttcaagaccagcctgggcaacatagcaagaaccccatttttac

SEQ ID NO: 127647 - DNA, 697 bp, Homo sapiens
tgcgctggctcacgcctgtaatcccagcattttgggaggccaaggcgggcagatcacaaggtcaggagatcgagaccatcctggctaacacagtgaaaccctgtctctactaaaaatacaaaaaacaattagccgggcgtggtggcgggcgcctgtagtcccagctatttgggaggctgaggcaggagaatgacgtgaacccgggaggcagagcttgcagtgagctgagatagcaccactgcactccagactgggtgacacagcaagactccatctccaaaaaaaaacaaaaaaacaaacaaaaacagaatagagagcccagaaaagaacgcttttgtgtatgatcaaatgatctttcactaagtcaccattaacacatgatagagaaaagataatcttttcaaaaaaataacgttgaaatcaggttatctacactgataaagctgaatcctttccttgaactatatacaaagaatatttgaaataaaatatttagaaatttaaaaaataacaatctcttagaaaaaatataggaaaaaaacatgacattggtattggcaccattttcttagatacaacattaaatgcatgagcaacaaagagaagaacagaataactgaactacacagtacttcaaaatttctgcatatcaaagaaaacattcaaaagagtaatgatgcctcctaggaaatgggtg

SEQ ID NO: 127648 - DNA, 354 bp, Homo sapiens
caaagggacaagcaagagcattgagtgtacatcatcgcaaaactaagactaaataaacccaggtttgggggagaaaaaacagaatgtacacgttacctactctgacaatacagaaatgatgcaatagaaaaattaggaggacaaagattatggaataaatgaagtagggtgagtttttgcaggctgtttcatctataataaccgagagttaaaagattatttaaatcacatttaattaacagtgtaagaataatattaagaaaaacaatattgctggctgaaatcagataataggtcaatcatggtggctcacacctgtaatcccagcactctaggaggctgaggcaggcagat

SEQ ID NO: 127649 - DNA, 732 bp, Homo sapiens
gaattaaattagcttttcatggtaacctaggagctatttctggaaccaatttggaaaatgatctttgtatgctgtggcatttatgtttgattatgtttttcttagtaattctcaatggaccagattcactccttgcttcagtcatcaaacttttgtgatttttgtaggcaaattatgtatttcctgctccataattatgcatatttatggatactatattcttcctcctcaaatatagaagttgtaaaaacttcttaattcgataacataataaaattatttaaattttatcatttcaccattctgtgaagtatgttaagactgagataaacagccatatataaatgaacttcttccaaaaaatgtttcatacgatttgacttttgacacttactaaaaaaaaaaggtatttataaaaatggcagataatccaaaacttcttataaatacattgtcttgaaatacagaatatttcaaggcacattaaagattttgtgtatattctaattgcagtctcttgatttacagagccataaagacattgaaaattgctttgagtaactcaattttcaagttttttagctgttaaagtttattctttgtgatcagcatgggatatattttatatgcttggtacaaggactgtaacttaatgtctttatttcttgaatacctcagacttaacagtttaaagagaaaacttaccttctccttaaaaaacaacaacaacaa

SEQ ID NO: 127650 - DNA, 503 bp, Homo sapiens
agagcaaagacctgcagaggggaccactgcatgtggcagctgccccagatgctgtggccctggctgctgtgggagggtaatttttgttaagatgaactaagttgggactgcatctcacacagtggcctttgtataaattcgcttgccttcctcatccggtatctgtcccctctttggttcacaccctggatgcaggtgttcgggggaatgtgcattgccacacttagaacattcaagtttctgccatccctgtgtttctggagtgacagtgatgttcccgggggggaggtgtgggttcatgcagcaagtcccatgcagagtccggggcaaattcaggtcctgagtgaggtcgtagtgggtacctggctactgaagaaggctgaggcaggagaatcgcttgggcccgggaggcggaggttgcagtgagccgagatctcgccactgcactccagcctgggcaacaagagcaaaactcgatctcaacaaaaaaaaaaacagggaag

SEQ ID NO: 127651 - DNA, 356 bp, Homo sapiens
cgtttacaatgattgaaggtcactctaggttcatttactttttattctaaagccaaatatttaggtccattagaggccaacattattattaagagctctttagcacccaatgacatttttctttcaaaaagtcaatattttatagaatctaaattaagtgggaaaagagatttaagattcgctatgaatacattctaattatttttacaacattttataacaagattaaacttttggtgagttctgctaaactatgataactacaaatctggaaacctttttctcccccccaaaataattttatcttttaggttctttcttcttttttgttcctctgtttttgctgatacattgag

SEQ ID NO: 127652 - DNA, 185 bp, Homo sapiens
aggggagaaacatcacttgagaccaggagttcaggacctgcatgggcaatacaatgagaccccttctctaaaaatagaatagaacaggaggtacatatacccaaaggagtattactcagctataaaaagaatgaaatcctgtcatctgcagcaacatgaatggaactggaggtcattatgttaag

SEQ ID NO: 127653 - DNA, 749 bp, Homo sapiens
actatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcagatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgacgatttgaaaggatgaaattattacaaagggggtgaagtgaagatcattctgtgcgtgaccaagatcatagcgaaggacaagagaag

SEQ ID NO: 127654 - DNA, 692 bp, Homo sapiens
agaattggggagtctaattttctacattataatacaattggcatttttttccagtagggaagtagattttggagaaatagtactattttatactatatgaatcgaacctacttttgtgaaatgaattacactaaggtatagagaattttgaaaagttgctacttccgtttcctataactacaacctaattctaactctgtggctgagcagatgcctggaaagatggaagtcttgaagaaacctattgctcttatttcgcttataggaggcaactcaaatatgagaatatgagaactgtgttttgaaataagtttctgatactaatgtgttttgtgctgtgctggtttatgcaaatgtacccccaaaagtctgaggaagctgaaaggctgaagaaagaggctgcaagttgaatttagaaagaaacatttaatagggactaatgatcagaagccgtgtgtgcctggggaggttgcaagacaaggtgactccctgcaccgttatcttccagacccagggcttatatatcatagggaaagggcatacgtgatttagaagggatatgtaggacaactgaagtacgatagcatcaaggttgttttgacctaatggcaggatttatggtaagtacctgctcttaaacaaggaataatagataaatgggaaatcttagaggcattcccagaactgggttg

SEQ ID NO: 127655 - DNA, 352 bp, Homo sapiens
gtaaaatggcaacctttatgtagttcactctactgtcacaagatggcaataactctttacctacaaattactctaaaacatttttcttccacttgtgaacttgctaaactgatgagtaaatactttatataacccgaagcttcaaatgtaaggccttttcatactttattactggcctgtccattacatactactgttttagaagccctaaatatggaatcgggaaaagccttggaagttttccatacgtatacgctaggttaaatgaaaaaaatactttacacggaaacaaggagccaataacttataaattggctctctaaccctaactggttacaagaaaggctccaaa

SEQ ID NO: 127656 - DNA, 106 bp, Homo sapiens
gaggtacctatctccctacaacaaattcattcattcattcattcattcttcaatcaaaagtctgtttcttgaagccaaagagtccaaattaatgtaatagttaaac

SEQ ID NO: 127657 - DNA, 203 bp, Homo sapiens
gacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccacccc

SEQ ID NO: 127658 - DNA, 473 bp, Homo sapiens
aggatccccgtgcactgcttcggatggggagcactccagagtgtttggggtcccggcccttctcccctctgatgccctggggtgggtcttccccatcactgcctgagggctccccatccgcttattattgtcagaggtcatggacgtgctgaacacgtttaagaagactcaagtccactgaaggctgggcacggggtggtgctgcccagaactccataggcccagcttttctggggacttctgcccagggcctcgggtgagctgccccgtgcctgccctggaattcaaggccacatgtagccatttattcagcttttctaaatggcctcttcacggtctgtccccaccagtttccagggccggggggacttacctgccacccccaggcttgctccgtcctggccctgggccactcagtccacactccatgtttataggtgataggaggccatctgtgccccgccccacgacgg

SEQ ID NO: 127659 - DNA, 418 bp, Homo sapiens
agggtcacaggatacagaatcaatccattgaaatcatttgtacttctatatcctagtaacaaaacattggaaattgaaattttaaaatatcacttaaaagtcatttaaaagcataaaatacttaggaataaatttaattaaaagcattcaagatctgtacactgaaaatgactaaatattgctgagatagaggaaatgtaaataaatggagaaatatatgatgttcatggatcagaagagtcagtatcattaaggtcttcattctcccccaaatgatctatagattcaatgcaatgccaagctaaatcttaacagatttttttttggtaagttgacagtcttattctgaaacttatatagcaatgcaaaagatctagagcagccaagcaactttgaaaaagaacaaagttgggacacc

SEQ ID NO: 127660 - DNA, 437 bp, Homo sapiens
aggcctttgcagggtggtctgcttattcctcatccacgatgagaccctgtggtccctgttcctgggcctctgcaaaacctgggggttcccctcgtcaccccacagatgtccaaggcacctgctctgcacagggctggtcgcagccagagaaggcaggtggctggagggaggcatgttgtgctcctcgtggggtgtgatttgaactgtggtcagcaccttgaagacctaggatgggactgggtgcctttcatgaggagcatagcctacccttggaatgcagggcagtcgacagggcctaggcagagagccggaccctagcatggggagggtgctgtgtgtttggtggatagtgaggaagcacggcagaggccgagctacactaagaatccttgtctgtgtcctgtgagctcaggggagccagcaaagcacatggaatt

SEQ ID NO: 127661 - DNA, 206 bp, Homo sapiens
acaattattccccattgctctctctaccagtcccctgtcaactaccattcatttttctgtctctatgaatttgatgaaatgcttcatgtaggtgaaatcatacagtatttgtccatatttgactgtgtataatgtcttttaggttcatccatgttgtagcatgtgtcagaatttcctttttaaggctgaataatattccattgtat

SEQ ID NO: 127662 - DNA, 243 bp, Homo sapiens
cacattcctcgccgggcgctcccaccccaccccagcctgtgcaggtgggacccggccaggcaggcgggcagggcggccaggtgcgccgaggggcgcctccacggggagtgtgctccgcagagaaccccttgctggggcggctctgggcctcctgactcactcctggattttcccaagctgagtctggccccgcggtgatgattaacccaacacctcaaccggcaccgccacgctagctccact

SEQ ID NO: 127663 - DNA, 516 bp, Homo sapiens
tctcaggattggagccgcagcatggactctgctcatggcattctgccctccctagcactgaagagacactgccacacaaatggtccacgtgtccattcccccgtggtgaacatcgatggacgtgtcttcgtgtgggcgcactcctgtttctcttgggtaaacacccaggaatacatggcctttgaggttgtacgtgtgacacccccacctctggagtctggggtgccctcctaccgaccagctccaggggtgtgcggcagcaccccccatggtgggactggggttcccagaggagccctgctgctgaaccctgcacgctccgtgcccgtttgcagacattctcaggctgagccccgcacgctccatgcccgtttgcagacattctcaggctgagccccgcacgctccatgcccgtttgcagacactctctgaggctgagccccacacgctccgtgcccgtttgcagactctcaggctgagccccgcacgctccgtgcccgtttgcagacaccctct

SEQ ID NO: 127664 - DNA, 530 bp, Homo sapiens
ctgtgtagctgttctagaggtacacgtccagtcaggtgtgccagtttcatggggtgtagcagtaatgtagaggacagaatgtacttcatgaagtaggaagtaaagtaggtcacacctgaaggggatgaaaataaggatgaggtggaggtttggaaaggctgctgcaagcatttagcaaaaacaaaaacacgtcggctgtggaagagactctgtgcttcactgaaggccaactgagattaaaggccacaaatttggggtggcacgcatccacttggtggcatgattttttttctagcgttacaagttcaaacataggtacaaataagggaaaatatagtgcactggagaccccacctgaaaaggaaatgtgccattgttgggtatctagtgtaccatagctgtaaagaatgacatgatgctggtattttggtaaagtatacaaattatacacatgccttatctagaagcagcagcagctcttccctcccccgctgtccccactacatcctcccatcagcactccaaagtct

SEQ ID NO: 127665 - DNA, 423 bp, Homo sapiens
cttttggggtctttgcttgcaatggaaactggtgagtgagtggaatgagtgaagactgcaggaattacaatgttttactgcaggaattacaatgttttactgcaggaattacaatgttttactggataacggaaaaaaactataatagaaaactagctgttaagtatgagaatttgatgtactcttagttcaaaatggttgccaagagtgctccaggtaacttatgttgtagattagatttttaaatgtgaaaactatttatactggagaaatttataaccaactaacttttatttagtatacaaaatttaaaaaaattgttcaccagtttcccaaagtaaagcagaatagtgatatgcctttacctgggttccaagtgtcctactctacatagtgaaccagataaatactgctttgcatttc

SEQ ID NO: 127666 - DNA, 440 bp, Homo sapiens
tctcagtgtgggaatgccctgagcagaacgcccacttgcacaggcagctgaacgccgagctccaaagtttcccaaggggtcaagagaactggcaatcagcagttctgtacatggtgatcctggagtttaccttgtaaatcccttcaaaaggagcaatagctaaatgccactggagaaaggccaaactttgcttttatcctaagtcaattcagagagatggtttttgaggctcagtaaacagtaaatgaatatctttctagatgaaaatttcttgagggaatatgctatgtcttatttatgttaagccctatagttcctactctagggtcttacacttagcaagaggtcaggttattaaacaaacattgaagaattatatcctaattttacaaaccagaaagctgagaaatgtagccaatgactcaaaacacggggagaag

SEQ ID NO: 127667 - DNA, 410 bp, Homo sapiens
caggcggatcacctggggtcaggagttcaagaccatcctggccaagatggtgaaaccccgtgtctgctaaaaataacaaaaattagccagatgtggtggcaggtgccttgtagtcccagctactcgggaggctgaggcaagaggattgcttgagcccgggagacaagttacagtgagctgagatggtaccattgtgctccagcctgggcgacagagccagaccctgtctcaaaacaaacacaaaagctcacagaagcgctggggtgggtgtgtagaagtcagacccccgggagcggcaggtggaggacgactcggtgcagcagccactgtggagacgacctggtggctcctcaaagatgcacagatctcccatccgacccagcacgaccactcccagctatgtacccagg

SEQ ID NO: 127668 - DNA, 545 bp, Homo sapiens
taatggagtttttcactccactttcttattcctctacaagttgctcatgatgttgggtggtaaatggctatgaatagagctggcctagagataccatgagatatgatggcggaagcctgacccagaggcataggcatggccagcagccctgtgctcatgcttcccaagtgtcacatgaaagatattaagggatgtgacttaaaatcttatgtaatttaggacaagaaagattaaaaaaatataccattttttagtgggaattctgcctctctctacccctctactcaccgttgaggaggtaaagtgacatctgattggtaaatctggggggaaaggctggtctcaacttgcatatgttcctttatatctttagttataattaatccctagcctttaagtcataggtcctttgagaaggtgatgaaagctatgggtcctctccctcgaaaaatgtacatacatactatacaatgtcagtgtatgcactgtccccttctactccccaaatctacccacataatttatagatccacatatctcaggtt

SEQ ID NO: 127669 - DNA, 560 bp, Homo sapiens
aagaaaatggacacagagagatgtgtgagaccgttgccaagatccagaaaagtgtgcatggtagcttagaccagtggttctcaccagggaaattttactcctctgaggacacttggcaatgtcttgagacattcttggttgtcacaccatgtgtgggaggatgttactggcaactagtagggaaaggtcaaggatgctactaaacatcctacaatatacagggcagttccctcaacaatcatctgacctgaaatatcaatagtgctccaactgagaaatcctggctcagaccaagatggtggctgagagagaaggaagtacatattgcagagacgattaagaggctaaaatcagcagtaattagtgactgattgatcgtgtataatgggggaaagactatcaaaggcaaccctcaggtttctggcttgctcacctggatgagtggggagtgccgagatgagaaatgcttgaggagttgatggtttggtaggggaagataaggagctctgcttgaaaccctgtaaatgtgaggtgcctatatgacacttgaaagatgaaaa

SEQ ID NO: 127670 - DNA, 512 bp, Homo sapiens
taccaggaggtatgcttttttgatcaattgcacctttgttggatttccattggggagtcttttaaaaagaagaaagtttagggaacctaggtgggagaactagaaacggtttgtgggcaatggaaagagaaggaagaatacttaagtcaaacacacctagttagcctttttgcccgaaatttcggtggtaagtgctgccgttcttcagctaatttaggttgtcctgtttgaccatgtagtcaacatttaaacaactcatttggcaaactgtcacgatcaactgatacataagccaaagggtagggttacttagattctgttcacttgatctgtgggataaaaataaccaagaaagatcttagttgctacctttcaagaatttggtgtattagtgagttcatatctgaaaatagtaatatttagaggtgtaagattatgttattagatcctcagtgaccttgttccttctctgccttcccaccttcagttctgtcccaacgtttcaaagcata

SEQ ID NO: 127671 - DNA, 793 bp, Homo sapiens
agtctcgctctgtcgcccaggctggagtgcagtggcacgatcccggctccctgcaagctccgcctcctgggttcacgccattcttctgcctcagcctcctgagtagctgggactacaggcacccgccaccacgcccagctaattttttgtatttttagtagagacggggtttcaccgtgttagccgggatggtctcaatcacctgacctcgtgatcctcccacctcggcctcccaaagtgctgatttcaacatttttaaatgtgaggattagagacatattctaggtttgtcccgttgatagttatagagactttctataacataatgttgattcttcttctattagaattgcttggcttttgagctacatcaagagagcagaatgtttttaaatgtttatatgtaattccatgaactgtgggtttttcaggtgcttgttacccagaatgagggttaaccaagttctcattcctctggttgaccgctccaaccatttcatcacatgtcaacaatccaaccaagtagaaatgaaactcaaaccagacaaaaccattttgtattatgaactacacttattattctaattttttatatttttagttttaagcctaattgtcagcatccagtgtagcctgtccccaccgttacctgggagtccagttcccattctttattactaggtaaccagtacttagctttaattctgacacttgcaggcaacattttatctagtaattttagagaaattggacatagatattaatacactttacagaagagaagtctgagaaa

SEQ ID NO: 127672 - DNA, 425 bp, Homo sapiens
ccgaagtcctcttctccaggctaacaagccacagcttagtttcttctgggcagggatggagggtcaaaagtggccaccaccaagtccttttctctctttctacacaaactgaaacaagcctttccccttcatgcctgatacccagaaagcccttttccctaatcaagagcctgcattttacctttgcccagtaaaggttctaccccagctcccttcccataaccatgcacacgcaccggtgaatccaccagtcaggcgggggctgtgtatggggaagggactcagacctaaagtgaccttaccactatgacatgagatgggccaggtagtcacaagcaaggcccaggcatgacctatgggtatggggcaagagggagactgcgttgggacagagttttgccaactagcaggatctgaggcaaacc

SEQ ID NO: 127673 - DNA, 672 bp, Homo sapiens
cgcggtggctcacgcctgtaatcccaccactttgggaggcccaggcaggcagatcacgaggtcagtagatcgagactatcctggctaacatagtgaaaccccgtctctactaaaaatacaaaaaattagtcaggtgtggtggcaggcgcctgtagtcccagctacttgggaggctgaggcaggagaatggcgtgaacccgggaggcagagcttgcagtgagccaagatcgcaccactgcactccagcctgggaaacagagtgagactgtgtctcaaaaaacaaaacaaaacaaaacaaaaaaactaatgtattcctcctttaatcactcttttcagtaacaaatatttagtaacaaataattactaaagatggcaaaagatacggagaatccctaaagccagcaaaagaaagttaactacaaagccctaatttcatttttagaaaaagctcataccctgaagtatttctctactaggagggatgggaggagggaaggaaaaagaggtgagcaagatttttcatagtttgaagatatgtattagcttatgccaaaaataataataataattgagctgtcatataattttggaactggcatgatataaaatccctaaaccataaaggaaaagactacataaatcaaaccacataaaaattacaactcctgaatc

SEQ ID NO: 127674 - DNA, 463 bp, Homo sapiens
gtaggccccactctgccactgagtgccttagggaccaagggaaatgcaggaggagggaagaggggtcggggagccctgctgttcctgggacacagacatagacaaacacacacactgcacataatacattatacacggacacacatagacacactacacacagatgctatacacacacagacactacacacagacattatacacagatacacatagacacacagagatacagagacacatacacatacactacacacacagacatacacactacacacagacacatacacgccgagcatctgtctcgggtccagagcgagcagtgtggagctcagagagagcaggagagagatatccagtgagggaaaaaacccatatttacactccacaaagaaaagatgtgcgagcccagagggacttacggggggcgggtgtgtgtgagtgtctcggatgaagtgagtga

SEQ ID NO: 127675 - DNA, 283 bp, Homo sapiens
accgcaacatataatggccctcctgcctctcccagcctgtcgcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaa

SEQ ID NO: 127676 - DNA, 496 bp, Homo sapiens
gcggcccctactactactaaattcgcccccgctcgacgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaa

SEQ ID NO: 127677 - DNA, 906 bp, Homo sapiens
gcagggctcggggttgcgggagcggcagataacctgattcattaacgtgagcccagtgggattggtgggggtgatggggacacagatgggagcactcaactcaggcacaggaccccagcagaacatgcccaggtcctcctagacatgggcccttgcagactttctgaggcctcggtttcgtcatcttaccaaggtgtgaccccaaccatcatctcctgaacttctggccacagagctctgagcaagcttccatcatgaccccattttggagatggggagttggcgcagccacactgctgctcagtggtagaaccagcatctgacccaggccacctgttccagagaccctgcttttagccagcagctcagtccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaa

SEQ ID NO: 127678 - DNA, 2221 bp, Homo sapiens
ctccttaatatctagcttttatttttagcttttaattgtttataagagaggaaccactggaaagagtttaaaatccttgttccattttcaggttgggaagtgtacgtgtgtgggggtgggtattaaacaagacttgagcattaagcatttcccctcctgagcccagctcctctcctcacttgttgactaagccctgcttcactgagcattttctttttttctgcccacaacctgagtgccccatggaggtgaaggacatagcctgagtctgtgccatcagtcagtagaacaaatgggcttgctctgcctaacatcgggccatctcggattccacctcttttataggaatgagtgatgaagagaggtgggttccgctttgccgctgtattaatacacatcaggggccagctcctagcactaaatcacgctacggcatacatctgttatcggactcttcaccagtgtgatgaacaagactgcagatagaggcttccttgtgtcattctttataggattttcctaaaagaataaatagctcagatctctgccaacactctcccctgtcactgtgatgaattcagcttctttcttaaacatgcagccacaaatcttttccctttttcccctcccccagtggtagaaagttttgagttgcaattgactgaatttaaagatattaataaggctagagaggtgaagagcaggaagaaacagcatgtcttccttgcctttttgtactaatagtaacaaaaggccaaggaaaaagactgtaaatgaccatagggttgttaaatagacccatcttgaaagtgtagcacctttattttctttgtatcttcattctccctcctttacggctttctagcatgcaggtgtctagtgcacagaaccacaccctggatcttagtgagcaagcatgctaacctgcttctcagacttgatacaccagaacagggatttccctgcaagtgtctccctcatgctgaagtgaactagctgaatatgctcttaaagaaagtagtcagaaaagaaaaaaaagattatcttctccaaaatttgagaccaagtagctgtaaaaaacataataaacccagatgaaaaccaggcttcgttttcttgaaatgattttcttcatcagaatggtagatcagagccattggtgtgcagattccaatcctttaaaaagtaaacacatgccttttgataaagcggaattgaggtgatcagaaattctgttgagaacccagctatttgtgtgagtatattttagctatcccaaaaactttttctgacctttctctttctgggataggatatgtgtgcttagagtatcattcagaagggtacctaatagttaatctgttaattagttacatcaggtttcaaatactaggtcagtgatatgagagcgagagagagagatttgaattgtcaaatgtattgtcagatgcattcacaagagcaggactgctttatctgttttgttcactactgtacccctagcatctaaatgaatacctagcccatagaataaacccactggttatttgttgtaagaataaattaatagaatcttaaagttgaaacagagtgattcctaatatattgtaaccacatggttggattcagtagttccattttaggatgtcccttttctcaggagtcatagggcaaattcttattgcccactgtgtctttttaaagtttaaatgttttttaaaattaaacatgtttcttagtaaatattgaaggggtataaaagaacatttatagcagatatgtaaggagtaaataaaatacagcaaatatccacgtacctaccattcactttaagaaaaagttaaaattttcttttataaaaggtttaaaagttttaaaaagttaaaatctttaaaaatcttctccctgctctcctcagaggtaaaagttattctgattgttttttatcgtttgtcattcttttgtttttttcaagtagttttagcagacatatgtatcttcaagcaatacattgtccagttttgtgtttttgaaccttgtgtatatgaaatcaaagtatgtcatattttatgttgcagctttcaccgggttctgtttttgagattcaattatgctttgtcctgccaaaatctatgtttcaactgccatgtatgtggtattctattgtatgaatatgattaatatgttataattaaatgttcttgatgaacatttggattgt

SEQ ID NO: 127679 - DNA, 2821 bp, Homo sapiens
ctccttaatatctagcttttatttttagcttttaattgtttataagagaggaaccactggaaagagtttaaaatccttgttccattttcaggttgggaagtgtacgtgtgtgggggtgggtattaaacaagacttgagcattaagcatttcccctcctgagcccagctcctctcctcacttgttgactaagccctgcttcactgagcattttctttttttctgcccacaacctgagtgccccatggaggtgaaggacatagcctgagtctgtgccatcagtcagtagaacaaatgggcttgctctgcctaacatcgggccatctcggattccacctcttttataggaatgagtgatgaagagaggtgggttccgctttgccgctgtattaatacacatcaggggccagctcctagcactaaatcacgctacggcatacatctgttatcggactcttcaccagtgtgatgaacaagactgcagatagaggcttccttgtgtcattctttataggattttcctaaaagaataaatagctcagatctctgccaacactctcccctgtcactgtgatgaattcagcttctttcttaaacatgcagccacaaatcttttccctttttcccctcccccagtggtagaaagttttgagttgcaattgactgaatttaaagatattaataaggctagagaggtgaagagcaggaagaaacagcatgtcttccttgcctttttgtactaatagtaacaaaaggccaaggaaaaagactgtaaatgaccatagggttgttaaatagacccatcttgaaagtgtagcacctttattttctttgtatcttcattctccctcctttacggctttctagcatgcaggtgtctagtgcacagaaccacaccctggatcttagtgagcaagcatgctaacctgcttctcagacttgatacaccagaacagggatttccctgcaagtgtctccctcatgctgaagtgaactagctgaatatgctcttaaagaaagtagtcagaaaagaaaaaaaagattatcttctccaaaatttgagaccaagtagctgtaaaaaacataataaacccagatgaaaaccaggcttcgttttcttgaaatgattttcttcatcagaatggtagatcagagccattggtgtgcagattccaatcctttaaaaagtaaacacatgccttttgataaagcggaattgaggtgatcagaaattctgttgagaacccagctatttgtgtgagtatattttagctatcccaaaaactttttctgacctttctctttctgggataggatatgtgtgcttagagtatcattcagaagggtacctaatagttaatctgttaattagttacatcaggtttcaaatactaggtcagtgatatgagagcgagagagagagatttgaattgtcaaatgtattgtcagatgcattcacaagagcaggactgctttatctgttttgttcactactgtacccctagcatctaaatgaatacctagcccatagaataaacccactggttatttgttgtaagaataaattaatagaatcttaaagttgaaacagagtgattcctaatatattgtaaccacatggttggattcagtagttccattttaggatgtcccttttctcaggagtcatagggcaaattcttattgcccactgtgtctttttaaagtttaaatgttttttaaaattaaacatgtttcttagtaaatattgaaggggtataaaagaacatttatagcagatatgtaaggagtaaataaaatacagcaaatatccacgtacctaccattcactttaagaaaaagttaaaattttcttttataaaaggtttaaaagttttaaaaagttaaaatctttaaaaatcttctccctgctctcctcagaggtaaaagttattctgattgttttttatcgtttgtcattcttttgtttttttcaagtagttttagcagacatatgtatcttcaagcaatacattgtccagttttgtgtttttgaaccttgtgtatatgaaatcaaagtatgtcatattttatgttgcagctttcaccgggttctgtttttgagattcaattatgctttgtcctgccaaaatctatgtttcaactgccatgtatgtggtattctattgtatgaatatgattaatatgttataattaaatgttcttgatgaacatttggattgtattcctgttttatgctattatggaaaatactgcactgttctctgagagaacaagtgcaaacattcttttaggccacttcctgctcattaggatggctatatcaaaaaacagagaacatcaggtgttggtgcagatgtggagaaattggaacccttgtgtagtgcttgtgggaaggtaaaatcatgcattgctgtggaaaacagcatgtaaaaaaacagttcctcaaaaagttaaacacaaaactaccatatgatccagcagttctgtttctgtgcatatacccaaaagaatgaaaagcagagactcgtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgttta

SEQ ID NO: 127680 - DNA, 240 bp, Homo sapiens
actatttaaaaaaaatgattactgaatagatgactttttttttttatacatcagaagatgtacacccttttctgaaaacaaatggaacaaatggaagccaattaaaatgcgatcagcactaactgacaaaaagccccagaaagcattcttataaaagcactctttcaacttgttaacatacaccaccttaaaatactcaactctctaaaacaaatgcagtgtaagatcaatacagctatg

SEQ ID NO: 127681 - DNA, 2617 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127682 - DNA, 448 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccccctttttaactgatatccctagtcatgaactctcgttgtgtaagtgacgacttttcttcttaacactattctgtatcctcctatctggtcacg

SEQ ID NO: 127683 - DNA, 2551 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127684 - DNA, 2243 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtggggaaaatggactttgaaacgttcaatattagaatgtagtttttctgttttcacatctaggttttatatccactgtgtcaaaatgtggactttgaaatacgatgtgaggccaatatgtacctttatttctctcttgatctcttccccctgccaaattaattaatgatctgactgacacgcacatttccaattcaaactggaatgtcatttaagacatttttgtactaatttaacatgtgctttactaaagagtacccaaatatagagttcaaagtaaccagtttttaaattgtgaatacctgattataaaaggcctatagattctgagtttcatagttccctgcatattactattctaccttaagctcacatttacattaatgagactatcacaggtagaaaagagatgttgagtaacaacaaaaaagttattatctaaatgcaaaaaaaccccaaaatgatgtttattatttacaggtacttcagagtaatatagcaagatgctattttcaggattaataaaaaagattcatttttaaatgaagttgatttgcagagcattcaacctaagcctcggtccttgtaagcctaatggagaactattccactaaactctaaataaataaaagcaaa

SEQ ID NO: 127685 - DNA, 1733 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcggggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127686 - DNA, 1952 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaagaacaagtggagaaactaacaacccgtggaagaaaattcctagaatcctgggatcaagtcaaaacacctgatggttttagaggacagaatttttggagagaaaaacacaaccagatgactctctgcacccctttcccaggccatgggcacctgcctgattcctatggtcatgaaggaacatttttctgatgtggccatattcatggtgtcagtgcaatctcatcagagatgaggctccccactcaagctgccatgtgacttgacagctcttcataccgttcgctcaccagagtggtgtccagtttcaggagcacggaagaaaacacttcttgaggttgaagactgtgttttgtccttgaatggccagctctgaacaatgcccgacacatcgctgatactcattgtctgttgagtaaatggaagatgatttgcagttggtgctgtgttttgtgttactgggggaatcttgtcctgagggatctgagtgtgaat

SEQ ID NO: 127687 - DNA, 2347 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127688 - DNA, 2845 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgagcccggagcccgaacccccgtcgccccccgcgcactgagtccccgacgcctccgccccgctgccctgcccgtggagctcttggggagccgcagtgtggggaccggagttcgcaaaagcatccattcttttcagcgggtctttgggggtcaggccgagagggtgaagcttccagatggttgtgggaggtgcgcgttgtccctgtttccatcttcattgcacacaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127689 - DNA, 1900 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127690 - DNA, 1587 bp, Homo sapiens
tccggaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcggggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtcaaaaaaa

SEQ ID NO: 127691 - DNA, 353 bp, Homo sapiens
aataaaaaagcaagtatttagcaaactacataacaacattattccaccaaaaaatggattttcaagaaaaataagaattggaaactaatcctatgaacttcattgaaagacagttcttttatatttaaataatggtggagacagcaacattacagtttcccctttctttttattgattagttttagcattattaaatagcaactaattaaactgaataattaagaaatcagacgtgagataagaactcaaatgttattcatattttaaaaaactgaacatctttgttgaacaagtctggtatttctgacaaaatgggattttatatcctttgagagacttaaggtctctcaag

SEQ ID NO: 127692 - DNA, 354 bp, Homo sapiens
tgtcatttctattgcagactctaatacagacaacagcacactggagtggacagggcggtagagcagagatcgggaagcccatgtttcagcccagattctgccataacctatgcggcaaccttccttgtgctgggcctcagcgtccactctgtacgttgagtggacccactagttgccccccagatccctttcagctctcaaatcttacggggtcaggactgactgcagaatggaagattccctctgactttggtctcctctgcctgtttggggtctggctgcacagacaggagcctgtggaggatgtggctttccacgggtcattcaaccagaggctaacatccatcctttccc

SEQ ID NO: 127693 - DNA, 750 bp, Homo sapiens
attctactaagagacataagcagtagtgtactgaagttagctcccactcgctcccaagagttgattgtgagtgtgtctttacagctctgcattcagtgacatcatgttggcaacttgaaactagtcatagctcgagtatctacaacatggaattcagcaaatgctgtaaatcaactttgtcttttcctctagaaagccagtttacaagcacacctaagtccaaataaaagattatatctatatctatgtgtgtgtgtgtgtgtgtgtgtgtgtgtgtgtatatatatatatatgatgagagttgatatagtataatagatagtgatacctacctaggagaaaattgaaacagggaagaggatgagatgtagggcggcagtttaaattttagatgaggtagtcagggaaggccttgctgagtaagataacagtctaatgatatgagggagcacgctgtatgaagcatttttgggcaggggccttcataagtaagaggactctgagataataacttgtctgctgttcttggaagacagtgagaagcacattaagattggagcagagagggagtagttggagggttaaagaaaaggttagagacattaatggggcacagaggttcattcatgtagggtcttgtaggtcacagtaggatagtaagaaattttctctcttctctgagtgtcttgtgaaactactgcaatgattttcagcagagaaatggcatgctctgtctactgtgtgaaaaac

SEQ ID NO: 127694 - DNA, 482 bp, Homo sapiens
tataagcaaaaatatgaatggccgataatcaaatataaacaactgtacttcattaataagtcagaaaatgaaaatcaaaatcacaagaaaatttcatttcataaaaatttgattgcaaaagttgaaaagtcagagagcatcaggtattggcaaggaggaagaacaacaggaaatcttttccactgctactgacaatataaattgatacaaaaaacttgaggactgatatgacactatcctatgaaattaaaactgtgcatatcccatgaaatggcaattccacttgtaagaaaatgctttcacgtgtgaactatggctagctacttcaacacagatgataatcttgagaatacaataccgaacaaaagaaaaacaagattcagaagaatacatatagtataccatttttataaagttgaatcaggcaaatctaagggtattgtttcagaattcacacatacatgtgtttaaaaatccatgct

SEQ ID NO: 127695 - DNA, 1242 bp, Homo sapiens
cacttcactgactttgtcctttacattgacaagctagataagatgatatcgttttaaataatcatttgcgtttaggtatttctctggcagttttgtattacagtttaaaaatagactagcctatgtctatggctcatgttggctatggtattttgaacttgatttctgaggctgctgacagcttttgaaagatttaacaactggcagcaagaaaaacttccatagaatctcttctctgaaattttttctgctggaaaaaagggcatcacttagcaggcgtaaatgtctcagtcactgactataagtacaaagggcccagaagctggaatctgaagacaaacatggctccactacattttactctcattgccttgggaaacattacttaaaccagaagaatctattgccctctttacttcacagtgctacagagaggattacatgagccaatatttattcaagagaaatgacaaaaagactgagaatctctgaggtccttgggtttccagaggtattcctgcaaggaacagtcaagcagcatcaaaccttcagaccttctgaaacagcctggttcctcccagcactgggtctggttctgccgccctcctttccaacatgtcacgtcagtcatcctcccaacaaattcagtagttggttaagcaagccatatacagtgttagttgactgaaatcaaagctctatagctaataccagaggaaagcaaagttctgattttcataaggttttgaatgctgtgctatggattttggactttattttgaaggcaataaagattgtaataaagatagtagcatgagtgaactggttaagagatttgccaaaatgtctagccattcaacttcgtaagtatatgaaattctccatagaagtataatgttaaataagtggccttcagtaaggcaaaaacaaacaaacaaaaaaatagatagctgctctttctatttctgttactattaaagaaaatgtagctttccaaatgacttaattttactcatgaatgaatgaatattgagttaataacactctccatactttcccttttttatatatatataacttgagataataattgctacttaaagtaggatgtttataaatacatggcagtactgtgtatgctttcttctttgtggtttttatatgcttttatacgttctgtgtatgaatgttgaggagaacttcttttagaattagttagaataaacttgttcattctgaaag

SEQ ID NO: 127696 - DNA, 1034 bp, Homo sapiens
cacttcactgactttgtcctttacattgacaagctagataagatgatatcgttttaaataatcatttgcgtttaggtatttctctggcagttttgtattacagtttaaaaatagactagcctatgtctatggctcatgttggctatggtattttgaacttgatttctgaggctgctgacagcttttgaaagatttaacaactggcagcaagaaaaacttccatagaatctcttctctgaaattttttctgctggaaaaaagggcatcacttagcaggcgtaaatgtctcagtcactgactataagtacaaagggcccagaagctggaatctgaagacaaacatggctccactacattttactctcattgccttgggaaacattacttaaaccagaagaatctattgccctctttacttcacagtgctacagagaggattacatgagccaatatttgtgaagacccagagaggacagttgacctgacaagggacatatagctaggaaatgaagctgcaagtgattctaggcctgattccaatgtccttactctttctatttatccacacatatcagtcaggagattatgatttagacaaatggctgttaagagtggatacaacatcaaaagtgcttaagacttaaagatgttttaatatcatcagggcattctttcttgcagctctcacctctgtgaatgataaacaacttatttcttaattttcttaaaatcccttggtaaaaataatcgactttaaattgatatttgcaaacacatgcatttgaaattttttcaggagttaattttcctatgacacctcatttgctaatgcacaatactgcccctatcagcacagagtattacaaggctttccagtcaaatgggagcaagcagctggagggattaaggctagtatttataccttaattccctgggctgcagtgttaacccagaaatatctcatatgaatatcacttggcttcagggcacagtcataccaggcattctcagttaatttcactatttgataaaga

SEQ ID NO: 127697 - DNA, 237 bp, Homo sapiens
tgagccgagatcgtaccactgcactctcgtctgagcgatagagtgagactctgcctcaaaaacaacaataacaaaaagaaaaacctgtgaggttgtaggttctttcccctttttcctttcctttttttttccccctttttcctttttcctttcctttttctctcactctgtcacccaacctggatgggagtggagtatagtggtgtgatcatggcccactgcagccttaacttcctt

SEQ ID NO: 127698 - DNA, 503 bp, Homo sapiens
tacatttcaagtgcttggggagactactgccacataactgaaaattagaaaccgacactgcagaaaaatacttggtccttaaatgtggcatttggatggattaaggacttgccgaaacgtaaaactgacagacttgggggggggggatgtcccaattagcacggcttctgtatgcaacgagtcccatactttgttaaaggaagaaaggaatgtgagttctcctaatctgttaagtatctttcggtgtaagttctgacaccacaatgttaaaaaagtcggatctcaaaaaccaactgctccaagcgaagtgcacagctgtcttgcctaaagaggcctatttatagtagcctcgggtagtctggtctgggctttctcattgggtacaagtaaaggaacgaaatagccaatgaaaaggtagacttttaagtgtcgtttacattggcatttgtgacgacactctaaaattaatccaatcataaacgaaatctgattaacctcatttg

SEQ ID NO: 127699 - DNA, 714 bp, Homo sapiens
gcaatttgtattttttgtactttttttgtgtttttgtttgtttatttttgagacagagtatcactccatcacccaagctgaagtgcagtggcatgatcttggctcactgcaacctctgcctcctgggttcaagtgattctgatgcctcggcctcctgagtagatgggattgcaggcatgcaccaccatgcccggttaatttttgtatttttagtagagacaggggtttcattcaccatgttggccaggctggtcttgaattcctggcctcaagtgattcgcccacctcagcctcccaaagtgtggggattacaggcatgagccactgtacctggcctctttgtgctttttaatgcacaataaaataatcacatagccattaaaatgtaaaatcttcatttgtgcaattcctaaaatcatttcccgtactattctttgagaaatcataaactaagatgatcataattcagtaaacaatagacaatcttatacaaatgaaaatgttgaggtatatattttcaagtattattcaggaagttcatttggggataataatttaaaaacaaaacaaaacaaaaacttccagggccagatatatatgttcatagtttcctgattaactaaggtttgtacatgcatttgttaaacagatacctcatgagcatatagtgtctgttaaacactacatggctcttgaaacacaaaaatgagcaaa

SEQ ID NO: 127700 - DNA, 536 bp, Homo sapiens
tatgtaagatgtcagtcctacatatagagatttgagattcatgtccctagaggtatcaatcgtactcaatttatgggaatgaatgaatcaagggagtttgaaagagagcactcatctgagcatgtaatctagttgcagacaaaagaagaaaggcaggctaataaagaagacacagaatggaggggcaatgcaagatagtacagaggagttcaagaacatgtgtatggtggaaaggtgccataaaacataccaaatagtgcagagagattgaggaggagagcgatgagaaatggtcaggcagtcagatggtggctgcaataagaatgggcagtttcaatggagtgaaaagggtgagaaccagattattaaaggggtgtgtgagtgtgatggaggatacatctaactaacaagcaactagttataaatgaggataggtgcatatcattgctttcatatataaaggtgaaaaaataaaaggtgtatttatatactaaaggctggataattttctccgtggaataaacaatattccattc

SEQ ID NO: 127701 - DNA, 398 bp, Homo sapiens
gttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggtttagggttccctctcaacccaggatgatttcatctcaagatccttaactaattacatatgcaaagaccctatttccaaataaggttcccttctgaagtttcaggtaggtgtgaatcttccgggacactgtcccacccggtacaggtgggcaggattgttcctcctcat

SEQ ID NO: 127702 - DNA, 584 bp, Homo sapiens
atccctctctttggagcctagtcatctgtcgggcagtccctgtcagggcgacttccacctttgtaccacagagcccctcctgttctcctttctggggccagtgagagatggagaggccagggagttggaagggaaggcaacagaccgtgtcaccataggacgatgtgactttactctctcccacccagcccagccatcagggcagtttctggccctatagggaaggagcagaatggggtcgtggagcccccacactcttaccccggatcctgaaaggagatagtaggttgtgtgagtacctagagaccttctgaagttagcaatagccatgtggtttctggcaggaagtgagaataccagagagctggaggccacacttccatacgggagaaatcctaagtccacctccgtttaagagccctcctccccctgctgtctccctcccctacttcctggacttggtacttccttgctgcctgtggggaggccacaacagctcttctccgagcccttccctcaccctactccacaatgccttctctcccagcctccctcaagccagagcgaaccagcaatggctgctc

SEQ ID NO: 127703 - DNA, 338 bp, Homo sapiens
ggcggagatcagtgcgagggactgggggggacagagccggggtgagcaggtccccagggggtcaaggacgcatagcaccaggtgggactgactcctgcctctggactgggtgaccagctggctgccctcagtcggggctggacagaggaaaggggcacaatgtgtccgggcctcaaatcgaggtgcgccaggccggaccagaccctgcccgatagcccagggctgggtgaccactgaacatttcacccaagccaggactcgaaggccagtgctggggaagcctccacacacacctcacccctccgtggcaattacgcagacgctgggcctcctaggca

SEQ ID NO: 127704 - DNA, 434 bp, Homo sapiens
atcaactgtctctgactggcaggttatactcattgaactgtgtgttctcaacaatgtcctgcaggcctctctgaaaggctggaaccctcccagccctcccaggaagactcagccttggagctcagattggagcgtgtctgaagccctatattctcaatcgttaactgcaccagcgctcagggcccaggcttctttcctgttcgctcttgctcttcggcacctccaataaccctgctctcacaacagggcccaagccccttgagcacgcaaattgagtgtcactgtggttaagagcaggtgtccagaagtcagagaaacctggattcaagtcctgcctcctccacttattagcttttgacattagacaagttatatccagtcattcaacaatgaatttattgagctccttggctgtgtgttccaggcactgaagg

SEQ ID NO: 127705 - DNA, 148 bp, Homo sapiens
acaatagtatgtattcatcatgaacggcttatgtgcttcaagcatagcacctataggtactgaataaatgtgggttatatgtgaacatgatatattattaaacacatgaaatggactggacctgttttctctggtcactgccacacag

SEQ ID NO: 127706 - DNA, 269 bp, Homo sapiens
cccagctactcaggaggctgaggcaggagaatcgcttgaacccagtaggcggaggttgcagtgagccgagatcgcgccactgcactccagcctggccacagagcgagactccgtctcaaaaaaaacaaaaccaaaaacaaacaaaaaacaaagccatgtaaaagaagagcacagcatatcactgagtggaaaggacaggttgaaaataacacacataatctcatttatgaaaaattatgtttgtatgcatgctgaagcatattgggagc

SEQ ID NO: 127707 - DNA, 698 bp, Homo sapiens
gcttaagagttgactaatgaagagaggaataaacagcctcaaagagcaaatgttgttgatatcttaatatattaaactagggctaagaagtggcttaatgcccagaggaaaaaaataccctgtgattctgattattttatttggagcctttaaaaaatagctccaaataatggtttttaaaaatgattaccatacatttctatcctctaaaatcagagggaaaagattatcctgggtttttcatgaattgggattttcctttgaccatctgcccacttccttcagtggtattagagttgtggaccctgtgtctataggtgtattcatctgaagcatttcttttctgttctgcctgtgtcctaaggagtacaggtcggatatattgctgaaattagcaatgagaaaaactcagaattcatttggagaaagtagaaaatggattataagcactggcatcacttaatggtgaatattaatgtgcatacttaaatatgactgatgaagtaggtataactgaagacatcaccgaatgtgtcacagctagacgagcatagagatttggctagaattaaggaaggaataggggaaacattaaagaagaaggtaaagtggatgggaaaggaaagcagatgtaaagcaaagtagatttaaatgccaaaatggcatgtgtaaagatcacaaaagagaattcacagggg

SEQ ID NO: 127708 - DNA, 722 bp, Homo sapiens
gggcagcttgcttaaccatctccatgttaacgtatgttggatgggaggtgggaagagggatttagactggtggtgaagacttatccatattatatcaaatgggtgtgtgtataattcctagtgagagattttctgaggcagtttattgatgtttagagatggattttgaaaagatccttatactttgtcttaatcagttaccccttcccatctaataaacctccttcattatttcattttaaataatactttcatttgagataaatgctgagaattttaacagaaaagttaaaactgaaacccccaaaccagtagcaaaggtttatgagtgtgcccttctaacctgttctggtagtcactgtacattgatccttggctttctttgacagatactttgctgattatagatggagctctagctctttttgaaagggttctcagagaaattggtttggttctaaagtgtttcttgagttctttgtacctaagaaagcctttcattctgcatagcgtttatcaccatccaacatatatatttctttaccctgtttattgactgtcttacctcatgggaatgtaagatctgtgaggacagacctgtgttgccactgctagaacagttcttgatatgttataagtaagcataccaatatttgttgaatgaatgagagtactgaagcaagaagtgaattttttaagtattagaatttaccttttaaata

SEQ ID NO: 127709 - DNA, 776 bp, Homo sapiens
ggaaaaagatcaactggatgtccttgggattatttctgctaatgcgaaacaattttgaatgaaatcagtacgttttctttcattaagtaccaaaatccaaagagtgtggtagcagaaggctagcacaggatctgtgctcaataaatcaatactgaaatctagctctgagcaggaagaacatcaggaactcatctgcagataatggaagaacatagtttgtttgtcttagctatgttccattctcccgtgcagataaatacttgatgttctcaattattgattatgtttcctgaaggagttaattgcagagcaaaatattggaagtgagcaatctattgtgttcccttgaaccttagttttcccaagaggaaagagtgtttgtctttagagtagtgactgagatggcttaaagacagtgcaggctagaggtgggtaggcacataaacaacaaaaaagcactcactcccctctccccctggagcaggaggaggctgagaagacctgaataaaagaacactgtcctttgtcaagttctagatagtagattctaacgacttgcattttctggaacaactcgaattgtttgctcactcatccagcatgaaactgtcaatatacacaaatagatttacttttagaaatgtgcttgcatttaaatagaaagccattatgtccttgcatgtctcattgaaagcgttctctatgataaattggatttatttctatctcttcagaatcctggagtttgtcagctctggtatctaaaattaaaatgg

SEQ ID NO: 127710 - DNA, 241 bp, Homo sapiens
gcaagcctcctggaagatgagatgcctcccagagaaaggctttgactctgcctgaggagtctcagaccatgactcctctgtagagaacatggccagattggaacctggttccccaggggaacaaggctttgatggttctggcagtcatgctgagggaggggtgtacttgaataaaaagattccttgaaggacaactaggcttcccccacccctctctttttccaacctcctccaccctggc

SEQ ID NO: 127711 - DNA, 309 bp, Homo sapiens
cttataaattttacctttttgtctttcaagagaacttgagaataaacttgtccatctccacaaaaataattccactgggaattttatttggattgcattgaatgtatttgagtagagttgcttttgtgaaagtactgaggtttcaaaacatattaagtggtacagttttaattagactgattttattgcataaaaattaatctttaaaaaactgttaaaattgaggtaccctttccagagtcattatatatgttcatttcttgtagtatcttttataccttttattaaatttttaaaggtttcttcctt

SEQ ID NO: 127712 - DNA, 452 bp, Homo sapiens
ggagcctcttgatctttacgaggaggccaacccttatgggagttacttcaatctctacagggtgagtggtggggaggaaggggaaaaccagagtggaagctctaggtccaggttctaattgtattgcagtgtgaaattcacttgttaatccaacaaacattggtgtttactatgttctgagcactgtgctagagattagggggaaaacatgaagttaaactgggtatgctgtagctggtggggtgaggaggccctgactcatccttcctattgcagggctccagctccctggcaactggggggtcttgtgagtctcatatgcccagagggaagtttggatgaattcttagagaaaaccagagagagactggttgactgttttccctccttttccccctcctcctctttcttcttttttttttttttccctaaatgaacaacagacaccaggg

SEQ ID NO: 127713 - DNA, 416 bp, Homo sapiens
tacattagactatgagtgacaattcataggcgacagagcgagactccatctcaaaaaaaaagtgatataatttgcaccaccttgtggtaacaggaacacatgacattttactagacctttttattttatataaaatgactagaataaaaatataaaaatgcctatagaaagtaaaaaattatagtcaatattattcactaatgtgaacaaactcactttattttccaataaatgataaaatacttacttattttctagtagatgggaaaataacagaaaatcatggtataagactgtggttctagccaggcacagtggctcacgcctataatcccagcactttgggaggccaaggcaggcagatcacctgaggtcaggagttggagatcaacctgaccaacacagaggaaccccat

SEQ ID NO: 127714 - DNA, 401 bp, Homo sapiens
ttttttttttataacaatgcctgctggaatgattggctcacaatcagtgcataataaatattattagcccaataatgtactgagtcaggggctgcaaagcagtatttcatcacgcaatgacccaaggttcacaagaaatctaattagtgcttcaactaaagccaccagtcaagtctgggggaaactggctccaaatcacaatgctgctttagtttcctcagtagctgctgatattatcctattaatgggggaactttatggaagaattattaaataggcttggtctggttgctaggctgtctgcgtgactataacagggattctcagaagccatgttaagcatgttcaaatactcctaaaatggctgctggtgatagagaaagtagaattctccaaagtta

SEQ ID NO: 127715 - DNA, 853 bp, Homo sapiens
tgtgattacaggcattagccactgtgcccagacagaaatacatgtccttaaatcttaacatgataaagaacatccttggctgggtacagtggatcatgcctgtaatcccatcactttgggaggccggggtgggaggattgcttgagcctgggagttcgagagcagtctgggcaacatagcgagaccctcgtctatataaaaaaaaaaaaaaaaaaaaaaaaaaaaaatttttgggcggcctcgggcccgggaaaggtttttaaacccatttggtgggggcgggggccccggggttagggaccggggccaagggggtcccaaaaggagaaccccgggggcaaacgagataaaggtgcgctgggttcctctccccaaataaaaaaaccgggccggggggacacccggacgtggtccctggacccaacacccagagaggcagtgtccgggagcggccatacccggggctctcatccacacgggggtcccaaggcagcggcccggatatcaaattacgtcgcgcgcgctcgggagcaggccaaagcaagcacagcagaacaacgcaccacaaacgacgcagacacagaagggagggagagagcggtgggaaagaggaggggggggagagagacacgagggcagagcagaaaccggggcagggacgcgaggaggccagagaagcagacgagagagagagaggacggagagagaggggcgaggaggaagagaggaggaggaggggaagaagggaagagaaggagaggggggaggtgggggcgagaggcgggggcggaggagaggagaaggcagagagcggcggagagagggaaggagcaggagaagagaaaggggaaga

SEQ ID NO: 127716 - DNA, 269 bp, Homo sapiens
ggctgaggcaggagaatcgcttaaacccgggaggcaaagattgcagtgagccaagatcatgccattgtactccagcctgggtgacagaacgagactctatctcaaagaaaaaaaaaaaaaaggaaaaagaaaaaagaaaagaaacacagggagaaatgaacttgtacaagtggtgccatgcgtcttgtgggaggagttggtggagttaaagatgcctctgggaaatgatctttgtagatataatttgccccattggaaatgcaggcttc

SEQ ID NO: 127717 - DNA, 385 bp, Homo sapiens
gaagaaaagtaaatgggtcagtcttgacatttacaaagcagcatgcccccatccaaagcacagctgaagtatcactctaacctacatctaggaacataggatttttactgaacaactaaagaacacatgtggataagataaataacattggtatctataagctggccaaaacttggctagaattccagattacagaaaaagggccttggattcagtcttagagattctctttggaagtttttcaaatgcttgacttatcaagagctgagaaacttgccaagcatctcccaggtactccatattctagccacacgcaattgagcgtccagagagaaaacaggcccaggttagccagtatgcatgttcttacctctactgtacattc

SEQ ID NO: 127718 - DNA, 567 bp, Homo sapiens
cactgtactacgcctttcagatgtacacctcactcattcccagtttgcaacagctttgtatgggaggttctgtaacatccccactttataggtgagaacactgagtctcagggaggtgaaatattttacacaagattgctcaactagtgacaggtgaagcagagattcaaattccagaagtctgatttcaaagttgtctctcttaaccactgtgttgtatctcaaatcatgacagttctaacttcatgtgtcatggtacttggcataaggacgtttttctccccattcttccccaaattcagtgcaaaaaatatatatgctgagtttttcatgggccaggtctactctattcttagagaaagggtcgggtgcggtggctcatgcctgttatcctagcactttgggaagctgaggcaggtggaccacgaggtcaagagattgagaccatcctggccaacatggtgaaaccccatctctactaaaaatataaaaatttactgggtgtggtggcatgcaactgtagtcccagctactcgggaggctgaagcaggagaatggcttgaatcc

SEQ ID NO: 127719 - DNA, 458 bp, Homo sapiens
ctgtcttccttctgcagtgccctggcattaagtccggccctctggtcactcctctgagctcccaggtgctgaaggctatgtgtccccatctaggaccgtgctaaacgcctatcggctttgccaggccttcttgattaatttgctgctggtgaaacgctacttttctttgtcttcaggtcaccctgactttgcatatttcttctcctaaactagagtataagttccaagggagttgatgcagtcttcacagctttctgttcccttgacaaagcaagtggacgtggtcctgcgtgctggagcgagtggctcagtgaataacaggccctgtgtgagcaggccatacttgctcacgctggaaacccagctccttcccaccagccctgccccatcctgctttgccaaaggagccaacagccccttaatcacctgaccacaggatgtgagccagaggggagcga

SEQ ID NO: 127720 - DNA, 232 bp, Homo sapiens
ccccacagcagctcagtcatgcacagctcaattacagctccccctgggctggctgatttggtggggatggttcacatggcaacaagtggcctatgccatgttgcctggcctctgaaaaacgtaacttatcatttgtattttcacacaggcactgaaaaggggtcagctattcttttttttttttttttttttttttttttttttttttttttttttttcttttttttttttt

SEQ ID NO: 127721 - DNA, 497 bp, Homo sapiens
ctcccagagtgctgggattacaggtgtgagccgccgtgcccagccaagtttttaattttgatgacgtccactttttctagtttttcttttgttgcctgtgcttttgttcatattcaatagatcattgccaaatccagtgtcataaagcctctatgttttcttctgagagttttatagttttagttcttatgtttaggtttttgatccattttgaattaatttttgtattaatttttggtaagggtccaactttattcttttgcatgtggctgtccagttttcccaggactataccctggttgacaaaattgtgctttccctgttgaatgatcttggtacccttgttgaaaatcaattgatcatatatgcgagggtttatatcttgactctgtgttctattccattgatttatatgtccgtttttattaggcattatctttatgtatctttaccccactgttctcattgctgtagctgtgtacagtagtaagttttga

SEQ ID NO: 127722 - DNA, 345 bp, Homo sapiens
cacatggggatctgcagcagcctctcaatgccaagggcaccctgagtttggttatgggagtcgggagttgagccaagaggaagggctggcgtcaaggcagggcgggcatcaggcagggttcccaacaggcccatcaagcccaaccacctcctgagcccaatgcctcacctcctaccctgctgggctctggactggctgccaaagccccaccagccccgctcagtgctagaggctgaacagccaggagaggatgcggaggatgtagctgcgtggaggcgccaatcacattgaactcttgatggggaaagccgggaattccaggtgtaggtgcagccgtgccaacct

SEQ ID NO: 127723 - DNA, 274 bp, Homo sapiens
aataaactagattctaaagcactctaaggtattcctttgaaagctgtcatcttaaagtaggaatgcaaacaaaattgtccaggtacccattgtaagatgacatcagtgggctacctgtttcctggcaattttattttgtggcataaataacctttatttccttgaaaggtcttaaaagttatagaaaacatgtcaaagcagccaaagtttactttcaatttcaacaccctagaatgactataaagataaaaaactgcaacaatttatagattct

SEQ ID NO: 127724 - DNA, 467 bp, Homo sapiens
atgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaa

SEQ ID NO: 127725 - DNA, 256 bp, Homo sapiens
cctgtaagatactgcacaatctggcttctgttcatcttatcctcccctacactccaggccctttagttccttgatggcaccttatttcctcccaccacagggaacctacacatgctctctgcttttaaactgtgtccacttccttgcctagttaattccttgcttgggaaagcctttcctgacccccagaccaggtcaaactctacatgatctcttggacacaattgcagtttgtattgttacatactctaaaatc

SEQ ID NO: 127726 - DNA, 651 bp, Homo sapiens
gggtagaagggtagctctgcttcctttccctctttgttgttgttgttgaggaatcttgaaactgctctccgcagtgtgagacctagtttgcattaccccaagagtgtagctgttttcgcttttatgtactgctacacaaatatgttttgtgtttggacaaatggccattctgactggtgtgtgatggcactggtacctcatctctgatgattagtgatgttgagcattttctcgtgtctgttggtcttttttaggtcttgttttgactagtgtgtttgtatcatttgcccattttttacttgtgttatttttctgcttcttgatttaggtaaggtcctctagattctggctgttagaacttggtcagatgcttggtttgggaacattttctcccatcatgtagtctatgtgtttactgtgttggcaattgctttgctgtgcagcaggtccgtagtttcttaggccagacttgtactttttgttttttcttgcatttcttttgggtactaaattgtcttaagtggtttgcaaaagcctatgttgagaaaggtgtttaataggttgtctgttaggacttttatatttgaagtcttctatttcagtctttggttcatcttgagttaattttccatatgatgacaagcagggctg

SEQ ID NO: 127727 - DNA, 382 bp, Homo sapiens
ttctctagacgatcggtttgactacgggggaagaatccacacaacattaaagagaccatggtgagtatgttctgagaactgaattccattgcctcgggggcctgtccgctgctgccaatttgcttctcatggcagaaccctgtgtgtcagaaccctgactaggctctgccgatggttgtttggaaaagagtccagctggagatgaaaggagttcttcaaagcaatgactccttggaggctatcactttagaattgggaatgattacttatcaaaaaacgacttcactctggaatatactacgggcaagaagctggcctgacctctcgggtattctgttagagtcggcctgagccggagaggccagatgaatttggagtgatg

SEQ ID NO: 127728 - DNA, 396 bp, Homo sapiens
aatctacctggccttccaatccctgtcgcatctctctgccttgagatgtatggcaatgctattttgctagtctgttcttcattctctattacgtgcagagttgaggactgggttgctttcttccttcaaatctctacctaggccttaggaccaagttgttcagggtacgagagaataagctgaccccacagggctgtcaggtgccacaaaagtcttctaacagtccttctcctccctggagtgagctcacccttgttcaccacacaggccttttacacagcacaattacaacattgagctcgacacagagacaggcactgccctgcacttaacctcctgcttattcaaatcctcactctcgttcctatcaaatgagaatgaacatttgggctttcc

SEQ ID NO: 127729 - DNA, 463 bp, Homo sapiens
ggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcaggggaagaggctgacattgtccttggacaggtacattcttgtggatattgatgat

SEQ ID NO: 127730 - DNA, 100 bp, Homo sapiens
cggcctcagcctccaagtagcggagatgacaggcatgtgccactgtgtccagcttaacccagttttgaggccctggctagcgaccagccagttcgtcttc

SEQ ID NO: 127731 - DNA, 263 bp, Homo sapiens
aatgttcaggaacattaagtccagggcaagaaggcagaaggaaactaagagagcacacattttcataaagaaacagcagcagccccaagaaagggctacaccccagtggtcctctgcagccctcacaaactctatcccatgtctatcccacaaggaatgacacctccaatctgttcagaaaaggcaggacaatttcaaagctaaataagtagagagtgtgcctaggggggccacagcaccttgaaggaagtctggaaagtacc

SEQ ID NO: 127732 - DNA, 488 bp, Homo sapiens
agtgcacggggaagactggggcaggagataccaagagtggaagcaggtaggagccagagtctgtgggagaccctgagagtctgagttgtaaggacctgtgggaaagaggatgagtcaaatcgacgggacttggtgattcaagtgggggtggagtgagaggagaagttgaagtgatccctaggcttttttttctggcttgggccacggggtgaaaggaaggtagtctcattcattagggaacacaggaggaagagctagtttgagaccaacgaggacatcagggttaatcttgaatttgatgtgcctagggagcatggaggtgaaggtgtccaacagcagggactcatactaccattgggaattggtgtcagtcaggggctaacagagggctctggagttctattgctagtttctcctgctttctatctatgtggacttgggcaagtcacttagcttcctgaagcatctatctcctcatctgtaaaata

SEQ ID NO: 127733 - DNA, 449 bp, Homo sapiens
gactctttgtcagctatctttatggacttactatgaaatatgttaagttgcatattattggcttatcattttttcacaagtcccacatagagaggctgaaaacatatattaacaagaacaaagaagaaaggagaaaaatggtagtaagggtattcagtagaatttgagagttgattcaaactagtgactagaggcattctttctgagaaaaataactagcctaagagaggaaagaggaagcttgaaatactaatagtcaggtgcattacttttaaataacaacagattggcaaggatcgccagatatttgaggaaaaacctttatgtgaaagataaaagggagaatatggaagaaaaacaaggcatgaagcagaaggaaactaatttccttctttattgggagagagctttcttgccttcaacatctagctgagttttgtcccactgag

SEQ ID NO: 127734 - DNA, 266 bp, Homo sapiens
gacttacgtactaaaagcaacacatcctacaggtattgtctttcacataaccttagtttctttgcagcacttaccaatactagaaattattttacttatttaagttcccctcttacttgaacatcagctctattgaacacagattcaatcactatagccctaaatgctaaaacaggacctcacagacagttttcatttttattccgtcaaatacatctcttttccttcatgacttaagactagtgcttagcacagaataaatgcta

SEQ ID NO: 127735 - DNA, 471 bp, Homo sapiens
gatctctgggctactgtgtggggaatgggttggggtgggcaagggtagaaggagggtaacctgttaggaggccattgcaaaagtccagatgagagatgatgtgattcacaccagcagtggaagtgatgggagatggatagagtctagctggagtctggaaataacctcactcgtctccagaattgacctaatccaattcagacagtgtggtttctgttctatttttagtggtctcatatcattgcttattaaattaaggtctataaattctacttgacttttctaaattactcttccatgtcttaagtccatgagaaaatgatagttctttacctcagaggccagtggccatagtaccaggcactgtacatgaaatcataggggaagaggtgatccccgattccagtttaatcaggaagacagtgttggcagacattggcagagacagacataaagtcaacaagttcaaaa

SEQ ID NO: 127736 - DNA, 602 bp, Homo sapiens
actttcaggaattcagggattcaaaacttacctccccataagaagtaccagggaatactccaatgaaatgaaaaataaatcttaaaagtagatctgaaatctaagaaataatattgaccaaaaccatgtagtggagcagaaataagtgcaattagcggtgatggtaaaataagaatggaagtaaaatactagatggtttctgcaagtgagacaagaatccaacttaaaaatttatttttatagagacagaatatcactatattgcccaggttggtttcgaactcctagcctcaaacaatcctctcacttttctcccaaagtgctgggattacaggtgtgagccactatgcccagtcaaataaatggctttttctttttctttttctttttttgagacggagtttttctcttgttgcccagactggagtgcaatggtgcgatcttggctcactgcgacctccacctcctgggttcaagtgattctcctacttcagcctcctgtagttccagctacttgggagggtaatatgggaggatcactcgtgccaggagacggaggttgcagtgagccgagattgtgccactgcagtccagcctaggca

SEQ ID NO: 127737 - DNA, 571 bp, Homo sapiens
actttcaggaattcagggattcaaaacttacctccccataagaagtaccagggaatactccaatgaaatgaaaaataaatcttaaaagtagatctgaaatctaagaaataatattgaccaaaaccatgtagtggagcagaaataagtgcaattagcggtgatggtaaaataagaatggaagtaaaatactagatggtttctgcaagtgagacaagaatccaacttaaaaatttatttttatagagacagaatatcactatattgcccaggttggtttcgaactcctagcctcaaacaatcctctcacttttctcccaaagtgctgggattacaggtgtgagccactatgcccagtcaaataaatggctttttctttttctttttctttttttgagacggagtttttctcttgttgcccagactggagtgcaatggtgcgatcttggctcactgcgacctccacctcctgggttcaagtgattctcctacttcagcctcctgagtagatgggattacaggcatgcgcccacacgcccagctaattttgttatttttagtagagatgagattt

SEQ ID NO: 127738 - DNA, 635 bp, Homo sapiens
catccctgtcttattcctgatatttggaagaaaccttcttgttttttagcctagcgtattctgttagctgtggtttttcagaaatgctttttattgtgttgcagcagttctattctagtcctaccatgttaaatgtttgtttttatcatgaaaggatatttttgtcaaatgctttttctgcatcagttgagatgatcgtgtgacttgttttcttcattttattattgtgatatattacactgatttattttcttatggtgagccaccttgcattcctggaaataaattgtacttggtcatggtatatagtactttttatttgttgcaagatttggtttgcgagtattttgttgaaaacttctgcacacatattcagaagggatacatatcatagtttttgggtgatttttttatctggctttggttcaaggtaactcatagaatgagttaggaaatgttcactcatcttctatttttggaagaattagagaaggattggtgttagtttttctttaaatgtttggtagaattcaccaaacatttaaagacagactgacagttggtcttgagcctttctttgttgggaggatttggattactgattcagtcttatatcagtctgttcggatgttctg

SEQ ID NO: 127739 - DNA, 677 bp, Homo sapiens
attatgagaaggagggaccacacgcatggctcctggctgtttgtgtctcagtctgaagtcattctaacaacaccacccagcgggctgcccctccccactgaggagaccccaccccaccccacgcccaaggctgtagtctggagcagcaagagccaaagaggtcctgtgagagcagggggtgcctcttgagaaccccagcaggagtcccaggagagccgcccacccctggatgcggtgcccgagtgtctgtcctacagtagtagctggcaatgcagcagcgagcaccactgcgcctctgtgccatcctactggcctgtcagctcctcgtccacctctgccctcatacctggctccccacggtggagccagagtgggccttttaaaacagaagtcagggctgggtacggtggctcacgcctgtgatcccaacactttgggaggctgaggtcggtggatcacttgaggtcaggagtttgagaccagcctggacaacatggcaaaccctgtctctactaaaaatacaaaaattagtcggttgtgatgattcgcatctgtaattccagctactcaggaggctgaggcaggaggatcgcttgaaccgggaaggtggaggctgcagtgagccaagattgcgccactgcactccagcctggggccacagagcaagactccatctc

SEQ ID NO: 127740 - DNA, 281 bp, Homo sapiens
aaagatgcttctgccaggacccaagcagacagcaatgtgtgcagctgtctagtcacaatcctacatttctcaacttttcagaccaggtacagctgtggcttccaaccaaagtaaccagaaatgagggaaagataatggaatcagtgttctgctgcagacacattaagtgtatattactcagcttttatctgggggttcatattcctattaaaaagaatatccaagctaagttgttaaaggctttaaaggtgctgacagttcaaagctgtgcagggctggaa

SEQ ID NO: 127741 - DNA, 196 bp, Homo sapiens
gcccacctgctctgaccacctctcccttgtagccctgcaccacctcccagcgtgagagaccctcgtcaaaggtccggctcaaatgctgctccctgtgtggcacagctctgaggatacaggccctcccctctccactgggtgggcagcaagggcaccagtccaggccctgtcccttggccagatcctctgccggagg

SEQ ID NO: 127742 - DNA, 371 bp, Homo sapiens
gcaaataaccctgttccaggtctgcagacctcaggtcaggggccaactcctccctttaacttttcacagaaggcgtaataggaaaactcgctgttatttgaaaagtccattgtgagaaatgtcagagtgcagcttataagcataccctggggagcacagctgagagcaattttgaaaaccaagcagttagaaactgatgaagtagaatgcacaggtagaagacagcttggcactgcttcagcatatggggctgcttgcttcaggccagatgccacagactgacccagcaggatgcagattactcaactttctgagatggaagctggctcttcagcttttctctacaaggctgcttcatttattctgattaa

SEQ ID NO: 127743 - DNA, 755 bp, Homo sapiens
atttttagctagaattctatttaaaaaaactccttctactacaatttcttccaaaaaaggcagaataaatgattaattccttcctttaacctctacttttccgaatagacttcagaataagaagctgatgttatacttacttaccacctagttactcctaacctggactttgctgcaatacaggaaaaatagatgaatacagcaggagatgttacaaactttctacaatcagaaaaaataaagctacaaggttttctttttattagagtatttgtagtatgtaaaaaacatgtatattaatgtaatttcaagttaaaagaggtaaacttcttctaaagtttcagaaaggcatttacctttataaagatatttgtcgaatatcaactgtaagatggaagacgggttgaaagtcattaagttgaaatcgatttcttcataacttggaagatatttgaataggctgtttagtctctcctgaatccacgggtgtaagtgatgtgtgaaagccaaacccttttcagacaacagctaaacaaatactcagttaagttcttggatttaaaagacggttgtgtttggaaatcattattttccacaagggaaagaagacatgttacaggaagcaactggaaccagttttacccctttgtttcaaagcctccagttcttcatctctgagcctagaatttcatcttggttcctttttttttaggaagagcaacttttagctggctggcagtttttaattcaccttg

SEQ ID NO: 127744 - DNA, 706 bp, Homo sapiens
atcgttattgttgttaattttagtacttaatattatagcacttaattatcccaaggcaatctcagtgattttttacaaaatgtattttcatttatttgataggtcatcaaagtgactataaataatacgcctttttctttttttaattctgaagagaactgctctagcctctgaaatgttatagagtaagacgtttcagaggattcttttctcaaccattaatttcttaatagctcatatagagctgtgcttgctgtctttcctgagagttcctattccaacagtaagaggtcatggcagattttgaataatgattttttggggggaggctcttaaaattatctttcctttgtcctcctcatctctttatggggttagcaaacttttttcttaagagccagaaagtaaatattttaggttagcaggccatgtagtctattaccactactctactatgttgctttattgagaaaccagccatagatgaaatgcaagtgaatggttatgactgtgttccagtataactgtttacaaaaataggcatggtttgccgatcataagtaaaacagcatcaaaaggaaaatattttatcacaacatactctattattttgtattaggaagaacaagagaagaaagacctaagctgaatatctccccaaaaaatttcttgtagaaaatacagatgagcgaaaatagaatcttaa

SEQ ID NO: 127745 - DNA, 737 bp, Homo sapiens
aacccaagccagaaaaccaggagtcatcctagaatctcccatctccttgagccccacatacactgacacagagacctttcagccccacccccttaacttgttaaatctctctcattgtctctctttccactactactgtcttcaatcagatccacattacttattttatggactaaagcaacttcttgctaactgatgaacctgctttccctcttgccccattccagtacagaattccaaaattctgtttgatagattttgaaaagttttcttaatccatgaaaaattctgtttgattgattttttaaaaaaatcacaacctgatcatgtcatatccttgcttaaaattattcattatgatgaatgtggttcacatagtcttcaggatgaggttcactccttttaatttggtacacagggcctgtctttattatgaaatgtgctatctctttggcttttttttttttgacaatttactacccatgtgcaatgcctgttccacagtcattatgaactttgtgcatttccctgtacctaatcctcttcatacgaaacctccttttctgtgaattatttttccctcactttgtcaccttctgaattcctatttaactttcaagtacttggctcacattgtctcctcttccagagttgcctgatcaatctactcagttggaattatatcttcctcctcttctttaattatgggcaatcttctgggaggccatattgtttgt

SEQ ID NO: 127746 - DNA, 399 bp, Homo sapiens
tgggtagggggatatggaaataactttcactaggaatttcaatttctacaacaccttttaagaacttttactgacagcatatgggaagttaaggatcacctaaaattccagaagacaatgagaacaattaaaggtatataaatgaaagacagcatagtgccctgcagctcttatgggacttcttcctttttaaagagctttcccatgcattagaaccttgtaaaacttctgaataagaagtcagagcagagaaagcttacaaaaggcacacccggagcgcttaagaaagacatcctgtggggcgcggtggctcacatctgtaatccctgcactttaggaggctgagggtggtggatcacttgaggccaggagttcaagaccagcccggccaacatggta

SEQ ID NO: 127747 - DNA, 392 bp, Homo sapiens
acctttccgcttttcctctaccaacacctgctcccctggttgtcttgtcactttattagcacaaaatgaacattttcatctctgagcctttgcttatttctctcattccagattcaaactggaatgtccttcttggcatggatcacccatacccatctgactgacagatgtcttcttttcctaagaaaaatgaatccatacttactctctgctgcattaccacatactgtctgtacctgttcttcctctctcatcgatttcttcattcagcatatgtttattgcttttccatgtgccactttagaaactaggattattgggtaggatagaaccactgcactggaagtgttcatgcttaccacctctttgtcacttgtctttatatttcattg

SEQ ID NO: 127748 - DNA, 487 bp, Homo sapiens
gtgtaaaactgcttcacaaactgcgaagtgcagtgcaaatgcaagttaagtttggttgttcaacaaaacttttagaggccacctctctgtgccagaccctgggctgagcactaagactggttattaagtgatgatgtcagaatctgaactcaggtccgttttactccaagcttgagctcttagtcattacataaattaccttcagtcttccaataccttcactcttcattcccttagtgactcattcattcaacaaaatgtatgttgggcctattacatgcaaaccttgtgccaaacagaagaacaggacacagtccctgctttcaaggaactcacagtggagacagcgaaatagacggcttaagcatgtaggtgctgagagggaagactgaaaggtaggaggggtcaggtctttttgtggatgtgggttggaggctgtcagagaaggtttcctaagggatgtgatggccgctgctgctgaggaata

SEQ ID NO: 127749 - DNA, 505 bp, Homo sapiens
cactgaacatggcagctactagcattcgtgagacatcagggctctgcaaatggctctctgcgcaaagcatgctcacagggcagaggtggccctgtgtgggtggaggacatgccagaagcatgggctctacacccagagccttctttccaccctagtccctgctcccaaaatgcaattgagaactgcatttaattagttacaagaaactgtttgttttcttccatgccagtcaatactatgacggctttaaatcaactgcatctaatcctataaatacatctccgggatggagcctcctcaagatgtcccatcagttttgttcatttacttctattcctgagattcagttctatgtcctctactcttcaatgagacatgagtccatcaacaaaatagcactgggaaaggaattctagtttctgacattgagacctggcttccagtttaagctcctccacttccaagctgtgcaaccctgggccaaccacttaacctctctgagctg

SEQ ID NO: 127750 - DNA, 426 bp, Homo sapiens
ctgttcaagtcatgtcctttctcaaaaatcttccacggttccctactgatgccagattaaatgccaaaccccatagcctcgtactcagggcctctcaaggccgcaccccaacctgattggagtcactaaactcctcaccctaccttgaccttgacaagtgtttttattgcctctccagccctataaaggaagctcggaggagaataaaaacaaaacattttgtaaacatggatgtgtttcccaaaagttaacattaaaattccaactctctccttctccttggagtcttccttggtgtttaggtggagatggtcacttccattcggtgtctttcctctccccagggagcactgagtgcacctatggagttttgctgtgcttccctctgcagcactgagaaaggcgctggcatgtggtaaatgctca

SEQ ID NO: 127751 - DNA, 581 bp, Homo sapiens
ggctaaagacaaatcacttggagataacaataaaaaaacagaacaattatctaattcaagattagactggcatgtaaggaagaatggctctagaagtagtgtttttccctataatatttacgaggatagcttttagtgcaaatttaggacatttgctcatggactgtccatgagtcagaatggctactggacttcttgttaagcacaaaagataaggactggctctagaccagacacttttgtcacctttagtttgtttttggggccagtacctcgaacactgtagatatttaacaatttcctatatagttctctcttctataacactgcaataattcttgagactatagttgtacttcctcaaaatctattgacttttatgggtcaaaacttgaagagcgaaaggttcctagaaaattggtaaagacaatagtcaggctgggcgcagtggttcatgctttattcctagcactttgggaggctgaggagggcagatcatcagtggtcgggagtttgagaccagcctggccaacatggtgaaaccctgtctctattaaaaatacaaaaattagccgggcatg

SEQ ID NO: 127752 - DNA, 494 bp, Homo sapiens
cgacctttgtgagccctctcctgctcctagaggtggggtttctccatgttgcccaggctggtctcgaactcctgggctcaagtcagccagcaatctcggcctcccaaagtgctgggattacaggcatgagccactgtgcccagcctgaattttcattgaaactaatcttcaagcttgatggaacctttatctactgttgacataccacctgtatttctaatgaagacatctatctcgtcttttcagaagtctccatttgtgtatatgattcaatatattggcctttcctttaaaaatatcagagaacaacaggttaaaactaagcacagctctagtttgtggggcattaacaagagaacagatttcaaattaccaagttttctcttccttttgttccactctgttgtcaggttatcatgcagcttggaattgaccaagtggctcagtttaggatcgttgatagtactgtgataagactttctcttttagcaatc

SEQ ID NO: 127753 - DNA, 459 bp, Homo sapiens
catgtgttggtttgcgcagtttctgttctgaggtatgtcagtgaggatactcagtggtgttgtcaggacaaggttaggacactgtatttaaaagttgaataatttcctaaatatcttttaatctctccttgatccatattaagctcactaatattttcagtctatatcaatctcttgagtactaggttccataaggttactgcttcattcactttctacatttttgtgtatcctgaagttactttagctacatttctagagaagccctcatgctctaccattctcagatttaataaattggctgatagaaacaagatccccccaaaaatctcaacagactggaatgataaaaaggattaagaataaattaggaattttgaactgaggttcagtaatcagccagttaactatggaatgatggtaaaaaaaagatggatgctgccacttaatggtcaacca

SEQ ID NO: 127754 - DNA, 349 bp, Homo sapiens
ctgcaaactcccagctccgccacgaggaaacagcgttgggttgctttctagtacctgtttccccacttagagaacctcaaaacgtgttcaaagaaccagacacaaaaggccatatagggccgggcgtggtggctcacgcctgtaatcccagcactttgggaggccaaggccggtggatcacttgagaaaagaatttcgagatcagcctggaccacatagggagacccccccacaccatctctactacggaggcgcgcgccggtaatcccagctacttgggaggctgaggcaggagaatctcttgaacttgggacgtggaggttgcagtaagccaagatcgcggcactgc

SEQ ID NO: 127755 - DNA, 449 bp, Homo sapiens
gcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggtaagcgaggcct

SEQ ID NO: 127756 - DNA, 544 bp, Homo sapiens
cttcggcgcttcatggctcactatctggttttcttatttcagacttggcaccaacaatgtcttgtgatgtttttgccaaagtaaatgagtgttataactactttgtgaaggtttggttttattctcattccatttgtggtggaatgaaattcttaaaaattttaaattagacagacacagtgatgtgcacctatagtcccagctactcaggaggctaaggtgggaggatttcttgagcccaggagtttgagttcagcctgggcaacatagtgagacccctatctctcaaaaaaattaaaaattaaatcaatacaattccaaattatgtgttacacattttggcctgcttcacagactaatagttctaagaatcacattgattgagtgagtgagtgattgacagtgtctccttctgttgcccaggctggagtgcagtggcgcattcacagcttacctcagccttgatctgccaggcaccatcatgcatggctaattctttgtttttttgtagagtcggggtctttacagtgatttatttattttt

SEQ ID NO: 127757 - DNA, 673 bp, Homo sapiens
tagaaggagctcaggaaatatttactgaatgaatgaatctacagataaccttctctttatgtttctggagtcagtatgtcaataactacgtgctgaggctgtaagggctgacaaatctctgccctcaaggtgcttattatgtctattggagaaaatccacaggagtgcaatttatgataatattttaattggttattatatgcttttctagacaatgagtgccttgagggcagacactttgtcttatctttgtgtgtttttgtgtgcttagcccaatatcgacatatagtaattgttacttatttagtgttaagtgaagtagaaaattttaatagccttcatataccaaattcaagttagtgtttatgttatacatttatcttttacaatgaactctctccccatggttcttggtcttagagaactcattggtttattttggacgttagtaatgagggaaaccttttacagaaactttgttttttgactttttgatttgagttataggccaaggtaaaattttcatcacatctgtgtttattgcacttctgatataatccagtggtgatgtacaggtgaagtagtgtgactgtattttttaaacattatgagcaccttcatgtgttgtcttgtgtacctgttgggctgctaattcattctgctctggtaagtc

SEQ ID NO: 127758 - DNA, 371 bp, Homo sapiens
gaacttgcaagcttcccaataaagttttctctgagatcaatggtaatattaatgaatatgatgttttaataatgtataatgaaatatgtcaacatttggaagatctgaagtcagtgaaccattattgtttgtatgatcaatgaataacattaattttcaagacagaccaatggaatgtcatggagtaagaaaattgcactgcaggttcagattccacataacaaatagtctttaaggaaccaccatttgttgagttttagtgtagtatcaaagaagactatactaaattgtttctccttttctcaattacaaatctgtaggaggttggattttcttcacgtatttcaaccaaaacatgacattgcagcagg

SEQ ID NO: 127759 - DNA, 568 bp, Homo sapiens
acctgttcagttttaattcaaattccttgacttctcaaccgtctgattaagccattgctttgttcattgtcatttgaacataaagtgtaatctggcacgtatatgtttgtgcttctgctgcaaaggagatgctaagcataccagagaactaaacaaatatcagctccacttccctttctctgtgatatatctcctctagctaccttgtactgtcattaaacattgccttgttactgaatcttgtttatttccttctccaattatacattaaacacttggaaataagtaccagtatcacaagagttttatgttccccagagcggcccatccccattccaaatgcttatatacaatttcatttcttgttctaaagatacctcttttgaaccccatgctgaagagctggtagcggacaggacctagcagcaggaggcagagtcagctgtcagcgttctttcatgtgtgctatgtgtggaagtctctgacaggcacacccacctgctccccaagactgctctccctgcacttggaaagctgtgggcatgcctccccatttcagcttagggga

SEQ ID NO: 127760 - DNA, 194 bp, Homo sapiens
aaaatcaacagtgcaagaatatggccagggacaatggctcctgcctgttaaatccagctattcaagaggctgagggaggaggatcgctcgaggccaggagttcaagaccagcctggacaacatggcaaaaccctgtttctacaaaaaatacaaacattagccaggcatggtggtgcatgcctgtaatcccggct

SEQ ID NO: 127761 - DNA, 348 bp, Homo sapiens
acccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagc

SEQ ID NO: 127762 - DNA, 219 bp, Homo sapiens
tgtgacaagcgcaagtctaaaacacaagctactgaaacctagtatgaatgaacgcaaagtatctaatactttacaatacaatttcttatactgattccatgaaaataacattccatcagtgttaagataccttgtgagacttttagcctcaaagtgaaatactttctaacctgacagaaaaacactggtggcggcagaagtgcagtcaccccctttgcc

SEQ ID NO: 127763 - DNA, 546 bp, Homo sapiens
cccttccaggacacagagctcgatgggctgtgcgatgctgggcaagtgtctctccctagctgagctggttctgttctgtacagtaagagaggcggccccgggatctccacggtgcttccagctgtgccgtcctggggtttttctccgcagagtccctctttccctctccattctctttgttgtctctcttcctccttattttcttcttcaatctcgatccccttcccgagccctccttccctaaagaaggctgactcagtcctgggaatgtgctgctccgggtttggggcgggagcactcagagaccctggtcaggtgtcagaagacggtgagaaaaatatctttgaaaaaccgacgcaggagtccagccgcagggaagtacctgcatggggacactgttcaggaggggccacaaggaacctcaggcaggctgggggccttctgtctgcggctggctcatccccacctcatcgggaaggtctggtcttcattcccaggcctccgtgaggcacttctcaacttcacgctggatgtggatgtggggaa

SEQ ID NO: 127764 - DNA, 491 bp, Homo sapiens
taggcttaaggatgatacacacacacacacacgcaatgcaattctattattgcccaaagaaaatagacccattaaggaagtccaacttctgctgcgtggaccagtgctgccacatcacacatagaccaaaggcttaggtttttgtggttttggttatttattttatctttttattttattttatcttattttattttattttattttattatttgagatggagtctcactctgtcacccaggctggggtgcaatggcgcaatctcagctcactgcaacctccaactcctggggctcaaatgatcctccagcctcagcctcccgaatagctgggactacagatgcgtaccaccatgcctggctaatttttttattttttgtagagacagggtctcaagcatcctcccgccttagcctcccaaagtgctgggataacaggcatgagctgctgcactcagccatgtttttgatttttaacaaaattgtaacacc

SEQ ID NO: 127765 - DNA, 193 bp, Homo sapiens
tgattgggtaatgaaattacaaaggaatgaacgaatgagtgaaggaatgaatcaaaattgaattaatggccaggtgcggtggctcatgcctgtaatcccagcactttgggaggccaaggcaggcggataacctgaggtcaggagttcgagaccagcctgaccaacatggtgaaacaccgtctgtactaaaaaa

SEQ ID NO: 127766 - DNA, 782 bp, Homo sapiens
ttaaagtacagaatctgaaataaaaaatgatttgttggagaatcttaacagcagattgtgggtggcagatgagaaaatgggacagaaatgatatttgaggaaatcatagctgaaaatgtccaaaatttgctgagaaaaaacacaaaaatatgcaaagaaaatcacatgtaggcactgtattcaaacttctgtacaccaaagatacaaagaaaaatctcaaaggcagccctaagggtggaaacaatagatcacctacaggggaataatcaaacatcgactcattcctcatactaaatgtaatgccatttcttaatgattgaaaagaaaaacaactgcaaaaccagaattttatgtagagcaatgtgatcttgcaataatgaagaaatgaattttctgttgtcagtggaattcctataagtagtgtgaaaggcagtgagtgcttcagggtgaagggaaatgacactatgaaccaagatagaaacttgtttttacagaaaattttcactaaaaattttaaagtatctatttacatgtaaaagaatatccttttattcttttaatttctttaaaagaaaaactgactaatgcataaattatagtattttctcatgagtctatagtacttgcagatatgaagtatgtaaaaatactacaaagtactgggtggcagtaaatgaaattatacttataagatactcacatttgcataaagtggtaaaatattaactctgtgtaaacagtgataattaaagaggcatattgtaatccttagaacaactgct

SEQ ID NO: 127767 - DNA, 651 bp, Homo sapiens
gtatacaatattgagcttcagtcacaggactcattttcaaagaaagtcctgatgtctgaatgaacgtttatatttttaaattaaaatgttcaggatgcaaatgtgtgtatatgtttaatagtttccctgttttactacctgtctttagccattcagatagtgtttttgatcacattggttaaaaggtattctcctgtctctggtgcttttctgtacaatatatacttatatgtagaacttagaaaaatcaaatgtgtaaaatagtttaagcaataatagtgattatttttataataaaagggattcttgttggtttttgaattattaaatttatgctagtttttattatgtacatattgttctgtgctgagaagtaaaacacgattagttatgacagtaggaaaaggttgggcctggaggtcatgtgagatgaaagaggaggtttacaggcggtggctcacacctgtaatcccagcactttgggaggccgaggtgggtggatcacgaggttaggagatggagaccatcctggcccacatggtgaaaccccgtctctactaaaaatacaaaaattagccaggcatggtggcgggtgcctgtaatcccagctacttgggcggctgaggcaggagaatcacttgaacctgggag

SEQ ID NO: 127768 - DNA, 378 bp, Homo sapiens
ggttgtctagaggatcccagactcggcaccgttcgggagggcagaggaccaaggctgaaaggagtagagagcctgagagagagatgagactgaggggagctagtggtgactcaggctaaccagtcagcgggagagacctagaccggggggcagagaaggcgggagaactggagagaggacctagcctaggaggagagggagcaggctgagaaggaaatgctctgggtaggagagacagactccaaggaaaaatccaacaagtagaggaggatttgggattggaaaagctgaggtccagctgggagagctgaagagggatagaacagaagaggttgagccatggggtttcaagtacgcggaaaggagcaaagatgttag

SEQ ID NO: 127769 - DNA, 554 bp, Homo sapiens
caatttgatgtgagagtaagttagaagagtgaatgatgatccttagattgctaggaaagagggcccagcgggtcagctgtgttagtgtgtggagactagggctagtgacacctccgggtcagctctgtgcccaggaagcacttcaacctgtgtggcaggagggatagcaataggaagcacttcaattccccacaactcagacacccagacgggagggcagaggaccaaggctgaaaggagtagagagcctgagagagagatgagactgaggggagctagtggtgactcaggctaaccagtcagcgggagagacctagaccggggggcagagaaggcgggagaactggagagaggacctagcctaggaggagagggagcaggctgagaaggaaatgctctgggtaggagagacagactccaaggaaaaatccaacaagtagaggaggatttgggattggaaaagctgaggtccagctgggagagctgaagagggatagaacagaagaggttgagccatggggtttcaagtacgcggaaaggagcaaagatgttag

SEQ ID NO: 127770 - DNA, 595 bp, Homo sapiens
caagctttgatgcatgaaaaaaatggtttcataagtataaaacattaaggaatctttctgagaagctagaataaaattgtcaatcatttatttaataacttatgtcagcacaattttcttgtagtatgcaatgagcatttacatttggttgtatgtaccaaaaaaaaattttagggttgctctgaagttatcaaggagacactgatcatttttttcctgttataaaaagttgcctagagctctagtagaagaagcatcacagctttcgtaaggcaagtgactgaagacttgatccaagactggacttttatctttttttaaaaaaattatggacctatggatgctaggcaagaccaggcactttatatatattattccaaattcttaatttgaatctgttacatcatgactttaccattttatgtgtgaaataacagaattcatgaagttatgaaacttgtccaatgtcacactaccaccgagtagcattgtgtgatagtcaacatgtattcctcccatactgggtagcagtgcttttctaagtgctttctatttatggcttgtttaatctcacaacacatttatgagataagtg

SEQ ID NO: 127771 - DNA, 735 bp, Homo sapiens
ctcaataccaaaatctatggatgctcaaatttcttatataaaatggggtagtatttgcacataaactgcacacataattctgtatactttaaataatctctaggttacttataacacctaatacaatgtaagtaagcattacgtaagtagttgttatactgtattgtgttttttatttcaggatattttcaatctatggttggttgaatttgcagatgtggaacctacagattcggagatccgtattccttttcatagcaaattgtcaagtggatcaaataaaacccaaacagtcatgttttaaaaacaaaaaacaaaaaaaaaaaacgaaaacaaaaaaaaacaaagcacaaaaaaagaaaagaaaacaaaacaacaaagaacgaagcagcgagacgcaggcgcgcgcgcggggacgaccgggagaggccacagaccagagggcggaggagagggcgcggggcgcgagaggcggtgcgacaaaaagatggaagaagagagggggcccaagggggaggagggcggaaaaaacaaggggggagagagaaatcgccgaagagaaaaacagccgcgagagggagaaacagccagagggggaggacaaaaacagacgccaagaggaagagccagacagcagggacgacagcggggggcaataaaaggagggagcgcacaggagaggacgggcagcgagcgaagagagcgacacacggagggagggcgcgcggagggagg

SEQ ID NO: 127772 - DNA, 466 bp, Homo sapiens
gtctaaatacatgcccatttaaattttaattaaaagtaaataaaattaaaattcagctccctcagttgcatttgtcacatttccaagtgcctcaaaagtcacatatgggccagtggctactgtattagtgcaaaaatagaattattccatctccacaggaagttctactggacagtgctgttctagttgcctacttaatgttccctggcccttaattttgttttccttcactatacacagaacactatgttagaagctgcaaagagttcagaaaacacttcatccactccttctactatgtgcaagaaataaaaaaaaccttaaccaactttaaatgagttacacggagcagcacatacagccctgagcaaatacatcaagagtacccttgcctctggggagatgagattcttatttaaagctgtagaacagtgctgatgtaccttcagaacagttaaaaaaaaaa

SEQ ID NO: 127773 - DNA, 722 bp, Homo sapiens
aacagtggctcatgcctataatcccggcactttgggaggccaaggcaggaggatcatttcatgccaggagcttgagaccagcctgggcaacatagcgagaccctcatctctataaaagaaacaaaaaaccagttaattccccgtttcttttcagtggtactactgaaggctgtttcagaaccgcaaagctgttgggagatccgaagtgtattttgtaggttatcctccatatgacatttatacagcaacacagcacttcagagataacctaagtccaaaaatgtaactggtcacagaacactgccccaagaaaatggggcagaggtttaaacttttagctcatacaactataaacttgttaagatttaaaaactacaaagtaagagtcacactgcacttcccaatccaacaactataaacgtggtaaaaagagagaactcaccacaatgaatactaagaataatgaatatggtaaagagtggtctatgtggttaaaaatttaaaaacctctttttgtggaaacttaccaatccagaaacagtgttaaccacatctaatgatttaatcttggaggtcgaattttttttaattaaaaaattgcttaaaatgtttgcatatttcataataaaatcttctttaaaagatctacttagtaaatcatgaaaacactcctccaaatgatttatggcaataatgaatccaaatgactcattagaagacgg

SEQ ID NO: 127774 - DNA, 481 bp, Homo sapiens
ttttattttgtctataattactatttcatggttactatcatttcttatctctctaaagatattcatggtaatcattttaaagatttttccccctccctgcagagtctttttttctccaggctttttactttcttttcccctctgttttgatctccattttcccgtgaaaggctttcctccaatctctgataatattcagttgttgttcatctgtaagagggactacaaagctgtttggacgctttgatgtgtgggtggggctagttgacactgagcttcactgtagggtgatctggctgggctgtttgattaagaatcagtgttggtatcttcaggtctttcctcttaggcttctcagacttcagagaagatgcttatcatctgccacctgtagagtgaatggccagctgccatttttactgggagccagcgaagatgagagggttgtgtttgtgtgtggtggggtgtgtgtcttggcatc

SEQ ID NO: 127775 - DNA, 336 bp, Homo sapiens
ctggcatttgactctctgaggcaccttagggaagttgctgaacctgttaaacaaaaaggccttgtgacaaggcggaaagcaaaatagaaagtaacaaatatgcacctgaagcggcagcaggggccaggcagcgaaggaccttggaggccaaggagaagattcgctctttattgtaagagcaaagagaaaccactggcttacagggtagaggatggaagaggggcaggggaagctgcaggaacatcagttaggaggttgttgtgattatccagcggagatatgatgagggcctaagctagggtggttgcagaagagacagaaagaggtggacagact

SEQ ID NO: 127776 - DNA, 520 bp, Homo sapiens
atgtgaatttctgcatcagcattgcgttggtgctgttcaccttataagcatctacaaaactggggatgtttaaatactttttcatacaccgacatcctctaaggatccctcaatctctgcagtgttttttttttttttttgtcatcactgtgcttgcctgtgagttggcatttctcctccatgtgtgaatccagtgtttctgcaagctgcttttcgtgtgttacatggagtcgattcctaacaggttgactaaggaaatgaaagccacgaaagttaggatagtagttccctgtgatgggggagaaggtgtaccaaacaactgggcacaccagagctcccaatcttcaatatgttaacctgggtagtgggtacacaggtgtttgtttaatttttatgttagaaactatgtatatatggtttataaactcttctgtatgtgtgacagatttcaaaatataaacaacatcaaaaaagttttgaataaagaattacctagggaacttgttaagaaaaaaaattc

SEQ ID NO: 127777 - DNA, 377 bp, Homo sapiens
aagaagggaaaggggaaggctccgcaggcttctagggcggttgcgagccattccctgtctcccgggagagaaacggattattgcgagtcctagggtcttgttccgattgtagtagaataaaaccagcagagctcttcagtcagggtgcaaatcctgcccgtcccttaagtagctgtgagattgttaaagcttctattaaatcagttttctcatggtaaaatgtacataataccaccttactttcagaaatactgaaaagtgttttgtataaatataccaaagtctgtggaatagctgggtcaactgtaaattgcaagtatttggttatcattattagttgttcagatatccgcttttgctaaaaaaaaaaaaaaaag

SEQ ID NO: 127778 - DNA, 2416 bp, Homo sapiens
ggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaattcctgaaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaaaatattttttctttcctggcagcttttaacattatagcaaatttgtgtctgggggactgctggtcactgtttctcacagttgcaaatcaaggcatttgcaacc

SEQ ID NO: 127779 - DNA, 888 bp, Homo sapiens
ggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctgtgagcctggggaaactattattaataatatttactgttgataatattggggaaaacagcccttaactctgaggtttctgctgtgctcctgtccaaaacagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtgccagagaccctttaagatggggggaagggtctcggatggatcaggagcaaagcaggctcttgcctgcagtcactccctccccaaccagtgcttcaagagatggccaggagcttctgtgtggccatcctgggaactcctcgaagctcccaaagaccccttagcagcatagagagagagg

SEQ ID NO: 127780 - DNA, 2716 bp, Homo sapiens
ctctttagcacccggcgcgcggtgggggcgcccgggcgggacggggcggggctgctgacggcgtagaccccgtgctctgtggagagccccacgacggcggcggtcgcggcacctttaaggtggagggctcaagcccctcgtgcggcttcccaatcctgggcaggtcacgtggcttcacaccttcgcttggcgccggagagggagtctcgggggcggggctggccaggtagtgtggcgcgagggcggaagactggcggggcttcgtgcccgggagacccgccgggctggcggcattgaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaattcctgaaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaaaatattttttctttcctggcagcttttaacattatagcaaatttgtgtctgggggactgctggtcactgtttctcacagttgcaaatcaaggcatttgcaacc

SEQ ID NO: 127781 - DNA, 3282 bp, Homo sapiens
ctctttagcacccggcgcgcggtgggggcgcccgggcgggacggggcggggctgctgacggcgtagaccccgtgctctgtggagagccccacgacggcggcggtcgcggcacctttaaggtggagggctcaagcccctcgtgcggcttcccaatcctgggcaggtcacgtggcttcacaccttcgcttggcgccggagagggagtctcgggggcggggctggccaggtagtgtggcgcgagggcggaagactggcggggcttcgtgcccgggagacccgccgggctggcggcattgagcattgccaagtaattcttcctgttgactcctgattttcggtagtattaaggccgaggaagaggaaggattgattggtcttgctctctcaggggtggcaaaggtggaaggatgtggagcggatgtaaggagaagcaggcacagtcagttttcagtgcctgtgtaatagaagggtctgtattgtaaaagaagtcaaaagcagccttgaataatcggaacccttttgccagatcatctaatgtcaatatgttttctggcattgctacttcaacatcgtcttccatgtctggcactggtttggagcactcatctctatcagattgtcttctgctaattcctctggtatgttaactcttggatttctccaaggtccatgtcttggaaatcttcactcccaacctttttttgtcatatctacagtttctttcatgatttcctgtattggctctgtggtaaatctgtgaagtcatgtacaacatctggaaacagtttttttaagcaggaatttattattttgggcatgatggctttcatggatttttctgtaacaatgatggcattgtcactggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaattcctgaaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaaaatattttttctttcctggcagcttttaacattatagcaaatttgtgtctgggggactgctggtcactgtttctcacagttgcaaatcaaggcatttgcaacc

SEQ ID NO: 127782 - DNA, 136 bp, Homo sapiens
ttcgtatgacccttcatctgctgtaggagattctctatttttctctttttgtgtgaaaaaagatgaggatgaaagactatggagttggtagctacaaagaagagagttggtagttcctaggtgtatgagagaggct

SEQ ID NO: 127783 - DNA, 545 bp, Homo sapiens
ggctctctggatgcaaagtgtcaaaagcatgccttgagtcagtatagatgtttactgactttcctttggctaagagcaatgctctagtgagagctattagctcagctctttgggccaaagttccgactggcagagggcgggcttcggctactgaattcagtgttaccactgcacatccagcccgtctgacaccttcagatatgaagctgcttccatcagtaaagtatttaacatctgggtctcttaagggctagtccgttaagtttttttggcttgataaaacctcatccactgtttccacacaacagtgataccctgggccacacaatggggctttccgtgctccacccattctgttggcagcagtgtggctggatttagagtgttcacagtctccagggttatgtaggggttttcacacaaaagcccttgatatcttaacatcttagggttagatagccagtgatgccccctctgctccatcagggtgacacgagcatgtggggcacccgaattattaacctttgtccaaatgtgagcttgtt

SEQ ID NO: 127784 - DNA, 102 bp, Homo sapiens
atagcaccagcgtctgcttctgggaaggcctcgggaagcttacaatcatggtgaaagagaagcaggcatctcacatggtagaagcagaaacaagaaagatgg

SEQ ID NO: 127785 - DNA, 100 bp, Homo sapiens
ttgttcaaagcttatagttgttatctactgtaagattgtcagccataccagaagcagaaattccatctcattgttttataaatatggtcaagtatctctt

SEQ ID NO: 127786 - DNA, 3183 bp, Homo sapiens
ccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggccctgcttgatactcagaatcttttgcgtgcacaaatcacaaattttacattcaacctgggattttcagggaaattttaccatacaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggttctcccaagacaaacctgtgggcttttcactcacaccattttctacaaagaatatccagggggtcctaaagagctggataagagtatccaaggaggagaacttttcttcactgtcgtcctcaaccctatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcagaatccttgcgatgacaaacgccacagagacatttggtctaaagaaaaaacttgtgatcgcttaccaaaattcttggtaataggaccccagaaaactggtaccactgctttgtatttgttcctggttatgcatccttccatccttagtaactcccccagcccaaaaacctttgaggaggtacagttctttaatagaaataactaccacagggggattgattggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcagttgctaattattgatgggcaacaactaagaactgatcctgctacagtgatggatgaagtacagaagtttctaggagtcttgcctcattataattactcagaagctttaacgtttgattctcataaaggtttctggtgtcagttactggaagaaggtaaaacaaaatgccttggaaagagcaaaggaagaaaataccctccaatggattctgatagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaaga

SEQ ID NO: 127787 - DNA, 339 bp, Homo sapiens
tatttctcatttacattaagatgaaagaggttaagtgagttgcttaaaaatcactagcttgtggcctggtgtggtggctcacacctgtaatcgcagcactttgggaggccaaggtgggaggattgcttgaggtcaggagttcaagaccagcctgaccaccatggtgaaaccccgtctctactaaaaatacaaaaattagccagacatggtagtgggcacctgtagtcccagctactcaggaggctgatgcaggaaaatcactgaaaccggggaggcagaggttgcagtgagccaagattacaccactgcactccagcctgagtgacagagtgagactcc

SEQ ID NO: 127788 - DNA, 232 bp, Homo sapiens
ctttcccttgttaatcttatttggtctcatcatttaaaatactacttgctaacatatacatgcagactcatttatccaactgcttattccatatctctacttggttatctaacgggtatctccaacttagcataaccaaactgaatccccaactctctctctctaaaccctgttcttcctgcagtcttccccatctcagttagaggaatctccaaacttctagtcgctcagc

SEQ ID NO: 127789 - DNA, 447 bp, Homo sapiens
atattaataatgatatacatacctagtctaataaaaactcactgctgagcaatgaggcctgtttcctcagacacagtattttacgattggcttaaacagttggcccttcaacaacatggctttgaattacctgggtctacttataagcaaattgttttgaaccaaaaaaacatcttggaatggaaaatccatgtacacagtgggccaacttttcgtttacacagatgtgggacttcagtattgcgcagggttgggtatatacaagggtcctggaaccaatcctccgtgtatactgagggatgactgtaattaaaattgtggtgaagagtttatgcctgtttttaaaaaatgcatatctgattaggaacactggacttttctaacaggtctacctaacccaaatagcaaagtaataaagtataaccatcactggtagaatagatttac

SEQ ID NO: 127790 - DNA, 148 bp, Homo sapiens
cctcctggaggtggaagcatacccccagatttgtggcgtgggaatttggggaaaagtttctgcggtgttttagttgtttatgtggtggtgggggtggatttctagccctatacatgctgggtctcatagctggataaaagctatgtaa

SEQ ID NO: 127791 - DNA, 638 bp, Homo sapiens
tcaccaggctggagtacagggagcgatatggactcactgcaatctcagcctcctaggttcaagagattctcgtgccttagcctcccgagtagctggaattacaggcttgagccaccacgcctggctaatttttgtatttttagtagagatgggagtctcgccatgttggccaggttggtctcgaactgttgacctcaggtgatccacctgcctcggcctcccaaagtgctgggattacaggcgtaagccaccgtgcccggccagctttgagctgttaacagaatgtctgaaacatcataatcttccttcctatccctgaccaggcagggtggctctgggacagaagacttacatgaaaaatgaccaaggccaggatggatgccgcctcccacctcttgtccaagctcattctaaccccgcctgctcctatgtcctcagagccatggcccagtccagaggctcgagtcttcattcttccccctgggggtgcagatgcttttccagaggtgcttagggcgtagggctggagagtagggcagagctggagtcctactttcccggagctcctagtgccccactgcctccaggatgtcctgtggctccctgaggctctgggtcctggaaggcattccccggtg

SEQ ID NO: 127792 - DNA, 281 bp, Homo sapiens
tccaggctgtgccctggtgtgaagcctctctgtggctctccactgccttcaggagaaattccactcactcaccacagctcttaggacctgcaccacgtggagtcggcctgactgggcagccttgtgtctggtgagtcttgctgtggcccagccatgaagaagtgcacgtgctcttccttctatctagaatgttctgtccctacttcttcctctaaacccagtttctaaacttcctccagaaggcctgcttagactgccctgtccccgggtcccctcccttg

SEQ ID NO: 127793 - DNA, 502 bp, Homo sapiens
gaaggtacaggaaatgggcagccgaccaagcaggagaaaagtgagcctgcagagccctgggctgtactctgaaaacaagggctgtgccaatgaggtcctgacaggtgaattcttgctgcccaggaacctgcctgcttggcctgcaggcaccctgactttgcaccaggcagagcctgctgttgcccagccaggttccactgaagatgtcaggggccatccactgtactgggaagaaggctggagtcatcagctgcagaggggaccagcgtccgcagggggatggttttagtagactgcacaagcagctggggtggctggcctgtctgcaactggtccgactgaccggctgaagagttataaaactccacacatggtacaaaggccccttgtctccacgtccctctggtagccaggtgtcccttcagtgggcctcttggccaactcctgggatcgcccccaggtacagaagtgggtacaatgcaggtccttctccacgaggcct

SEQ ID NO: 127794 - DNA, 675 bp, Homo sapiens
tatcattggttttcaatgatagatacagaaataaatgtagatgtaagtatatgtgtctgtgtgtatatatacatatattccctacctctgtacattgagaggacctggatgcagccacaccccaaaagcaatgagcacacctaatgtatagattttgacttctaaataccattctccactaaaagaatcaggactcagagaaatggccagccccaggtttagggcaaggacattattaggcgataagcccaaaagtatcttgtgctagaaaaccaagaattgctctaagaatgatgagacatgttacaacaaaatacacacacagaagtcaatttgaagggatttccacaggcaaatctaggacaatttgagcatcaaatgttagtaacagattagcccattgagtaaaataagaaaccatgagtgtacacagatatcaatcaactgaaagtcatctgagaagcaggatcttacatagttattaaggaccttcccacaaaatgcatattaatgacaaaagggaaaagagtaactttatagtggaaaagcctggcaaatgccgttttaatcaagttatcaaaatgaacatcatctgtaacgggacaagtcaacattgtgttcctctaataggttacaatgagaatgcaacatcaattctgtaatattcctgcaaaa

SEQ ID NO: 127795 - DNA, 451 bp, Homo sapiens
ggctgggagcctgagatcagtgtgtcggcatggtcaggtggcagtgagggctctctttcaggttgcggatggccaccaccttcttgtgtatcctcacacggtggaaagagcgctctctggggttgctttataagggcctcagtcacattcatgaggctctaccctcatgactaattgcctcccacttcccaataccattaccttcctactttggtttcaacatgtaaattggggggcaggggacacaaatgttcagtccatggcagtgaccctgtgaccccccttctctgctacatcacctctttctttcctttttttttttttttttttttgagatggagtctcactctgtcacccaggctgaagtgcaatggcgccatctcggctcactgcaacatctgcctcctaggttcaagtgattctcctgcctcagcctcccaagtagctggga

SEQ ID NO: 127796 - DNA, 600 bp, Homo sapiens
acacatttcagaataagtgcaactactattaaaaggtgttaacacaatattaaagtggatggatttcaggatggccccataaactccagtgaaatcataggcaaaaatttgtatatatgatatgcatggcactaaagtaatataaaacattttgcattatacaatgacattttagatgtggttggcctttgaccaagcagcccagtccacatatccaatacatcagcaaatcctgttggctctaccttcaaaatgtcagaaatctaaccacttccctcctggctcaactacaaccccagtgattccacgtcaccattgtctttctcctgggcgactctaatggtctccctttatcgctctttcctccttatcatatgttctccataccacagccacagttatcctttcgaaacccaagtgtggcagacagactctcaaggtggccccggtgatgcctgcctgctggtgttcatgccattttgtcgcctcctccccttgttgcatgtgagcaggacctgtgattagcttctaaccaacagaatatggcatgggtgacggggtgattatgtgagtttatgacataagacttcagtgtccatc

SEQ ID NO: 127797 - DNA, 182 bp, Homo sapiens
tcccaaagtgctaagattacaggcgtgagtcactgtggccttgaacagtagttttttttattacattttactgatgggtacagatgaagaaactgaggtcagatcaagcacgccctaggttacacagctaagccttggcagagctgggatttgatcccgggtccagccacttgcaggtggaa

SEQ ID NO: 127798 - DNA, 357 bp, Homo sapiens
gtattccatttttgctatttcccgacccttgcaggattcaggatgaaatcgtaacatctcttgttccagagtgcctttcatgtaactgatacacaaataaattgacatttctttttttatctctcatacacctggaatatcagaggatattccacagtattattccggaaagacatcagagcagtgtggatatgatgttggaactctgatcatctgtttctgttattattttaaaacattcacgataggagactaatcctggatccctcttgccccagtgagaccttctttatattccacatccattaccgaattcagcaccgtcgcacccagggtgctgcttgtgggcttgcttat

SEQ ID NO: 127799 - DNA, 739 bp, Homo sapiens
gtgttgcagttttgccatacataatgataaagatgtcatactacccttccataaattttgctaacaaacttagcttgtttgaagtctgcatgctgcttccaaaagactgtctttctaacataaatttcagattaaaatactcgacttattaacatggaaaatatacttgtaaatctgaagaataaaatgcagaataactcttgtcgtaggagctgtatactgcaagtggatgcctagtgttcttgactgaattgatagtaaatgcaactaagttgcaaaatggtatattctggacaacataattttggttttgatttgacagatagtgcttcaaacaatacattaaattcatatgaagtgaattcatggtaaataagaattttttatatcatgaatttaagaagataggctttcggtgagtgacagagccataatcttttgtggtggtttatttccaaagcaatctcaaatacaactgctttacacattattcatctctcctttgtctttgttgcccattgtgcatgtaacccatccctatgaagaccacaacttattgtttaaatggagatttttgtctccataacttagctaacaaatgactttagatttcataataatggttgttaatttatagggtatgtagaagaatttcattacattattaacattttattgtcccccatgtaatgttccaaaatgtcaatgttaaattactaacttctaaaaatatattact

SEQ ID NO: 127800 - DNA, 496 bp, Homo sapiens
ctgactatgatgacgttgccaacaaaattgggatcatctaaagtgagcccagctggctaacactaaatagacatatttttcaccataaaataaataaataaatcataaaataagttaaacaaaacctctgtaatttttcatgaaaactggaaatatcagtatgaattgaaaatttattcttctctttttttttgagacagggtctcactctatcacccaggctagggtgcagtggcacaatctcaactcactgcagccttgacctccaggctcgggtgatcttcccaagtagttgggatggcaggcgcccgccaccccaccgggctaaatttggtatttttgggtggagatggggtttggccatgtgggccagggggttctcggactccggacctcaagcggttggcccgcctcggcctcccaaagggcggggattacaggtatgagccacggtgccgggcccagagccggtttttcggacagaacaccgtcgaag

SEQ ID NO: 127801 - DNA, 567 bp, Homo sapiens
gtgcaagataaaggagttgaacaaagacagtggttttcaaactggattccgaggaaccctagggttccaagaagacatgatggtgagaagagcaaggcaaaagggaaagaagacaattgttaatgagcaggacccccacttctacccagattgctccttcttgctctgttttgtctaccatgcttccacacaatactacacttaatcaaagggttttggcagggcacagtggctcacatctctaatcccaacgctttgggaggccaaggaagatggatcacttgagctcaggagtttaagaccagcctgggcaacatggtgagacaaaaaatataaaaattagctggacgtggtggtgcatgcctatagtcccagctacttgggaggctgaggtgagaggattgcttgagcctgggaggtcgaggctgcagtgagccgagatttcaccactgcactccagcctaggtaacagagtgagaccctgtttcaaaaagaaacacacatacacgcaccccaaaacaaagggtcctgttgcaaaaaaaaaaaaaaaggaaaaaagaaaaaaaa

SEQ ID NO: 127802 - DNA, 379 bp, Homo sapiens
aagcttaaacattcagatccatgcccactcatgaaattgattgtacagtggaatatgaaagaaccgattatccaaagcaaagtcaggccaaacaccttgtttatctcagtagtttcctttagaagtgacagtttttcctgttattttcatttagtcatgcattcatttatccagcaagtaaaaattatgcccctactgtgtacgcagcacctaatccagaactctgcatttccccttccataaaaagcaggtgcgacctgcctacctcaggggagatcacatagaggtaagttctagcaaggtccctgggtgagttattttaattaaagccccaggaaccaggaaaaaattagcacagtgggatcaaattcaggcacca

SEQ ID NO: 127803 - DNA, 510 bp, Homo sapiens
cagaaatgtgttgtattccctttggtcttgaattcctgcttgcttctcttagagtcaacatctcattgtgctgtaggtaattcaggtgctaaagacttgtgttgttttttgttttttgagacaagtcttggctttgtcttacccaggctggagtgcagtggcacgatctcagctcagctcactgcagcctctgacaaccaggttcaagcaattctcctgcctgagcctcccaagtagctgggactataggcatgtaccaccacacctagctaattttgtatttttagtagagacgaggtttcactatgttggccaggctggtcttgaaatcctgacctcaagtgatctgcccaccttggtctctcaaagtgctgggattataggcgtgagccactgtgcccagctggcttgtgcttttttatacaaagcccctaaatacaagccagtgactccaactagtgctagaaaataaagtcatctgttctaatgctgcaggacaaaatgtctact

SEQ ID NO: 127804 - DNA, 477 bp, Homo sapiens
  misc_feature (177)..(177): n is a, c, g, or t
  misc_feature (218)..(218): n is a, c, g, or t
ggagtgtattgtttatgggattgtctggcattaagctgtggatccattgtaatgagtgtgtgtactgctgtactgtgtctctttgttgggggtattaggtcgctttctgggcctgagttattctgagccattcccagcgaggcggctgtgcccaacttggttgcaatgtggggtgantggtgcccccttggaggacagaagggacaacgacccggccngttagttcttgtactcgacaaccatttattttagagtagggtttctcaatctcagtggacattttgggaagaacaattatttgttgtgtggggttgtcctgtgcactggagggaatttgacatcatccctggcctcgatccactagatgcaagtggcacctcccagttgggaaaatcaaaatggctccagacattgtcaaatgtcctctgtgggtggagtgggagtttgggggacaaaattgcctccttctgttagaac

SEQ ID NO: 127805 - DNA, 768 bp, Homo sapiens
ctagcatttggtggtttgctggcatcattggtattcttgcttctgctgtaccacgcccacctccaccttcgtcttcacaaggcagtctccttgtgtgtgtgtctgtgtccaaatttccctcttttaaaagaacaccagacatattggatcaggggctcaccctactccaggatgacctcatcctaacctaactacatctcaaggaccctattccaaataaggtcacattctgcagtactgggcgttaggacttcaacatataaattttacaggaggggttactattcagcaaggtgagaagctgctgaagcaagcaaggtgagaagctgctgaagagttctgggcagaggaggggcaggtctggtttatgcattctgactgatgggttgaaagaattcttgagtggagttgtttaagaattgtctgtatgtacctaaattacatctcagtgaagttgattttaaaaaacaactttcaagccgggcgcagtggctcatgcctgtaatcccagcactttgggaggctgaggtgggtggatcatttggggtcaggagttcaagaccagactggccaacatggtgaaaccccgtctctgctaaaaatacaaaaattacctgggcgtggtggcacgcgcctgtagtcccagctactcaggaggccgaggcaggagaattgcttgaacccgggaggtggaggctgcactgagccgaagttgtgccactgcattccagcctgggtggcaagcaagactctatctgaaaaaaaaaa

SEQ ID NO: 127806 - DNA, 202 bp, Homo sapiens
ctctgctgtgctatgtcatcgtcatctccactagttcttggtgcctggcaagaggtggcagccataggatgttttctaaatgaaggagcaaatcaatgaagacgtgccgaggtgcctacatctccacctctggtccgtctcattgcaggctgtaatcgggaggtgaaggagattgaatggaaggcatctaccagcatcagtt

SEQ ID NO: 127807 - DNA, 175 bp, Homo sapiens
aaatggcagttggcaaagactagaacaaacgcccaaagagtagagatggacgtttggatagaatcgtggcaaactgcagggcagacagtcagtcctggatccctccttaggggccatacagcgaagcccacctgcatctcagaaagcctcagaactgagacccagcccccaccta

SEQ ID NO: 127808 - DNA, 242 bp, Homo sapiens
ggcacatcttagaatgttgcatttcaagtcttgctaatatggttggtacaggcaagaatttctagttctttcaaaagattcattttggaccttgagagattctattcataactgttaaataaagatgcattatcttaagatggctccttttctgtttaccaaacaaaacaacctttttttttttttttttggagacagagtctagatctgttgcccaggctggagtgcaatggcgcaatctc

SEQ ID NO: 127809 - DNA, 538 bp, Homo sapiens
ctgtaatcccagctcctcgggaggctgagtcaggagaatcgcttgaactggggaggcagaggttgcagtgagccgagatctcaccagggcactccagcctgggggacaagagcagcgggacttcatctcaaaaaataataataataatgaaaaataaactttattttggagtatcttagttgcgcagcaaagtcacaaagatacagtttcttcatacttcccacccagttattagtaacatcttacgttattacagtacatttgttaaaactaagaaactgactttggcactatgaaacgttcgagacttttatttggatttcgccaatttttctttaatgtctttttctgttccagaatccaagttaccacattgtatttagttgtcatgtcttcccagttttctttggtttgtgacagtttctcagtcttcctttgtttttcattaccatcacagtctagaaaagtgctgccagatatctggtagaatactcccctcccctaaacttggggtttacctgatgtttttctcatgatt

SEQ ID NO: 127810 - DNA, 254 bp, Homo sapiens
gattctgatgaaagaggccagtggcaaatgtgtatttaaaaaaaaatgcatttttttgcaggtaccagagtgaatcctagctttgtcctttgctaactttggccagttacttaactttattggttttcttacctttaaaatggggataatgagaatttcaaccttcttgagtccttgtgaatattaaatgagatgtgtgtgcaaagcaccagaaaagcattaggcacacagaactttttttttttttttttttt

SEQ ID NO: 127811 - DNA, 677 bp, Homo sapiens
gtcacttctgtggtagagctagtgattaaatgatattggaacacagagggaaaaaatgactatttgtgtggcaactaacaagatctcaaaagtatttaatagtaacataagggaaatgataggttttacttatttttattatattttaaaaaattaatagatcacttttggaaaatgtgctgtatgcagattgggccaggtttattttaaattcccggtattcctgagtgtataccctatatatgttccccaaaagacatatattagaatgttggtggctgccttgtttgtaattgtcacaaagtgggatctacccacatgcccattaacagtagaataaaaatagcaataagaatgaatgatctgcagctgcacacagcaggtagattaatcttgcagtaatgtcgacaggaaggcgccagatacaaaggaatacatactatgtgattacatttctaaaaagtaccaaaaaaggtgaaactagatgatgatgttagagttgaggaggggggtaggttagtgtctggaaaggttatatggaggcttctgggatactggtaatgttcttttatctaatctggattttctgttggatgctggttatattgagtgtgtgggtaaagattcattagtctttatacttacatgtacatttttccatttgtgtattatgtttc

SEQ ID NO: 127812 - DNA, 413 bp, Homo sapiens
actgtcataaacactgatcttctcactttaggaacctgagctctattattgtctaaaagcatgagtgcccagtaaatgtccaatgattgcttgaataattactatgcgttcagatatacaactctgtgcttttgtgtgtgcacatgtgtgtgaaaaaaggagatataaaagaacttgaacttgccactctgtagtaactaacaaaattaggtacatagtgctcaaaataaaatttcatatttaggattgttagaagaataaacagaaagaaaattattaaattgttaattttgtaataggagacagaataaactcagttttcactatagtacagtattcttttagcagcaatccttacaaaatatcaactgaaaatcaattacataatttttccttcaaggaaagagctcata

SEQ ID NO: 127813 - DNA, 325 bp, Homo sapiens
gctttccaacggagatgctactggatcttgtaaggtgggcaggggtccaacctgcacagatacctggctgagagtatctggcttatttgggaaaaatgcaggcagtgttttttggagaaacagataaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgg

SEQ ID NO: 127814 - DNA, 192 bp, Homo sapiens
tcgactctagaggtccccagcgggaacaatcactgtagcggaacaatcacttagcggggaacaatcacttagcggggaactatcacttgacatctgactttatagcttaggaagggcttaacctcacattctgtggcttgcgcctcttacaacattctgcagggctgagtaagcaaggcagggaattttaca

SEQ ID NO: 127815 - DNA, 446 bp, Homo sapiens
tgtcgcacatgcctggtaatatagtatcttagtacacacaggatttcactatacgtgttggtcaggctggtcttgaactcctgacctggtgatcctcctgcctcggcctcccaaagtgctgggattgtaggcgtgagcctctgtgcccagccacatttttgttttattaatttccgtatcctcagcacttagcacagcacttgatgttcagtaaagtgcacaacagatttattgactgagtaggtaaggaggagttttttccttgaactctttccatgaatttttcatcgtgattagttgtccttggaagggtgggatgggttttcactaggaaaacctggttttctaaggtactcattgagagatgttgagatgttttttctggggatgtttctctttggacaaacatctcgtgctttggggccattgaatgaaaatactctgag

SEQ ID NO: 127816 - DNA, 553 bp, Homo sapiens
gtaactttaatgcttatagtttattatagcctaaatcaactcttggtgcttttggggtgaagactctgtatgagttccttggctacagagagtctttgttccttggttatggagagtcttcctcagatgctgattgtagtagcgatgtgatcagtgtgtgagcaagttcactatctcctatcacactggaatggcagaggtcacttgaagcttatctcattcccctgtggtgtgtactttcttatttatttatttttttcccagtgttttacttactgggttgaacagttcagtttatgccaataggggaggtgtccatggataaaagctagctgtagttaaagcaggtgggtaaattcaatggtgggcagaggtcccagccttgacagagatagctgggggagctctcagtgaaacaaactgaagtcgtatcataaggaaggactggatctacctcagctcccctactaggccagcaggaacgccatcccacacccagacacacacctgacccagtgtttcaactattcagatcagacagacacctttttgc

SEQ ID NO: 127817 - DNA, 342 bp, Homo sapiens
gacacatttacagaaaccacttctctgcacaaccaagctcctagtagggggtaatcaagtcaagagatgcatagatttcaccatttgggacaggaaagtaggagggagattccccagggaaagggagttgcctgacaagctcagaaaaaattgtggggagaattagtggtaggaagaagagacagggaagggaaggaaactgggtggaaaattctgtattgaagccaactgattgtagagattagtgctggtgttcaggtggagcccattctgtctgaacagacaattctctccatcctttccccacagagctcattggggttgaaagtgttgaatggcagt

SEQ ID NO: 127818 - DNA, 182 bp, Homo sapiens
ttgcccaaagtcaattacaagaaagcagcagaggtggatccaggtctgcctgcctgaagagagggtgaactgaggtccttgcctcccaagaaagcggcagaggtggatccaggtctgcctggctgaagagagggtgaactgaggtccttgcctcccgggtcacagcgtgtgctcagcatgtt

SEQ ID NO: 127819 - DNA, 267 bp, Homo sapiens
tgacatcaagttttctcccgtcaaaagaataaaaatggctatggcagttttaggtctcacatccacacatctctctgcacggaaggagaagagcttatcttctgccaactacccaacattctaggcttcattctattaggacaaacataggttaacaaaaccatctctgatccaatcactatggccagaagaatgccatgttctgactggctatcacctggattacatgcctatccccaaaccatcaatcagagaaagaggacaagg

SEQ ID NO: 127820 - DNA, 665 bp, Homo sapiens
ataatatacttgtttagaaatagcaatggtctagggatctgaagcttttccagccctggttcttctactttctaagttatgatccctggtcaagaaacctaacctcttgaaaactcatgttttttgtctgtgaaattcctgccctgtgtatttcacagaatgattatgtgaatcagattagataatgtatatcaaaatgctttggcattcatcaaatttgatggggctgtaagataatatattattgcaaactcagatttccaaacagaaccccttagagagatggaacaaaatcttctaaaaagcaagtattttgttttgctcactttatttcagggtatttttttggctttgacctgtcctattctggaattcaagagtcatataggattaagtataggctacttaaattattgcacaaggtgttcatggcctctgaaatgaatgagttgtttaaaataagattatttttttaaaaggcaattaatgggaagccatacaagtcccatttaacccactgctctgtcatagacttttgcaaattgcgatacttccgttactataatatttgcctagattcaaatctaccctgtggtctttctgtttatgaattttcacatagtcatagaaagttgatttaaaaacttttttaatcattaaagagc

SEQ ID NO: 127821 - DNA, 304 bp, Homo sapiens
tatggtggctcacacctggaatcccaatattttgggaggctgaggtgagaggattatttaaggccagaaattcaagacctgggcaacaagcaagacttggtctctacaaaaacatttaaaaaaattagctgggcatgttggcatgtgtctgtggtcccagctacttgggaggctgaggcagaaggatcccttgagcccagaggttcgagttgatcatgccagcttacgcaacagagcagagaccctgtctctttaacaaaaagaaaaaagcaaatttgatattgggaggtatggatagaaaatg

SEQ ID NO: 127822 - DNA, 510 bp, Homo sapiens
ttagcccctacaacagctctgcagaggagcattttagagatgagggaattaaaactcagaaaggttagataacttgctctaggtcacacagctgggtaagtggtagagtcaggatttgaacccagagtttttggagctccaagtctcagactcatcccactaggtcctttgggtgaacttggcactatctctagaaacccaccctgctcttgaaggacaaggatttgtatttcctgaaggttcaggctcaggaaaatgggagatacttggaaatggagtacggaaagcccacagctttggaagcaaacagacctgggttcaaatcccagctctacaagtggttccaggctatatgcccttgagcgcattattgtcactcttggagcctcagtttcctcgtctgtaaaaatggggctcgtgatgtgaacctcccaggactgttgcaagaactagaacatatatcaagtgtctggcaaacaccagcaatgggaacatggtggtgattattgt

SEQ ID NO: 127823 - DNA, 491 bp, Homo sapiens
gtttgttgtgacatagcaagaggagttaaaggatgggggattgtttcgtagggagaaagagaggctaagaggtagaggtggggacaggatacctgggtgcctttctgggagaggaagtctttttctttgtcctgtggctcagagcaagtctctgagagtggaggtttcaaggaggcagatctctgttagggaagggcgagttgcctggccctagacctgcttgaagtgggaagaatgtagatttggcagtcaggcctgctagtctagggccttgttcctcagacggtggttagaggatcagcagcacaggttccacccaaacctcctgggcatgaatctagatgcgtccggatgtgcacacagaagactgaggagtgctattctagaacagagcttctcaagccaggagccattctccccaatccatggctgagaagcctaaggctagaaacatgggccttgagcactggatctcaaagctctagtttcct

SEQ ID NO: 127824 - DNA, 124 bp, Homo sapiens
tgttgatcgagctcgggcccgacttagctacaaaacttttttttcatcccaaatattctcaatgaaagttctcttgtcaaccaggagagagtcaaaaacaaccacaaacactagcagaatgatc

SEQ ID NO: 127825 - DNA, 198 bp, Homo sapiens
atggagcttacaatcttgcacaaagaaacataataatcaaagtaagtaaattatgtattatgtcctaaagtcttaagtgcttcttaaaaagtaggagaaaaagcatcaggagtgccagaggtgaaaagaatttcaatttcaaataggacagcaaggtacgacttaagagaaaaaggcatttaaccaaagtcttacaag

SEQ ID NO: 127826 - DNA, 109 bp, Homo sapiens
ccaagctgctggcattacaggcatgagccaccatgcctggatgacaaagactttaaagtaatcatcttatagatgctcagagaacttaaagaaagatgtggagacagct

SEQ ID NO: 127827 - DNA, 344 bp, Homo sapiens
cgtcaatagtgagtttgtgagtagaaggtgtgggtgtcatacagttggtgtctgtgcgcctggaagcacacacctgtttctgcttccagagttgtctctggcctgcagttctgtgcttcctagcttgatccgttcctctccaggaatctcctctccctccccaccctgacccacctgttggtgagagatgcaactgactgtttctgccacactttttacttacaggtggtacctgtattattccctccacctcttcagggaagagggtgaagagatgagaggctaggggttccaaacacaaacttgacccattttaccattttgttagcaacagtcttgagaga

SEQ ID NO: 127828 - DNA, 386 bp, Homo sapiens
ctggcaggatgagcatgtatgggtaggctgtgcactatacaagcccaggggaggctgtggcatggataacacagacatcgtaggtagttaagtttatgacaaccatgttccagcagattggaggcacggtcttgtaccaacaaaaccaatgtattgtgacaattttctgacatatgaggactgggtacctatctctaatttacatggagtcaccgtatagtggtagttccagacaacggatttagctcaggtgggtcacttcagtggtatcttgtaagtttctgtctacaaagaacttctggctctgtgataaaagtatttctctacataactcagtaaatgtaacacctccactccacttatatactacaatcacagttgagagt

SEQ ID NO: 127829 - DNA, 387 bp, Homo sapiens
gacttctccttcctcaaggcccagctcaatctcacctccacctaaaacctccggggcattcctgtagtatttggaggctgaactgctcaggagggaagggtgttaatgagctggtgtctcgccctcatcctgactcccggtgagaatgtaagttctctgcaggcaaggactatatctcattaccatttctgtacccactcagacttggccatgtgtgcccagcacataaagtgtcttcgatgactgtctatagacccacggtacttgagattgccccaacacatccttctaaaatctttctccttttcagaggctcacgaatgttcaaaccaggtctaccgggaacaacattatggtcattccgtttattctgaagcccacatacag

SEQ ID NO: 127830 - DNA, 833 bp, Homo sapiens
ggccaattttaaattttacctgattacaacattaaagtctattcagggatgcttgctcagtcttgtaagtttgatgcacttatagtgagatgatctgcttgcatctttagaaacagtgcaatgaacgttattggttattgtgttggatacctcacaactttatcatgttggccagctctgcctaggtgtagtgagacagtgccttgcctcagctgccctacctgtgtcttgctttctgccaagggcacttgggaaaatctatttactgcctacacatgtacagcttggaagtatggttgggcatgatgcccaggagaataacccatgaccaatggtggcaaggagctgaaagataaatggtcttcctttccatctctaaagtgggtaattgtgaggtgtactccaagcagcttaaaatccaaggtggtcactaatttgataatgccccatttactggtatacttttcttccctgtttcatttttcccagtctcttatgccaatgctggctagagtgatcctagagttatattgctccctgagataagttcttatcttagtgtgaatttccccataactgtgcctgaagcagagatttgagtccaattaatttatctggggaatgatactaggaaaggccattaggggaatgtttaaacagagacctgaaggtggggatggaacaagcacgaggctatggagaaagcacatttctggcagatcaaacagtcatcacaggactatacttggtagactcgctgttcaaggatagtgaggaggtcagtgagatgagtggagtgaacaaggggcagagtggtaggaactgagggcaaa

SEQ ID NO: 127831 - DNA, 238 bp, Homo sapiens
ggaggttgaggctgcaataagccatgatcgcaccactgcactccagcctgggcaacaagtgagaccctgtctctaaaaaatgaaacaaaaaaaataaaatcatgactgagagcaaaactctggagcatctgaaacaaagggtctcctgtggcctaaacaactggggcacctcaggtggagccccagacccgtcacgaactcttacttcagcagaaccataggtggaagcaaacacagg

SEQ ID NO: 127832 - DNA, 243 bp, Homo sapiens
gtgattctaagaatcaaatgagataatataaaaacattatttaaattaagtgtttatgttggaggatcaaatttcttctgcaagactctttcaaagaatatcactataggtcacagccacagagacaaactgcagctccataaaattcaaggcttatcaaaaatggaatgagttgaacccagtaagcctatgtgtgaacacctctcatactgggttcaactcattccatttttgataagcctt

SEQ ID NO: 127833 - DNA, 653 bp, Homo sapiens
ggtgctgaggaaatgagaacagtagaattagtctatacaaaatttgcctttttcgcagaatctggggattggaccagagccccgatataacttgaacagaagttatttgtgtatgtagataaatgattttcaccgttctgaagcttaacagaaatattttcaatagggaaaaaaccttgccgttgcagttctttattttccacagcgatagcaagccacaagtgagagaatgtttttaattgaaatcacataacttcatctcagccaacttccaattgcttcccctttgcagcgttttgccagagtttcaaacaagactgtacaagaaaggaaaagaatgtggtattcacagatactaaaacattgtaaaaacaacgctcatatctccagccaatttcgtcaccacgtgactctcacccttccaccgaggatgaacagaaatgtcatccatacactttctctgagctcccagtctctggtctgggcctgcatggtggattcctcatcattggaaagaccaccctgggctattttgctcttccttttgtgtggcgtcatcttttattttttccttgtctctggattgttttggttagagaggaatagtctttatgttgggctctgcgttgcaagtagtataaatgctcttgagc

SEQ ID NO: 127834 - DNA, 793 bp, Homo sapiens
tgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaaaaattgtgggggtggccggagaaagtttaacaatgggggggggggcccagtaggaatggggggcggagactggggagagggggttccaaaaaggcggggggggttggaaaccaggttggttggttaaggcaggaaagga

SEQ ID NO: 127835 - DNA, 402 bp, Homo sapiens
  misc_feature (209)..(209): n is a, c, g, or t
  misc_feature (243)..(244): n is a, c, g, or t
atccagagcatacccctcagtgagctgttaggcacattgcactccagcctgggcacaagagcgaaactccatctcaaaaaaaataaaaatgtaaagaacagaactaaagtagaaatagacagcaacaaattatatcattttctgtgacatagtttgaaggggtggcctgcccctccacacttgtgggcatttctcgacaggtgggacgnacagactgggaaaacgaacagagaacacagaganncaaagtatagagaaacaaaagtgggcccaggggaccggcactcagcatacaaggccccctgctgaggccccgggcggcgcccctggtctctgagttccctcagtatttattgatcattatctctaccatctcagagagggggatatggcaggacagta

SEQ ID NO: 127836 - DNA, 204 bp, Homo sapiens
tggggaggaattctgccatcacattcaacttaccccacttcaattaaatgcaattaactgcaggtaacaaaatgtggaagttacagctcctacattctgccaggtttgaaggacaaagggcctagcactcgtcagactcgcgtctatgcagagggctgctctgaccatcccttctagcaattgtctagtagcttctttcttacc

SEQ ID NO: 127837 - DNA, 666 bp, Homo sapiens
ctctaccttgcagcaacgcaaacacaatgcgttcctgttcttcctcaaacccaccaagcccatttccacctcaggctgtctccccagcctagaatgcccagtcacttcctggtacattgttccctgggtcttcatatagtttataccatctcttaatccagtctcccctccattgtcacccttcagagaattactcctggcaaaattaggcccaccagttcccaggtctccagcctccactctctaatctcttactctgctttattcatagtacttacctaacccaaaggcatccttcatgtctatttactgttaaatcacagtaaagacaccataagaccagggcctttgttctcttctaagtacctgaggcctagaataggacctagcccacagaaagctctcagatatttgaaggactaattgatttaaaaaacaacaacaacaacaaaacccactaaagcatggctgctttctgaaaatcttctctcatagcacacattctcttgacactgctttgcctttgtgattcttaaaggatcatttcattgttgaattagtatcttaaaatgttttctccgtgctactgaagcaggtaagaaacaagtgatctcataaaggtaaactacttaaggagcacaggtgcttctcatgatagatttctag

SEQ ID NO: 127838 - DNA, 252 bp, Homo sapiens
cattaggtatatttgctgctgttgtattacaggaattttatattacattaattgaaatgacatttccaggctatatgactagctgaacccatagtagttagggaattaacaagttaaaaattctagatgggtgcagtggctcatgcctgtaatcccagcactttagggggcagaggcaggaggatcatgtgaggtcaggagttcaagaccagcctgaccaaggtggcgaaaccccatctctactaaaaatac

SEQ ID NO: 127839 - DNA, 4068 bp, Homo sapiens
cactggcggagaaaatccccttcttttttttctctctctttttttctttttgagacggaatctcactctttcacccagactggagggcagcggcgagatctcggctcactgcaacctccacctcccaggttcaagcaattctcctgcctcagccttccgagtagctgggattacaggtgcccgccaccacgcccagctaatttttgtatttttagtagagacaggattttaccatgttggccatgctggtctcaaactcctgacctcgtgtgatccccctgcttcagcctctcaaactgctgggattataggcatgagccactgcgcctggccaacaatccccttctaaaggcaggtggtgtctccagcaccagggccatacggctgcaacacccctacaagtgccgggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagatgaagctggctactacttcttcaacggcaactacaaggtggacagccccaagaacttcaacatcgctggcacggtggtcaagtaccggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcatcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 127840 - DNA, 3933 bp, Homo sapiens
tgagtgttcctccccgtctgcctgacagctataaaggcggccgccggcgcagagccgccactgggctgcgccctcccgggaaccccctctcttggatgctctttgaagtgggagagggaggcggcgcgggggaggaggggaaggggagagggaggccgggccgcagcctctgcactcacgccgcccccgcacgcacagcgcacctggcgccgtctgccctccgcagcgctcgcccctttctctgggaggacaacctgctgacccgaagccagggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagatgaagctggctactacttcttcaacggcaactacaaggtggacagccccaagaacttcaacatcgctggcacggtggtcaagtaccggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcatcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 127841 - DNA, 1641 bp, Homo sapiens
tgactgggaaacccgggcgctggggagagggtcatacactccctagtgacttctactctatgctccagccttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatatttctcatacttttaacatactctgcaatcctccaagatattggtggaaaccctggaaatttcaaatctatttcgtctgctaatgccatgtgaatgggaaacttagatacacgctggcctacagcacatgccggcatgtgctgtaggccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 127842 - DNA, 4491 bp, Homo sapiens
tgagtgttcctccccgtctgcctgacagctataaaggcggccgccggcgcagagccgccactgggctgcgccctcccgggaaccccctctcttggatgctctttgaagtgggagagggaggcggcgcgggggaggaggggaaggggagagggaggccgggccgcagcctctgcactcacgccgcccccgcacgcacagcgcacctggcgccgtctgccctccgcagcgctcgcccctttctctgggaggacaacctgctgacccgaagccagggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagatgaagctggctactacttcttcaacggcaactacaaggtggacagccccaagaacttcaacatcgctggcacggtggtcaagtaccggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcatcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggcaaaaaaaaaaaaaaaaaaaaaaaaaaaaaaaaaaaaaaaaaaaaaaaaaaaaaaaaaaaaaaaaaaaaaaaaaaaaaaggggggggcggcgcaaaaaaagactccccacaggggggggccacaaatgatactagcacaacaccaagttttgtggtgaagcgagaggggccccccaaattagtaggaccgataaattacaacacgaagacagcggcggacgacaatatacacagacgtcgtcgagaaagagagacacacgtgaactacgtggtgtgctccttttgtgtgagggaggcacacccaccccaaactaccgcggaggaggagagcacacacattatgtggggacgaacaaccaaccaccacaacaaaaaaataattaacacccccccgaaggaggagaaaccacaaaatcaacacgacgcgagagcatatacaaaaagagcgatgtaacaacacacagccaccgaactaataatcttggccactgcatgaagaaaaaaagatgtagcaacacacaggaaagtagtacttaccaagaacaaaatattctaacacg

SEQ ID NO: 127843 - DNA, 410 bp, Homo sapiens
ggtggttcagcttctgacccagcagccgctcagagtgccagtgagtgtgcacatgcccctcggtgtctgacctttttctgtaaacaatgaggggtagaatttttgtgtatcttcacgtctgagcatggctcttcgaattcatacgtaaagaggcaggcacagatatgttaactggcttgtcgaaaagcccgcagagagccagccccagaaagcagtctcctgatttcctgtcctggtgcctgttaccctggcacaggcccgtggggcattggtgcccctcattttctctggctggtcttgaaggaattcttatctccagctcagtggttggggggcactaggggaggagaggccctctctttccttctctccacattctccctgccccgctagttgtgcctgccggaatt

SEQ ID NO: 127844 - DNA, 244 bp, Homo sapiens
tgacttagcttgaggaagcttggccgtttatttcattacagagaaacttttggtactggcttttgaataatacattgctttggagtgtgaaagacttgaatctctcatcttgaatttaattgatagttttctgttatttcacttacatgaccttttttttcagaacagattttctttagtttgatttccttttgttgttcttgcagaagtgttttctgaaaaccttattaaatagcatccccca

SEQ ID NO: 127845 - DNA, 472 bp, Homo sapiens
tcaccagctaataggaaaacgtaattttcatctgtgcagacttggctgtgagttgggggagctgtctctttccaagccctacctttccttccaccctccacccctgtcgagacacccccagggctcactctcctgatcaaatctgctctttccgaggggtttgctgtaagtcatttcactcttcttcctcaagtgaaggcttggagaggggcactgcttacccggcctgacttcagtgtccttatacgtgaaaaggcagagggtcgaagttagtgtttctaaaatatatttcagcctaacactatttaattcaatttacatcttaatatgagttaaagccaatatattacctctcccagggttgtatatacttcaaatctaatttgcaattgtgggatataaagttttcttcttggctgaagagacttacagtgcgagtgtcagccctccatccgtcggcctaggaacagtt

SEQ ID NO: 127846 - DNA, 541 bp, Homo sapiens
ccacagagaggtaggattggtggagcacacttcttcaagacccgaaagaaaggcaggcccaggcagccattcacgtccccatctagtgtgatgggaatggtgacaaccaaggaccagtgacaggagctgagcatttgagccacggggttaaaactgtccaatctagctctcccagccagggctccaaagccggtagcttttcaccagctctcgtccgaaaccctaactactactactgtcttctacaccgcagaagacaacacccatgtgattttaatgactggccactgttccaccagagtatatggcaaccaagatacccagactcttccttctctaagatgtgagcagccattaatgacccctgtatggatgcttcatttatccttatcctacatgggatccctcaggggatggtggtgtctttggaccaaattcaatctactgagtgtttttctaacagcttaaaatgaggttgaaaaaaacttccaccttctcggcaacccaacacacagaacatctggtggggttattatacttg

SEQ ID NO: 127847 - DNA, 545 bp, Homo sapiens
tcgaactgtggggctcaaggcatcctcttgcctcagcctctggatcagctgggattataggcatgtgccaccactagccagctagttttttaacaacatttttctgtagagatgggggtctcgttgtgttgcccaagctggtctcgaactcctgggctcaagcagtcctcccacctcagtcccctaaagtgctgctttgtgttttcaggggttcattgtggcttctgtgtagaaaacaaatggtgggagatggaattggtagaccagttaagacgcaagagagaggactagagtggggatatagagaggacggatggaggcttactgagaaagtacaatggctggacttggtggtcgagtggatatcagagatgagaagatgtaagtgaggtgagagaagtcaaggctgacttccacatttctggcttgaaagaatcaacactgcgggaggtacagaagggaatgatgtgtaaatgcttggcatggtactggtgaggatgatattggagccgagtcatggaatagaactataagcttaccaggtg

SEQ ID NO: 127848 - DNA, 455 bp, Homo sapiens
caaccaacaacatggataaatctcaaaactattatgcaaaggggacgtagccaaccacaaaagaatacatactacatgaatccatttgtatgaagtccaacagactgaacgaatgcttggttgtctctggagtggggatgtacactggggatgatattcattgggaaaggacataaggggactctccagtgataaaagctgtcctctatcttgactgtgctgttgaaatatggagatatacacttgagatctgtgtactctatgtatgagaaccctttccgctgttcaatggctccatccaatctatctcacttatgtcaacagattggtatcaaataaaacagcacctgttattttatgattaaatgctttacagttcaggagcctcctctccaacttattttgtgcaagcctttccctggccctgatgttccagctgcactggcctccctgaa

SEQ ID NO: 127849 - DNA, 291 bp, Homo sapiens
tcattcttcgttgacgggggctgtcccctgcattgcaggatatttacatgccagcaacacccccaacacccagatgtggcaaccaaaaatgtctccagatattgctcagcgggccctgaggggcagaatggccctgggttgagaaccgttgcattttaaattccctcatttagtacaatcctccccactcgcctgtgaaggaagattatatgtctccagttgtttgttttggagacagaggtttttttttttttttttttttaaagacaggatcccactctgttgcccagg

SEQ ID NO: 127850 - DNA, 499 bp, Homo sapiens
ctacacagctcggattccttttggggtctttgctggacttttgaaaattagggaatttctcctactctgaactctaccaggaatcacatatcaagatctcagtaccatcttacctagaccctcttgacctcttctttctccataatctctttctagctcatgtcatccagactcgagggccccattctcagtttgacactgaggacacccacgctattatctctggctgtgacctttcccacgagctccaaattcacaccatcttttgacgtctccacttaacttccccatttcggtgtctcaaacttgacaattcaaaacagaactccctcccacttccaaactggtttcctacccaactttcccaggcccccagtttctcaagtcagaaatctatgagtcatccttgatgtttgccattccctcatccctcccatccaacccattcgtaggctcttgggaatctacctccaaaatgtctctggaatccatcctcttc

SEQ ID NO: 127851 - DNA, 248 bp, Homo sapiens
tcacagggcagaagttatcaaagacaagggttaattttgataaaatcattatgtgtcagacaactggattattttatttaactaagtgagataaaaaatgggtttgccaatgtgcatcctgttattcttataataccgactagatttgtcaaaataataatgaagtacagacacacaaatgcacccatcttaaacattttgtgtttcttcttaaattgaacaagaatgtattgagtactgtttgttag

SEQ ID NO: 127852 - DNA, 303 bp, Homo sapiens
tgctgggattacagacatgagcccctgtgcctagcccagaataccttttaatggacagatttaggactagaaattaaataatttatagattatggatagttgggataattcctccttttacagtttacatatctttattttgagacaaggatttaaatgtttagtcttatatagaggagatctaagaaagtgctacctagagaatttaaatgtagagaatggactgtacctgtgagacctatggaagcgcttcatgttggaatagggaaatcaaacactaaatgctgtagttctctgaccagt

SEQ ID NO: 127853 - DNA, 324 bp, Homo sapiens
tgttggcaaggatctggggcaactggaaccctcatagactattttggttatattatataaccactttggaaaagtatagtagttctttgaaaaattaaacatatgcctaccataggatctagtcattctactcctagacatctacccaggggaaatgaaagatatgcatacaaagactgtgtataatgttcatggcagctttatttttaatagcccaaaaccagaaacaacctaaatgtctatcaatgggtgaaaagatacatgaactggcgtctatcagtacaatggagtattacttaacaataaaaagaaatcagctattga

SEQ ID NO: 127854 - DNA, 436 bp, Homo sapiens
aagaagacgcgaaatgctcaccatccaggggcagagaaactcatgtcaagttccctagcacatcaaaattaccagattaagaaacaaaacaaaatgtgtgcatgcacaagattcagaccctggactcacagacattttcagaagttttcttggaatccaattcaaatccccaagatgcagaactttccagaaacgtctttggaatttaattcatgccctaaccccaagcttcagaattttccagaaatttctagaggatccacaggggaaaggaaacttagacctcacatataaacatatttcaaaaggtcattacatttggaaagagatataaataaacatgggaaaggaggtcaagctgtgagaacccattcattccttctcagcttcaccgaacagccagcactgaatttctctgcttgttgctagttccgtg

SEQ ID NO: 127855 - DNA, 368 bp, Homo sapiens
gctgagacgattcctcagtccatgtcaccctgagaaaatccccctccaataaggcatttgattctgtggagtccgttattgcagaattttacctccactctgtcctaggcgtgttaacattcgaagtctaattctaactcttagacactctcaccacgtccttaacacgagtgagtttactagtctggacacaggagggaggcttctggaagactgggaaaccccaggccttcttagatatgagcagtccttgctgctcgtgatgaatttcatgcatgactttatcactgtccatcggaatcccgccgaggctctggaggcagagatgtcagatctctgatgacagtgaacttccacagagggcagca

SEQ ID NO: 127856 - DNA, 691 bp, Homo sapiens
gggaggaacagggaagaatggctactggatagatgaaagccgatggatctccactacagtttcccttgtggttttctgttgtagaagcagttatttttcttcatagcacttgaccaatttgaaatgtagtgtattttgtgtgttcatttggttaacacctactgtgtgcttctgcagggtggcgatccattctgcagtgttcatggctgtatccccagtgcctgttgcaggcacatagtaggagcttggtaatcatgtgtggaatgaatgacttgaatggtcaaggaaatgagagtgtgtgaaaaggaaggagacggatgtgttgtaaccatatcgttatacccaaagaagctctagaatgcttcttggagaacttggccatttgaatgattggtagaatcatgagttgagggctagaatggggcaggggttgtttgagtgtagtgtctgtaccagcaggaccagcattattagggaaagtgccagaaatggaaactcccaagttccaccccatgcctcctgaatcagaaactctgaggatgggacccagaaatctgtgttttagcccccagagtgattttaatgtatgtaatgtttgagaaccactggagtaggggacgggagaagtgagaaggtcatgcttacatagtcatagcatataaaagttactggcaggaggcagttccttggg

SEQ ID NO: 127857 - DNA, 443 bp, Homo sapiens
gaaggggttggctgaataaacgcggcatatccctgacatggaaggagaacgctgtgcctccatatgcaagcaaagttaatagtgaggagtagaaatcaaggactggggagggagagagaggtgacttgtcattttatactcctctggccgtttttttatttttaactataagcatgtgttacctttatagttaaaaaacaaaaaaataaggcaaaattgcagataactgaggtatttccatcaaagtagtcaaaagaggagatgattgaaaaggttggcatctgaagaggagcagcctggctgggcatggtggctcatgcctataatcccagcatcagacaacgtcagactctcagtatttcagagctggaaggaccttaaaggtcatctagtttaaggtgtggcaaacaatggccttcaggccacatccagtcctccacctg

SEQ ID NO: 127858 - DNA, 196 bp, Homo sapiens
tggagcggaggaatatgggaagccaggagggaagaaagtggtgctagagcctgaggagccagcgcaggccagagctgaaggagtgaggggccacgatggagaggaagaatggcatttttacgtgatcatgcccgactccacagaacgtgtactgtgtagagccaggcccacctctagccctggtaaactgaccatg

SEQ ID NO: 127859 - DNA, 461 bp, Homo sapiens
tgccatttactccatggcacatttcacaaacacacacacacacagatttatactaaaatcacaaaaaccttttaaaatgtcttgtgaaaatatattagctatctttcttagaacaaacataaagaagaatagtaaataaatgtgcagtccagcaccagtgttgacatctgttgtgaaatgtgctacatggagtaaccattgtagagacaatcatcttaggcaccaaaatgacttaggagcttctttctttgttctttcttatcacttactatttttattagtttagctttttccaaacgtgtttactcagagatacctattttagttaggaagaaaaagagaaataacaccaattaaagctaattgaggctgaattcttgtcagtcttaaaagaatcctaattgtttctctttgaactgactaatccataaaagttttctgaagccatggagtaaatggca

SEQ ID NO: 127860 - DNA, 175 bp, Homo sapiens
gtgaggggatgggaggaggcttcagaggccaagtctgctgagcacaggtgtatggacagctggaaggacccttccccacatcccaccacctgcaaggtcccagcagtgtccagcccctgtgatagtgctccccactaagccaagagcacaggtaagaggacttattgccaacttc

SEQ ID NO: 127861 - DNA, 369 bp, Homo sapiens
atgaaataacagaatgccagtgtcaacactgaccatatgatatagttatttcacttagagatgcttcctcaaagagcgtgcctttttcctccatcataaccgctttaggatctctgttttatccatgtatttcccacatagtagaagcattttccatttccatgaatattacaggctgagaaggagcacacatctggcactgataagcacactggcccaggcactcagccttctcatttcattaatctggttggtgaccgtttccatcgggcacacctggaaatgtccatcggacatattgccatctcagttgctgcagtgcagtgaattaccccagagccaccagttcacatgcccaaagatgaactg

SEQ ID NO: 127862 - DNA, 663 bp, Homo sapiens
gtggaatgatatggtttggctctgtgtcccactgaaatctcatctctaattgtaatttccacatgttgagggagaacctttaatccctacgtgttgaaggagaaaggtgattgtatcatagggatagtttactcagtgctgttctcttgatagtgagtgagttcttatgatatctgatggtttttataaatgtttgaaagttcctccttcccacgctgacactctctcctgctgccttgtgaagaaggtgactgcttccccttccaccatgactgtaagtttcctgaggcctctccagccatgggaaactgagtcaattaaacctcttccctttataaactatccagtcttgggcagttctttatagcagcttgagaacagactaatacagtactataactacttatggacaacactaagaatatcttactttgttatttagtgtagatatataattaacttcaatacattactattaatgtcataataaatcctggctctccttctttaatttttttattccttctctcctttcttctaaatattaattaatgtccttaaagtctaagatattcatgaacaaagcacacacaaagataaatcatacactattactgccaaaactacattctatcggaaacctgttagccaattagtggaagt

SEQ ID NO: 127863 - DNA, 730 bp, Homo sapiens
agggctgtatgcatctattcggctctggatcctggtttcttcctatgctcttgcctaaagcccccttcaactgagagtgtttatggaaaacaaagagctttgcttcttctcggaatgttctatggacttcttgccatctggtgcctgcagtggcgtttctccctgtgaggccctggggcacgctgtgctcactacctgaggtccctttgccgcaccagctgcttctgtcaacgtagtggctcagggagagtaactcaatgatcgaggtggacacttaggctaatgaagaggctctcaagggacagaaacaggacacctctgtgctcccagggtgcctctgctgaactcctcggggcaagtagtggaaagctactcctggtggcttgaccaggtggggaacttgtttcagaagccagcagacgaaggcgaggcacagaaatggggacttcaatgtcctctggactctctcatctcccttctctgcctccctctgaagggaaacttgcttctgctctctgcagactgccattctttgccttgctgctgctcaaggcaaacagacaatgtggaaagtgactgtggaatgaaagactacctctatcattgccaattgtaaattccttcgtgggtcaagcatctgtccgggtccaatcagcagagactgcagggtaaaaggatgcctcactgcacaaaatggctgccagggcccacagttctggattgggaggga

SEQ ID NO: 127864 - DNA, 570 bp, Homo sapiens
cgaagagggaaatagggaaggttttagttagaaggcacatcttgaagagtcaatatgccttctcctttaggtggagagtcagtgcaagaaataagcattcaaagcgtaaggaatagcatgtgcaaagctagtttggtatgactggagtgaattatggaaagtgatagaagaggctagaaaaactaggcactggccagattatgaagtctttgattgccatgcttagaagtttggattcattctatcctgaaggcaatacagagttccaaaggaatcttaagcaagggagtgctgtgctcagaattctgtgttacaaagaggagcataagatacattgggtttatgatttggaaatttgagtggctggtagtgcacttaggcaatatagaccaaacatttggaaagcagaattggatgaaaatgacaggtgaggtgcttaattctgatcctgtgagtctgaggcacttgtaggccatcagggagaactgagcaagaaatataagtgtacagtgtagaagacatcagtgtaataatgtctgaaggcttgacttagaaagaagatgtggagtg

SEQ ID NO: 127865 - DNA, 293 bp, Homo sapiens
cttttctgctagtgaggttcttcttttaaatttttttattatggccctgtgcctatcagtgggattcaacaattaacaaggttttgccacatttgtttcatttatcctttatcttttacctttctttgctgaggttttgttttgttttgtttttttgttttttgtttgtttttgagacggagtgagactgtctcagaaaagaaaaaagaaaagaaaaagaaaaattcaaagcattcagttcagaatgcagctgtgacttctgttttctgtgtcttcattttctctatttcaat

SEQ ID NO: 127866 - DNA, 599 bp, Homo sapiens
gggtgtggagggattaaatttattagattaaatgaagtattttgaaaaataaaattatgattatcccataaaattcagaatgtactatccttacagaaataatataaagatattaaataacttgttctttaactcctgagagaaacaattgttcataaagttgcaagcatattctgtgttgaattgttgaatttaaatagctatggttcacacagtccatatttcaatatttcacatacacaccaaaaatgagaatacaaccatgaaatgaaaaactatcataagtcatgcctgttttttaaaagtgcaaaatcactaatttcatataaaaatggataacagaaaaacgcaagtcttaaaaagctacaagtaaaaatgagcagaataacatctatagagacaatcaaagtatgccaaagacatgcaggtaaaacattaaaaagtaacaaatggcagggcatggtggctcacacctataatcccagcactttgagaggccaaggtagttggatcacttgaggtcagtagtttgagaccagcttggccaacatggtgaaaccccatctctactaaaaatacaaaaattagcccggcatgga

SEQ ID NO: 127867 - DNA, 669 bp, Homo sapiens
tgcggtggctcacacctgtaatcccggcactttgggaggctgaggccggcagatcacctgaggtcaggagttcaagaccagcctggtcaacatggtaaaactccaactgtgctaagaatacaaaattagccgggcatggtggtgcatgcctgtaatcccagctacttgggaagctgagacaggagaattgcttgaacccccgaggcggaggttgcagtgagctgacattgagccactgcagtccagcctgagtgacagagtaaaactctgtctcaaaaaattaaaaaaaaaaaaaaagaatgaatgactttacctcctgccactgtgccccttgcacagaaggctctaaccatgcttggcatccttgctattcctggaacagctcaagaatgagtttacctcaaggccttctgaacctgctgttccctttacctgggaacattcttccccgagcaagctcccagccatccctgaaattcttttcaagaccacctcctcaaagtgcacacgttacacatatctgattgttctctgtacctgtaggccacagaaatactctgtaacaatactccatccctaagtatttctcttcacagcacttctcatcaaatgacaccttatgtgaacatgtttgtttgtttgtttctttgcttttgagacacagtctca

SEQ ID NO: 127868 - DNA, 180 bp, Homo sapiens
gaacaacaaaaggcttggcaggtaggttcacatcatcatttctcagatgggagagcagacaagacagaagaagagacctgtctaacatcacagagtggggtcagggagtagatccagggctcctggtacctagtccagagtgtttccaccatcttcaaggtctagatctttgggtgtcca

SEQ ID NO: 127869 - DNA, 740 bp, Homo sapiens
gataaatgaaaacacctctctggtggcatattagaaacttcttgggttcgaatgctttgtattggggtcattttcacaatgtgtttcccccatcacaccactgcacttcagcctggcaacagagggagagaccctgtctcaaaaaaaaaaaaaaaagctgttctgaataaaaactaagtggattagtgaaatgagagtagaaagaaattactatgatgataaagacaatttttcaaagccaacagccaatatcatactacatggtgaaaggctgacacattcagattatcaggaacaacacaagaataccttttatcaccactattattcagcattgctttggaagtcttagctaatgcagtaagctgaaaaaatgaaatgatgtaaacattttagaagaattatctgtatttatgggttatataattgtacaccttgaaaactcgtgagattctcgtacaagaaatacttgaatttataatagaatttgggaagctagctggataaaaaagacagaaaaataacattttctatactgacaatagctagtttaaaatggaaatggaagttatattccctttctactttaatgatacaactataaaaatacttgggaataaacttaacaaaagtgcaaggtccctaaaaaagattttattgatgttataaaacggagtgtaaataaatggagggacatggcaattctaggatattaagacaattttggccaggtgctgtgc

SEQ ID NO: 127870 - DNA, 393 bp, Homo sapiens
actgtgagaaataaatttctgttgtttttaaactacccagtctagcgcattttgttatagtagccctacaaactaagacacacaccccaaaatacttcagcacatatctccaaaatttaaagccattctcctaaataactacaatgccattctcacacctactaaatttaccataatttcttgatatcatctaatattcaatgatattaaaaagttgaccacttaaaatagttccactgtaaccaaggatctaagtgcacaggctagaaaccattggcctatgagtcacatgtcttagggcagaaataatatatataaactccagaactatacttctttcttaaaagaaagagagctcagccaggcgcagtgtttcacgcctgtaatcccagc

SEQ ID NO: 127871 - DNA, 635 bp, Homo sapiens
gccaggcgcggtggctcacccctgaaattccagcaccttgggaggccgaggcaggtggatcacctgaggtcaggagtttgagactagcctggccaacatggtgaaaccccgtctctactaaaaatacaaaaattagctgggtatggtggtgcgcacctgtaatccgagctacttgaggggctgaggtaggaggatcacttgaacccaggaggcaaagactgcaatgagtcttttagaaagcagaagctgagtctgatagaacttagcccgtgaccttaatgggtactcggcagatgcagctgcctggctgattcgagaacaggacaggcatggaccctgctttcggagcagtgctgtggaatagaactttgtgcagtgatggaaatgttctgcatcttcactctcccttatggtgggcactagccacgtgtgaaacgtatctaatgggactgagaaactgaatttttaatttaagtagccacaggtagctagtgattaccatagcaaatgctgcagttccccgggtttttagtcttgattatacctcccagaagttgtctgctccaaaggtcaacagttcagcaggaagcagagcccatgcctttgagaggctggaggtattgcatactcccaaa

SEQ ID NO: 127872 - DNA, 432 bp, Homo sapiens
taatttgatacatctttacacacccaggcctgctttccaaaggaaaaagagctccatagcccacaaagaaatgctcaagccaaaaacctgaattaatcatcatatcatcggtatgaacaattcaagtttattctgtgatgaagacaggatgaattgatcctatcaatcagcatgaaaacccatgttcatactgagaagttaagccaaaaatctcaactcaaggattcatcactcttagcaagttaggatatttttccaacttttttctcctggatataataaaattggtcacattatgataatataaaaactgaccactcaaaaccaaatttactatgaattaaccaaaggccttaggtttctctctctccaggttacctttttggaatcgctatttcattgatatccacgctagctgactggaaaaggtca

SEQ ID NO: 127873 - DNA, 370 bp, Homo sapiens
aggcagaacaggctgggcatcaccactgctggccactacccagccacgccagatttaggtcagggaaactcgcgggaaggaagaccccagggccttccctccccagaggtggagagcacaggccacagtcagtggtggggagagccagggtgtccccagagaaatgggaggatccaaaccacaacggaacaaaaggcaggcggactcggggttgggcaggggggcggggcgcctgggagctacagccagccctctgctggcctgggagggaagttcacagcacccgaacatagtcaaatggggttttctccacccccaaaggaatgcaaaccagggaagggaggagagatcccattaggctgagccctct

SEQ ID NO: 127874 - DNA, 646 bp, Homo sapiens
ggctcactgagctttggattccaggtccctttcccagcacttagtcccatttttaattttcaggaagtattgttccaaaacttggctcagacttatcctctccttggattcctttctccatttgttttctcggttttgctcacttactctttaacttgcacccctctttttccaaggtggtggattagggggtgttaatgctggggcagtgttaggcacagaacctaggagtcatctccctcactccgggaccgcatcaatcatcagtcacagacatgacagttcatttttccctcctgaacgcgcctgcacagatgggtgtatcgctcaagtagccaaatggatgtagctgttgggggacagggcctgaggggcagcagggagagaaaagaacaaagaaagaaagaagaatggttctttgtggggcagcaaactttcttctggttcccagcctgaatgtttctgatctggttttcttctttttgtgatgtttgaacttgtttcctcaactcagatgctgaactcttgtccaaaaaacctaagggcagcatagtgtgagagactgtgggaggcaagtccagcaatccagcaaaaagaattgcagaactgtgaagataaatgtgtgtccgtatcaggactgcgctgg

SEQ ID NO: 127875 - DNA, 279 bp, Homo sapiens
atttcctgtttctaagaaaatgggcctagatgctcagctacattaaccaaacaacatgttgacacaaatgaatctgaagcttgcccgctccaggctctctagaaggtcaggtttgggaatgaaggcatttgggtgactttccaaactctgaatcccaagcccagtgactcaggccaggtattaatttgagggatctgcttccctcctcttcctgcctaagaaggccccactaagtggctagagtcagaggctccctggtcatcttgagtagtgggaatg

SEQ ID NO: 127876 - DNA, 674 bp, Homo sapiens
ctttcaaatttagattttaatatggttccagatataatatgatcatttatattcaggtgtgaaactatttagtaattcttaggacttttggcaagacctgcctcattaagtggtaatgactgattcagctatctgaaaatatttttgttataagatttcaaattcttgccattggaaaaggttcaaagacatttaaaaatctagtgaagtttgaaaaagaggatgaggaaaagtaaaaggctgttaaccttggggtgtagtagtgtagtaagacttcctaataaggcatttggcacaaaatttactctccatctaagtaaatgcaactatgattttataaccaagaatattatgtgtcatgtttagtttaaagcattcattcatttgcagaaatgcgaaaccttgctcttgtcagtcaactccagatgctggtgtgaaatggccccaaatagtgacggccattggaggtgggaaaggtacatgccaagagaaaggcttaggaaatagcatttaataaatactagcctaagggcaaaagcacattgaataagaaaactctgtcattaggccgggcacagtggctcaaacctgtaatcccaacactttgggaggccaaggggggcagatcacaaggtcaagagatcgagaccatcctggccaacatggtgaaaccc

SEQ ID NO: 127877 - DNA, 368 bp, Homo sapiens
ttctgtatttctgacctggccatacctccgtacaaccctaagcaagcccacctgcaaaactacttagagaggggaaaaaagaagaaaaaaataaatgtcaaaaatgttaacagatgggagaaaataaacaactatacgggacactatctcaagcttcaataaagttgaagtcaaacagtatacacaactgaaataccctcctctgattgaagctttcgcttcagagtctttgagaattattcaaattatttagaataaaaagtaagaactcgaggtagaatagaaacttcagcatctaccaagtcaagaagataacttggaaaacaattctgactgacattccaatttaatcacacttaatgaattct

SEQ ID NO: 127878 - DNA, 484 bp, Homo sapiens
tcaaatgttgaagccattcaaattatgtgtgttataccccccaaaatggaaaattaagacaatatggaccaattcttagagacacataacttacaaaaactaactcgaaaagaaatggaaagcctgctcagccctgtgacttaggggaagtcactgccagctacaaaagaaaacccctaacacttcagtggctggacacacaaaatgtattactcacacaacgtccaacttcaggaataacaagagatctcttctaacagaagacaaacagacttcctaatcctgtgatgcagctgcccaggtcactggcagggaagctatcacagtgacgcaccagctcccgctgctctggccctgaaatgactcacctcagtcccacacacaggctgttgctcagtagtcacacggccccagcccaactcagggatatgcagcgtaaaggcaggggggacataaggatggtctgtgtgaacggttctgccac

SEQ ID NO: 127879 - DNA, 314 bp, Homo sapiens
tcaagtgaatggtgtgacttttttcaaatgatcaaatgctgcccaaagattattaactaagtacagaaaaatgtcccatttcattacagacaaggtcttccgaacgtggctccacccagaacacagcagtcccagtacgcatgccatgatgggtttttatgcccagcttataataagaagatattcttaccaggaagtggagaatgcatctaatttctacctctcccttaatgagatgaaatcagttatattaaacagaaaagtacagtcaacctgggctattaattaggaagatctaaacaaatctgccctca

SEQ ID NO: 127880 - DNA, 441 bp, Homo sapiens
atgccaccatgcccagctaatttttgtatttttagtagagacggggtttcaccgtattggccaggatggtctccatctcttgacctcatgatccaccctcatcagcctctcaaagtgctgggattacaagcatgagccactgcatctggccaatgttttaaattttttgtagagatagggtcttgctctgttgcccaggctggtctcaaagtcctatcctcaagtgatcctcctgtttcagccctccaaagtgctgggattacaggtctgagccactgcacttggccagtagctgttctaaagtctttgtctcctaattccatcatctctgcattcctgagtctgtttctatggactgatttttctcctggtagtggcacgcactttcctgctcctttggacgtctggttatttttgaatggccatcgtggtgagtgctac

SEQ ID NO: 127881 - DNA, 296 bp, Homo sapiens
ggggtcacgggaaggcttcctggaagaggggccatattttgtatataaaaaaaattagcaacataaaggaggtgggaaaaattccaaaccacatagcaattgctccttgttcacgggacgcatgaatcagaacagcaacatgcaccaggacagagaggagggcacaatgccagggtgcgggttgcactaccagcctagcctgtggggctgctttttcccctaaccaccaaccctgtctctcaccacaagcagcacctgaaacacactggtcctaaactccaagcaggtggtaacct

SEQ ID NO: 127882 - DNA, 568 bp, Homo sapiens
cggttgctcccagagacaggaactcacagagtacgagaaacatgcctgagagccctccacatctcaggccctaactcagggcctggcttgtcttaggctctgcaaacatagcacagtgacagttgttgaagtgtagcagcagctttttgcagggaaagagggagttgtatttattgcttctccatgacatggttcttttctcattagttcatgggcaagtcaagggaaagagacctaggtagcagctgagtctgtagcctacagatggcctgggctggcttggctcagtcacttcccttagtcacttccacacattccagaaattgtgtttttcttacaggtgacagaggaagttatatatggaaggtagggttaggggcaccaaccccctgtgcaattgacaatccatgcataactttgaccctccaaaacatagctaataataatagcccactgttgactggaagccttaccaataacataaacagactagtaacctgtatatatcttatgtattcatgatgtacctttttctgaaattaaaaaaaaaaaatttctgtgctacaca

SEQ ID NO: 127883 - DNA, 284 bp, Homo sapiens
ctcccaaagtgctgggattacaggcatgagccactgcgcccggcctaaaattcaaaattttaagggagagtcctatgggtccttatggagaattagtttaacagattttattgccagttcctttgtaaggtctggagaagcaagaccccagaagagagaagatggcccaggtggtttcatcccagggccttgccttctgagggtgggggtggaggtgtgtgtgggtatggatggggagtttaatcatctcatgttttgggaggtgaatgtgaacttaatgctgg

SEQ ID NO: 127884 - DNA, 351 bp, Homo sapiens
aatattattgtctgtaatttaatataggagaatgtttctaagcctacaaccttgcatgcagaagcagtttttcaagcattaatacttaaatgggtcatagacaccacatctgtcattctgtcctgaagtctatgaggcaaaaccaagactatgctggcctattgatttttctagcatttgctttaatttacttaaccattgagaaatccatcagtacataaacggcaactgtccattactgcctcatttgcagacattctttcccctcgtttttggtaaatatttcccttaaattgctatgtgtttacagtgtaaaaacgaattaggaaactgctcacacctgtttctgtt

SEQ ID NO: 127885 - DNA, 585 bp, Homo sapiens
gcgaattcactagtgattgtgagctgagatcgcacccacttcaaagtcaccagtctactcttttgctcaagtatccccaagttcattcttcccatttcactgtcactgctcatgaatgcaatgagggtttacttccctccaacctggctggtccctgcctggcactgaaggggacctctaaacaaggacctttcaatgacccttggcagagagcagcaaaggctctgcaatgcccacaaagccctgagtctggtcctaatcccctgcaccttcctccaagcagtccacacatttggcataacacactttattagcccctggatgcggaagttcccataccttctcacaggagtcaattctgcaacttctgggaatttcgttagccagtttactttttgttggtggcttgaagtcagtcatagtgggaagctgacaaaggctacaaatcaaacctcttgcccctggagagccagttgttaagcactgaccaggaggccatcacctggatactctcccctcattctttgttttctttttctttttctttttttgagatggagtctccctctgtcacccaggctggag

SEQ ID NO: 127886 - DNA, 672 bp, Homo sapiens
tgtacatatttgtaaattcttgcattctcaatacagtatgcatcccatgaagaactggtggggaataggttcaaatcagatagtttagttatatcctgttgctgtggaagagattgggtgattgaaattttaatatgagccaagtaatattccagcttttaaaaattaacttttaaagataatctaacctttcagtttggttatacttttggataattgaagttttgtatgttttcattcttacgaatatttgcaaatgaatatagtattgacaagaaccactttgccttgccacataattccactagcttgaagctgggtaaacttgaaaagttcagcatactctgatttatacaacccagacccttttgtaaattacagcgtgagtaataataatctttcctccttactgactgcaggagtgtcccagggaaatttacctagtcggaatcctggactctctgcttaccattccttttgttttggctcctctaactcattttcctaatgctcccaagtattccgtggaataaatcatatgtggatggatacataatgttgtaagccttgtgcctgtaacctaaatttgagacttcagaagttatatgcctttcctctgttatactttctacccgtaatattgcatccattatatcatgctattacatttaa

SEQ ID NO: 127887 - DNA, 803 bp, Homo sapiens
gaactattttaaattcctgtcagcaatgtgtgagaattctagttgtctaccacatctttaccaaaaattgatcttaattagtgcctttaatttaaccatttggttgtagtgtagtggtgtcgcattgtggttttcatttgtatttttctgatgtctaatgatataaacttcctttttcatatgcttatgagtcatttgaaaacactcttttgttgtgtgtctatttccagtatttctccctttttattgaattccttaaatttgtagttctgactaagtcccttgtcatatgtattacctatcttccaaaaatcttctcacagtctgtggcttgccgtttcactctattgtctttgttgaatagttcttaatgaaatccaatttattacgcttttctctttagcactttatatatcttgtttaaaatgttttaacctatctaaaataatgaagattttttttttctagaagtttcattgttttagttttcatatgtaagctatcacaatttttattttggtgtgatgtgaagtagaggattaatgcttctttttattttaatggattccaattgacacaatactgttcaatgagaagactggctcctcttgcactcaattgcaatggcacccttgtcacaaatcaagtgaccaaatgaaaaccatttcttatgcttcatttgtaatttttctttgccatgtttataggttttatatcaagaatgtgctgatctcgtaaaatacgtagagaccagagggtctcctttatatgctctgaaacatctgtactttagaaattatata

SEQ ID NO: 127888 - DNA, 272 bp, Homo sapiens
cagaaaaataaaggggcctctgtccccatgtctgagaggccacaagagcagcctctctccaggtttcttgtacacaggacagaaatgaaattctcccttattttggtgttttgttgtctgcaattgaatgtaatataatctgttaatacagtagcagagtagcagaatgattaaaaagtgagctctggagtcagactgctttcactccattccttacgctgtcacctcttaagcaggagccttaagcaaaggagccaaacctttcagaatcc

SEQ ID NO: 127889 - DNA, 188 bp, Homo sapiens
aaactggagccttccgaaaggaattcactcatcacacagcaagttagagggatcctaaaaccaaaccaaatctagacacagtggctcatgcccgtaatcccagcactttagaaggccgaggtgacagtatggcttgagttcaggatttcaagaccagcctgggcaacatagagagaccctgtctctac

SEQ ID NO: 127890 - DNA, 165 bp, Homo sapiens
atataaatcttcataattcaggtttgtcaattcataaaataacttgctgggattttaatgggatgcatgactatatagatcgacacagtcctttgactcctccagcaaccagtctaaatgtggaggatgacacacacacaggaagagaggtggcatggacgaagt

SEQ ID NO: 127891 - DNA, 357 bp, Homo sapiens
aagtggaaccatgtagggtttatccttctgtgattggttcatttcacttaccataacatcctgtaggttcagtcatgtttttgcatatggcaggattttctgctgtattaaggctaaataatatttgatggtatatatgtgccacattttctttatccattcatctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactctattccaaag

SEQ ID NO: 127892 - DNA, 517 bp, Homo sapiens
agaccagctttctccatgtgtctgggaacataagaaacaagtttctgcaataattgttacacagcttttccagagagggaccaaatctctgtcgtgagtgggtatctgcatcatttcgcaggagggaatgtgatgtcctggcttggctcacaccctctgtgggtttaggcacgggttcctgctggatccctcactgtggccagagagggagggctctgtttcaccacagggcaccagaagaggactggatcgtgggaagaccaggtaatcataatgctattaataatagcagtaatcatattgttttatacattgtatatgtcataaggattttaactttcatgtaacataattgctgtaaaagtttccccagtttgttttgtgctatttacctggtgttaaaatgtttaagaatttacatattaggtacgttaggtttattcctttttatatggtttctgtttgaaattttggttttagaagacattcattctcaaggtcataaaacacacacatc

SEQ ID NO: 127893 - DNA, 174 bp, Homo sapiens
tgctgggattacaggcgtgagccaccgtgcccggccagttgttttttttaaatgtccttattggccaataaaattggcagcaatactttgtacttctctttctgtgtctgtctgtctccccgtcctttattacctttcccccttctcccctactcctttgctttgtctgtctgc

SEQ ID NO: 127894 - DNA, 148 bp, Homo sapiens
agtttaaactagtgtcctaaactatagcattcaaaatgagataatatgctaaagtaatacacaaaccaaaaatcccagtggctaacacaaaaagtttttcttattcattttacatatccagggtaagtcagtaatagacgcagacaca

SEQ ID NO: 127895 - DNA, 577 bp, Homo sapiens
taatagttgaggtttctactccacatcactatagatggcagatgtctgctctatatacagtcttggctcatcgtaaggatataaaaatagaactcagttaccaagctttaaaagagacctagatgtaatggattaatttaacttactgctgtgtctatcaaccctgtcggtgtgttagattcagatgggacacataaactgagaaccttaaaaaaggacacccaagtcagagagaagcacagttaaaggatgttctcaagagacctcactaggcagggactgcagactaatacctgttaggttagataatatctgtatcctctaggggcaaagtcatttaagggctatgctgggctccttgtcagaaacctgtttcctcagagtccaaatataaaagttcctgcatctcctggttaattcacatgtatatattttggaggagaaaccctaattttattgtctgtcatattattcaaaaaaatctaggccaggcgcagtggctcacgcctgtaatcccagcactttgggaggccgaggtgggtggatcacgaggtcaggagaaggagactatcctggc

SEQ ID NO: 127896 - DNA, 328 bp, Homo sapiens
ccagaagttcttttttaacccaaaagttagagaattggcatagctactgacattgaaagaggaaatgaagataaggctaaaaacaggaggacttgttaaaagtctgtttaggatatatttaccctcagatttttctctcttacttcatatacctgtgccactgcttctatcagaattgcagctgagcactggagttttagtttctgaaaatggtaaaatagagattccttggactgagggacataagtcatagctgagtgtgagggctgttattctgaaatcaggcaaagtttacattaatgactgctgacacttctgttctttttcc

SEQ ID NO: 127897 - DNA, 382 bp, Homo sapiens
tttgaccacatcttgttctgttgcccaggctggagtgcagtggcacaatctcggctcactgcaacctccgcctcccgggttcaagtgattctcctgcctcagcctcctgagtagctgggactgcaggcgcacaccaccatgcctggctaatttttgtatttttagtagagatggggtttcactatgttggccaggatggtctcgatctcctgacctcaacctcgtgatccacccgcctcggccacccaaagcgctgggattacaggtgcgagccactgtgcctggtcaaacagaatatttcctaagggttcatcctgctccacagtctgaggttgttatttgttaattaaataaatatttgttgggcattgaccatgtgcca

SEQ ID NO: 127898 - DNA, 712 bp, Homo sapiens
gaaaaatgaattttgctgcttagaaaagaaaatcatttaaaagttatcatactagaacattggtaagaaaatggatagagaagaaattttttgggttgtggaaaataagataagcaagaggagagtcaaaaattttgagccctagaagaatatcttaatattgttttgtgctcaataatatataacttatgagaagaaagagaaaagcattatgttcagataggataaggagaaacatttatatgaatatatttttaaacttctagtatgtaatttcagcaccaagttagaagctgtgcctagaattttgtttttgagtatgaaatgaaatgagaaggtagcaattggaaaagactaaatctaagaatcattcctggagaggtatggcagaataagctggccatatgccatgagtacatggatttgtgtatactgctctgtatcctgccattatgctaaactatcaataaatctgctgtccttatctgtattcctcagtacataagattttttattctctctggttgcttttaagaattgttagatggctgggtgcagtggctcacacctgtaatcccagcattttgggaggctgaggcaggtggataacctgaggtcaggagttcgagaccagcctgaccaatatggtgaaaccctgtctctactaaaaatgcaaaaattagctgggcatggtggcaggcgcctgtagtcc

SEQ ID NO: 127899 - DNA, 325 bp, Homo sapiens
atatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaat

SEQ ID NO: 127900 - DNA, 203 bp, Homo sapiens
aacagggaagcagcagtgcctggagtgctgagttcagttctggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctcttta

SEQ ID NO: 127901 - DNA, 356 bp, Homo sapiens
tacgggctcactggactgcatggtcaacatggaggtctttctgagttgtgcaaaatgttcttctcaggaagcttgactgctgtttgatgttaacatgattgaggagtttaggcttgactaaagtcctttggtatccctgtgaaataggactttgtgttagtacattctcacactgcaaataaagacatacctgagactgggtaatttataaaggaaagaggtttaatggactcacaattctgcgtggcttgggtggcctcacaatcatggcagaagatgaatgaggagcaaaggcatgtcttacatggtggctggcaaagagagaacttgtgcaggggaactcccatttataaaac

SEQ ID NO: 127902 - DNA, 549 bp, Homo sapiens
agcacagtggtgcgattacggctcactgcagccttgacctcctaggctcaagccatcctcctgcctcagcctcccaaagtgctgagatgataggtgtgagccactgcacccggcctgtatttaaatcttgaaaggtttttggcaaatgtcatttcaggtttagtatggttgatggcaagtggttttgtttttctgacagcggaaggaacggcttttcctgttcttaaaaagcctttctagtttgtgggaatgagagcgccattgacacagatgccactgcgcttcgtgcttgctgcggcggggggcacctggcggagctgctctcggtcacatccccacaccgctgtgtaggcttgctcaaaccttgccctccctccgacattggaggacctgctgagccacatgcagtgtcttgggacacagaaggcagacatggggtccccctgactttctggtggcccggtggggaggacagtcatggaaacaggttgctgcaaggtggtgctcagagggggactgacagtgtgtggagggaccccggagcaggag

SEQ ID NO: 127903 - DNA, 855 bp, Homo sapiens
gactcagcatggtgccagctgcggtggtcaaggcagagcccatattgcctctccccaaactctgggaaacccagcatagagaaagaatccttttgcttggggaaaagagaggaaagagagcaaaagattttgtctaggaacccagagaattctcccttatcttcctaaggtccaccaaggctgtgtttctaggagtctgcaagagtcatagagttcttgggcttagggttcccaatagtgctaaaacagctttagtgaaaacaggcttaggtaaaaacactcagtctcctttggattcctagaaagccctctcaagaagaataggtaaaaacaagtccagactctgaagactggaataaatatctagctcttcaatgtccagacaatgatgaaggtccacaagcatcagaaacatccaagaaaacatgacctcagcaaatgaactaaataaggtaccagtcaccaatcttgaagtaacagagatatgtaacctctccgacaagaaattcaaaacagctgtcttgaggaaatgcaatgaactttaagataacacagagaattaatcagaattatatcagagaaaaaaattttttgagacactctcactagcccaggctggagtgcagtggtgtaatctcggctcagtgcaacctctgcctctcccagattcaagcaattctcctgcctcagcctcccaagtagctgggattagaggcgcctgccaccatgcctggctaatttttgtgtttttagtacagatggggtttcaccatgttggccaggctggtgttgaattcctgacctcaagtgatccgcccaactcggcctcccaaagtgctgagattacaggtgtga

SEQ ID NO: 127904 - DNA, 841 bp, Homo sapiens
gatggtccccactcacattgggtgaggacagatcttcctttctcagtccaccaattcaaacgccaatctctttcagaaacaccctcacatacatactgagaaataatgctttaccagcaatgtgggtatcccttaacccagtcaagttgacacctgaaatccaccatcacgagttggatccttagcatttttattaagagtattttgccaccagtctgtcactgaagcatctttgaaacattaatttcaagataactttataaacatattatttaatttatattctttaattttagggagggtttaaataaaatttaaggtctttcttttttatttaaattataaactactccaatgaagactcacttgcttataaaatgaatagagcaaatgtgtcttctgaacaactttcattacccatgggcctccctggactattcagtaatttgttaaccattgttgggacagccttagagctggttaagtaatctatttttcctacaaccacaatatctgatcagttattttcttctcagaatctgaagttataaaactgattctctcttctgcctgagctgtgtctttgatgttatggtatttaacataagtgaaccattatctttggtaaacttcatcattatgcttttctgttcacacatgggtatcatcggtcatattaaatttttccacctcgtagcagtatcaaaggtagatttatggagtgctaaaggaaatttaaatttctgagcccctcactttcacagaccctgtgtgggtgctgggggatgctgggagaagagtgttccaattgggaagaggaaaccaggttaccaccaagaag

SEQ ID NO: 127905 - DNA, 815 bp, Homo sapiens
gttttgttttgttttgtttttttgagatggagtcttgctctattgcccaggctggagtgcagtggcatgatctcagctcactgcaacctccgcctcctggttcaaacaattcttctgcctcagcctcccaagtagctgggattacaggtgcacaccaccacacccggctaatttttgtgtttttagtagagatggggtaccacccaggctggtatcgatctcctgacctcaaatgatcctcctacctcggcctgccaaagtgctgggattacacgcatgagccactgagcctggctgacaagatttggtgatggcttagatcagggaggaaggaagagtcaaagcttaagtatttaggtggatgtcatgcattttgataggaatgggcgtgttggaggaaaaagttaaagggaaaaaaaaaaaaaaaaaaaaaaaaaaaaaactgtgtgtgtgcgcgcgcgcgccctgcggcctccggaaaaaaacctttcgagaaccctatcgcgttgggggggcgcgcggggcccccgtgggcgccaggtggaacacggggcccaaagggcgggtccccgagaggagagaacacggggcgcatagaaacaagagggggcgggagattttctctccacccactatataaaaaataaacgcccccggggggggggacacgcggagcgtttttttcttagaaacaaatatctcccaaaataggggacattctcacgagagggagagcaaataaacgcggggagctccttttcaaccaagggggggaggtcccaaggggagaggtctgccgatatttcaaatttagg

SEQ ID NO: 127906 - DNA, 494 bp, Homo sapiens
acgcggtccgaactcggcaggcacaagtacggcagtaaaattcatctctctggcatggcaccttttcacatggatttccaaatctgtcctatttgtagctacttgcccacagtctgtacaagcacacaacgtctgagagccagaagctggcttcactgtcagggaatgcagcccggagtccggaggacgggcactcccctggccctgctctgcctcctgggtttctgaggtagtcacacacactctctgcacactgctgcacgcttccaggtgtttcagcactgattctgcatcgtgtgttttcatctgtgttctcaagtgtttcatatacatcctctgagtttcacttgtacctcttttaattcctaaaagattaaaccttttctttgcctggcccttcaaggtgaaagtgctgcttcgtcgacgaaagctattacccaacacgagaatatttcgctcaggtcttggcctcgaggttacactgttaccgtgtg

SEQ ID NO: 127907 - DNA, 302 bp, Homo sapiens
gaattccggctctctgggttctttattctaattcatggatcaaattgtctatctttacaccaacaccaaactattttgactacagtagctatatattatgtcttaaaacaaggtggtataagtcctttaactttcttatttttcaaagttgttttggtgattttattttttatttatttttaattatttatttttttgagacagagttttgttcttgtcgcccaggctggagtgcaatggcatgatctcggctcactgcaacctccacctcctgggttcaagtgattctcctgcctcagcct

SEQ ID NO: 127908 - DNA, 483 bp, Homo sapiens
ggaaaccctccagcaaagacttgggtcatcttgagttattctgcagtttagcagggtggggtgaggtggaatggaggattttgacctggaggtccccagatcccagccccagatgcacagcacacacatatatgtatgtctcaactgtttcttgttctagcccccagcccatgaggcccccaagcctcaggaaggactgttgtattaacaaagaaactctctggctctgtcatttggggcaggtggagtaactatctgccattactgcatctggttactagatagatacttgatctgagggtacctttttatttttttgagacagggcctcactctgtcactcgtggagtggcatgatcttggctcactgcagcctctactgagttgggactatagacatgcactaccacacctggctaattgcttttttagggtggggggcgtattttttgtgtagacgagttctcaccatgttccccaggc

SEQ ID NO: 127909 - DNA, 480 bp, Homo sapiens
catgggacccatacaaagtatcattaatgatgttggaagcactcccaagaagcagagagagtcataacattgtaagaaaaagctgaattgcttgatatgtattacagattgacacctgtagttggggttgcccaccatttcagacagatgtttcatcttgtaaacagatgacataaacttttggtactaataaatacaatgcagtactgaaaatgtattttctcttccttataattttcttccttttatttttctttgagacagggtcttgctctgtcacccaggctagagtgcagtggcaatatcacaatttacgacagccttgatctggcgagctcaaacctctgagtagctgggaccacaggtgtgtgccaccacgtctggctaactgttaaaaattattttgtagagacaaggtctccctatattgcccaagctggtctcaaaactcctgggctcacgtgatcttcctgcctctgc

SEQ ID NO: 127910 - DNA, 325 bp, Homo sapiens
aaaataaataaaaataaaactgcagcctttactccatgcttgtcattactgtttgtgtacacagtgttcttgaaatataaagaaaaaatatgcctgcagtatcagtcacccttacagtcatccatgaaaaaaaaaaacaatcaggccgggtgtggtggctcacgcctgtaattccaacactttgggaggccgaggcaggcagatcacctgaggtcaggagttcaagaccagcctggcaaacatggtaaaaccctgtctctaccaaaaacacaaaaattggctgggtgcggtggctcacacctgtaatcccagcagtttgggaggc

SEQ ID NO: 127911 - DNA, 469 bp, Homo sapiens
atttgtttgttgaaattaactcgagtactttctagtattaatagaaacttatttgagtttcctaaatgaggacttcttcaacctattcaggtgtgacatgtcatctaagttaataagtggagcaaaaaataaaaataacagcatcaagcacaaaaattcagtctctggagactgagagatttggatttggattctaagtccagttcctctgcctgcttgttttgttaccacaggcaagtaactaatcctttactgtgcttataataatacttcctacgatctttgaatgttgtgaggattaaacaggacaatgcaagtaaagtgctatgcacagcccctgacacctagtaaatatttaataagtagtagctgttgttaatgctgctggactctaaaattcataaggctctacaacatgtaaactagcattacacatatcacaacaatggatttttcatttatctatata

SEQ ID NO: 127912 - DNA, 259 bp, Homo sapiens
acattctctatcttgataaggatataggctacagtgctatgttcacttctcgaaatttaagctgaacatttaggactcgcatatttcatattctaccccaattttcaaaaatagaggaacaagagagattcctaggtaagacaaccttcgaggtgcaagacagtttatttttttttcgagacagtctcgctttgttgcccaggtgggtatggtggcagatacctgtaatctagcactttaggaagccaagcgggaggat

SEQ ID NO: 127913 - DNA, 509 bp, Homo sapiens
taaccagatttttacaatggtgccatggtgtaggcaatcccggattaagaggtcccttttacaaataaggaaatagactttaagatggctgccagtaagtggcagtgctgggacttaactcgggtctcatcattaatccagggcttctggaattccgggaatatggcactgtctgccataattttgttaatttactgcttgttttagaaatacatctgttataactagaaattcggggacagcttagtcaatttgttttccttacaagcaaaataaagtaaaatgtagcagtctgctcattagtgctctggtgggatggtttacctgtgaaccttggagaaccatgtcctgctttcacaatttaccaggaaaaatggctactccgaatttaaatatatgtaggacattaatggaaacacctacattccaactcagtcattgccactctgtagaatcttactgctatttcaaatgtccaattacagcaattaaaatactgattactgttg

SEQ ID NO: 127914 - DNA, 453 bp, Homo sapiens
ggagagccccaggcttatcgcatggacagggatggaaggccgtgtgggcctgatctttccctgtccacaatgttccaggctcagactttatctctcccatagtggacacaacaagccccttttgagttcaagctatgggggatgttctcagagaagcagctgtacactagggctggtcctaaccgaccacttttccttttttttttctttttgagacagggactcactctgttgcccaggctggagtgtagtggtgtagtcagctcactgcagcctctgcctcccaggctcaagcaatcctcccaccttagcctcccaagtagctgagactacaggtgcatgtcaccatgcttggctaagttttaaattttttgtagagacaaggtctcactatgttgcccaggctggtcttgaactctaggcctcaagggatcctcccatctcagcctacca

SEQ ID NO: 127915 - DNA, 396 bp, Homo sapiens
gacatctaagcagccccaagaggacacacctgtggccaccagccctgtacttcaccgcacaagccctgtctgagttctaatgccggaaaggaaaccttcagagagaatagctacttcagaaggagggatgagctgagtcgtggtatcccagcttgagtggtggttgttcatcttcagtggtagaatacagaaactatggcctgcagcaaagctcttctggtgatttctcctccttttcaaaacaatattgggaggccaggctgcctccatattgaattctagaatgaaaactgaccagctctgttattcagagtctagggaaaagaaatatgaggattgcaatgcaaaaacatggagtccttgtttgtttgctggtgggatgaactccagcccctc

SEQ ID NO: 127916 - DNA, 453 bp, Homo sapiens
gggggggtgggggtggggggttgacactcccttagcacctccagctcctcctgcagggtcactgaggctttaagtccacgtcagaagtggggttttataaacattcctgggtccatgtgtgtgaattagaagtcaattaaaatgaagaacattcacatgtctggtctctggagtcagttgaggccatttctcacttcctctctccatatatagagttcctacaaagcctggtctcctatccatcctgtcctttggccttggcacaagaatgacttctatagaagcctatgacatattttcgtctctgctcgcctggtaggagctgagttactttccctgtgaggcatgcaggaaccagtgtcatttgtgcacagtctatagatagtgcagagacaagaacccagggcacagctgttacaatgaggctgtgcaaggatccccacagggcccaat

SEQ ID NO: 127917 - DNA, 590 bp, Homo sapiens
caggtcagggtccagtggggttggctgctccccagggctctcttcctggcctgcagacggctgtcttctcactgtgtgcccacaagacctttcctagtttccctctctaggtatccaagcctccaatctggctgctggaatacaagatgctcctgtccttcaggctgcaaactgcctggctcttggtggcttccacagaaaatagcccctggtttcctctaatgaggagacatcacagaatgaccaagtctcccaaggattttcccccacagcgactcagacaaacaaaggcaacctgcaagcgactgactttgctgtctcgcggagtgattaatctccctgaaattaatggcccctcaaaggcaggcagctgcagtggctgtgcgcatctgaattgcaggattcctctgcatgcgtgaagacatttaacaggacagatgacacgttgtgggtgcccatggccctcaggaacccacacaacttgaccataggttccataagcatgcaggaatggggtcaccaccatggggttccctgcctacctcctccattcccattaacagaggtaaaaaagctgtccctcagaagag

SEQ ID NO: 127918 - DNA, 304 bp, Homo sapiens
ctagaggatctcggatatgcgtctcattccatcatttaagcaacataaaaagcaatgagatattttagataactttttccatactaagttttagaaatccagtatgttaggttaattttctggtagattcatcaagaagtgcttctgagtatagaatttccctcagttcacgcatgtttgtagccttgaatctttgtgattgaatataacatctttgtgttatatttttttccctttgtgaaaaggaaaaaattatgttggcaaatgtctcaacaacaacatagaaagcaaggcaacagtaagc

SEQ ID NO: 127919 - DNA, 499 bp, Homo sapiens
catatgaaagagcaaattcagaacatgagcatggaagtccctgcgaacgtcagatctccgtgtgcatccttacccccttgctgctttcatgctcactctcctcttgcgtggctcgctttcaggtttatctccatccctggaagcagagttgctctggcccaggctctccatgagagtttggcttgaacattcattgtctggccccctcctagttctcatctcccaaagtcaagccaatgtgtgaagaaatgaccagctcagcagccaaggcccagggtgcacaggtcttcgttgggagaggcatctgcaggcctttccttgcccactgggatccttgcctagcatagtgacgatgttcagccctggagacaaacaagaaggggaacaccaacatcaatagaagtatatatttacaaattgcatttctgctgtattgaaactaacattctgccctttaaaatcctgaaaataaaatttcagtatgaaatgaaaaaggcta

SEQ ID NO: 127920 - DNA, 734 bp, Homo sapiens
ggaattgtagaaattgctctattgctgttaccactctgtataacctgcaaacttaagtaccttaaattccctgtgtatatggtgtaggtttttcagttccaatgtggaaaagggggttggccatagttcatagccttgttagagtctataacaactcttaatgattggaagtgtaaaataaataagaacaagcattcagtacatttaagaaatttttttctttttcagtgtcatattcttttcttctttcctattattttctttagtgtttattccttattttctgcatacgttttagaaacataatcactgtatagcaaaatagctaattatgaggtgtcatacaatgatactgctcttctcttccctcctctctctagttcctgaatccttaatcattcccttttcttctgacttcccttcctgaaaactttagtccaaacctgggagaagcaagagaaaaggaagtgagatgggaagaagggatagtagcagtggcctgaaagggtatattggagcccaactggagcagtggcctagcatggggtgctagagccaaagtggggtgaggagggtatccacatgaagggggatataatttgagatgtcagagtctgaaagggttgaggatgacttttgtataggggtgaaggggagtgtagagccatagggtgttagtgttcagatggggtgaagtgggcatagcagggggtggcagcagtaggtgcaggttt

SEQ ID NO: 127921 - DNA, 332 bp, Homo sapiens
gactatttgaatctggaactgttttgggcagaaggaagggggccaagaatttgggaaaggagcaggatggggagagggtggacatgtgcaaaagaagagaccacagagctgtgaaactttggccctgggagagaggcccttaaagaccatctcatctgccccattatcttacagccgggaacactgaggcccagagatggaaaggaatgcctgagctcccccagccaggttggagaaccaactctcaggggttttcagaatctgcaaagcagattctcagagccagagtcaaggaagggaaagaggtcagaagacccatcactctccaggtg

SEQ ID NO: 127922 - DNA, 132 bp, Homo sapiens
tgagtacagtcaatctcagtcccttctctgagttctagattagaaaataactcacagagaggaaataacattctttatataagtattgctgatacaaaagaataaggcttaaatgtgtgatacagtgggatt

SEQ ID NO: 127923 - DNA, 167 bp, Homo sapiens
aaaactgtcaagaaggaaaatgatttgccacaataataacgacatctatccatggaggacagcagtgatgcatttttaccctgccattcaacttcatcatttctatcaatatgttaaatagaaagtgagttaagtacagaaacttctgagggttacctagcacattc

SEQ ID NO: 127924 - DNA, 445 bp, Homo sapiens
tttcctcatccgtcaagtagggatagcagctacctatctcgtaggcgattatgtagagtaaacaccccggctcactccaacttctccttcaggtctcaggcgtcacatctcagaggtaattcaggccccctgggccaggctgggctccctgctaggtcacccaccctagaatgtatcacactgtaaagggcgggtcaccatcatgtccccgggaccaggcacagcgtcagacagtgacaatgctcagaaaactgctgagtgagtgagaagctgcctcctccatcctcgccagtctccgcctctctggagaggtgttctgcagtgtctggtcaccctgcaaccaccatgcaaggaaccagggctgggctgtcgctgagcaagaacgcctgctctggacctaacctgcagctggttatttagggactcatgtaattccacggttggc

SEQ ID NO: 127925 - DNA, 402 bp, Homo sapiens
tttgtatttttagtagagacggggtttcttcatgttggtcaggctggtctcgaacttccgacctcagttgatccacccgtcttggcctcccaaagtgctgtattagccccattttatatccaaggaaactgaggcttagggagatttaaataggggggaaagtatagcttcatgattacacagtcaggaaatggcagagctgactcttgaattcagaccctgtgatgctgtatccagtgctgattttgttttgccctgtgttcctttcagtgtcaggtaagaagacctcagagatcatcttctccaacccacacattttactgattataaaatccaggtccgcattaactcattggccaaagttaagtggctaaatgactctcctgttcaggaagtattccc

SEQ ID NO: 127926 - DNA, 680 bp, Homo sapiens
gagggtcaatcacctgaggtcaggagttcgagaccagcctgaccaacatggtgaaacctcatctctactaaaaaatacaaaaattagctgggcatggtggcaggcgcctgtaattccagctactcgagagtctgaggcaggagaatggcttgaacccaggaggcggaggttgcagtaagccaagatcacaccattgcactccagcctgggcgacagagcaagactctgtctcgaaaaaaaatatatatatagataagatatactttaagtttgggggttttaagccatgtactaataaaacagacaagaactactgagccaagacctgaaaaggtgagaaacccagggagagaaataagcaaagcactgtcagctacttttgtcctggggttgaaaggccaagaaatagacttggtggcttctacagaatagatctaaaaaagtccaaatctagggttccaacaaaggtaaagaccctgattgagttagaattcagaaaggctatatcctgggagcaaaagtaacccagaattaagtcagttcctttatggtctgcagtccagctttgagtaatcaaggtggcttagaaaatctcaaatcacactaagaaaaggatagttaatcagacaatccctatcaccaggcacctggatgaaagaaatacaaatcctccatgaaat

SEQ ID NO: 127927 - DNA, 413 bp, Homo sapiens
caggcagcacaatcctgcatggaaaagaaagcccccacctgagtttgaatggaagacctttctgtcatcgggaacacctgctgcaccccaggtgctattctagacaccagaaatataacaaataagtctttgaggaagaggtcctgtgttgtgagggaggaaagacaagcacaaatcataatgatacgctttgacgatccctagttctgcatctgagacttgcacagaagcagaaatttaaccaggttaatcaagtgctgtaaatcaagcaacgaagtcagtcatatctagggaagaaaagcgctcttactccaaaggtttttccccactttgatctgcagtatcatgtcatctgaaattgaaaaagcaactttatacagaagcaggaacaaatggctcatttattttaagta

SEQ ID NO: 127928 - DNA, 521 bp, Homo sapiens
atgacaggctgaatagtattccactgcatgtatatattgcattttttaatccatttgtctgtggatcagcacatcgattgtttctacatcttggctgttgtgaataaaactgcaacgaacacaggagtacagacagacatctcttcaacacactgacttcaattcctttggatatacactcagaagtgggattgctagatggcatgctaagtctatttttagttttttttttaggaacctccatactgttttccaaagtgactgtatatatttacaatactactaacagcgtgtgaagttcccttctctcctccacatcctcaccaacgtttattttccatctttttttttttttagacaagatctcactctgtcacccaggctgggagacagtggtgcgatcacagctcactgcagtctcaacctcccgggctcaagcaatcctcccacctcagattcccaagtagctgggactacaggcatgtgccactattcctagctaatttttactttgtgttcta

SEQ ID NO: 127929 - DNA, 578 bp, Homo sapiens
tgcggggaagcgggagtgccaggagagagaaggtggagcttgcctgatggtgcacaaaaggtgcctgagatggagctgttccgcctccctctcatcctgggggtgctgggggcagactgggctgctaaggagatgtgaggaagtgtcttgtccacggctgcacccctttccccatttgggcaggaaagccctttgcctatgcagactcttcaggcttttgagacccttttctttttctgttgtttttctctaccacagactttacccttgtgaaaataccaggccagggatcacttcctgggtgacctgccctgaccttttgcccctatagggaaggtactaagctgctgcataccaaaggcttttgttagcatttagatggtcggtcacaggcaagacgtgatgcctgctctctcagccctggcctgtgctttactgcacccccttctcatcatcctttcatgctctcaaatctcctccataagtttttggacttttgacacggatttttgttccaaactattaggttggtacaaaagtaattgcggtttttgccactttttttttaaatggtcaaa

SEQ ID NO: 127930 - DNA, 500 bp, Homo sapiens
atttaaaaaaatgtttcttatattttttcatgaatcaatagcactccaccaacccacagatttagatgtttaggaataatttcagctgggtacagtggctcatgcctgtaatcccaacactttgggaggccgaggcaggcggatcacgaggtcaggagtttgagtccatcctggacaatatgatgaaaccccgtctctattaaaaatacaaaaattagctgggtttggtggcacgtgcctatagtcccagctactcgggaggctgaggcaggagaatcacttgaacccgggaggcagaggtcgcagtgagccgagatcgagccactgcactccagcctgggcaacagagcaagactccatctcataaataaataaaataattaattaattcatggcctggcaccgtggctcacacatgtattcccagcactttgggaggccaagccgggtggatcacctgaggtcaggagtttgagaccatcctggccaacatggcaaaa

SEQ ID NO: 127931 - DNA, 715 bp, Homo sapiens
cataaataaaattaatagaccactaactaaattagcaaagaaaaaagaagagtcacataaacacaatcagaaaagttaaaggtgtcattacaaatggtataaccaaaatacaaaagatcaccagagactattgtgaccatctgtttatgtacaaactagaaaatctaaaggaaataaattactgaaaacatacaacctcccaaggttgaaccaggaagaaatagaaatcctgaacagaccaataatgagtagtgaaattaaataagtaataaaaaaccctctaacaacatcaaaaaaattccaggaccagatgggttcatagccgaattttaccagacatacaaggaagaactaataccaatctttactaaaactgttccaaaaattgaggaggagggaatccttccttactcattctatgaagccagcatcaccctgatactaaagccaggcaagcatacaacaaaaagagaaaactacagatcaatatcccagaagaacacagatgcaaaaatcctcaacagaacactagcaaactgaatccaatagcacataaaaaagatagtatactgtgatcaggtgggttttattccagggatgcaagattggttcaacacacacaaatcaatcattgtgattcactgcatgaacagaattgaaaacaaaaatcatatgatcatatcaatagatgcagaaaaagcattagataacatcc

SEQ ID NO: 127932 - DNA, 436 bp, Homo sapiens
tatatttatttattttcccttaaattctgaccttaagcttaaaaataagtttgttaatactaacgttgttttcccttgagctagctttgaacctcaaatgaattgcaaactgcgaagtgactgctgtagggctactcttcagtaagctggtccagttatatggtaatgaatccatttataaaaaaaattgtatgtgagctgtttccaaggctattatagtatttctttatcagactatacataattttacgtttgtaacatggtacagttccaactgaataggcagtaattttctttattagagttgcattttagagtggttcattcatcagatttttatcaaatatattcttcgtgtcattcattgtgataggttctggaatatgattaagaaatggtccctgaactccaggggctcacagtctaggaagaaaaa

SEQ ID NO: 127933 - DNA, 525 bp, Homo sapiens
acagtgaaggtgtctgggggttagactaggactaaggagaagggacataatagaaagagaagagagacatcatctagatcagagtttgtcaagctcagcactattttatacaatttacacataactctgtttagaggggcttactcctgtacactgcaggatgtttagcagcattcccggcttctacgcactacattccagtagcatcctccctccagagtcacaatcaaagtctccagacattgccaaatgcttcctagattacaaaatctctccctagtaaaaaccattaatctaggtttatctctaagaaatgaaagggggaaaaaggaagggaaccttttccactgaaataagagaaaagagatgagatggcgtagggagagggggacaaaacagaaggcagggagctctttttagacatcagcgagctcagtcaagtagaaaagaagattatctatttagaaagactgtagggaggactggaagtttaaaacattaggagagttctagaaaaggcattat

SEQ ID NO: 127934 - DNA, 583 bp, Homo sapiens
acaatgaccttctgactcctttccaccagtccacagtgtcctcctcagtctgggctcattgcctcttgcaaggcgtcctttataagtaacaccctccccagaggtcactttcttattgtgacagtgaggcatactgtcaagaacacaaggctgggtgtttcatcctccctttatcacttaattgctctggagtcattaagtaactctgggagcctccggatcatggaaggaagtgactggctgggtggctgacctgtggagggctgctggctgtgtatggaataaaggaggcttctgggggtcggggcagggtctcggtaagcacagggagaatggatttcgcgggggcttggatcacgtgtgtgtgtgtgtgtgtgtgtagtctctccggatgtctgtgtgagcttgccaaatgctaaaaattcttcttcagtgtcggctttcctgagacttctcttgggctgtggcttggagctttgttggggtgtccactaggtcgggctgtgaagctctgtaggatactttggtagttttggtgtgagtcattgattccttagggtgacttggtgtctgaaagagctcg

SEQ ID NO: 127935 - DNA, 518 bp, Homo sapiens
gtggtggcctgggttacaaccctggcctgtccatttcagtagctgggtgactccatgcctttttaaacctcagtttcctgaaatgtaaagtggagataatcctactccctaccttatagtcattgcaaggattacaggaggctggcacttaatcaggggccagtacaagtactgttgttagagctcaaagcaatccacccgccttggcttcccaaagtgctgggattataggcgagagctactgtgcctagcctgcattcttttttttttttttttttttgagagggagtctcgctctgtcacccaggctggagtgcagcagcgccatctcggctcactgcaacctctgcctcccaggttcaagtgattctcctgcctcagcctcctgagtagctgggattacaggcgctcatcaccctgtcaggctaatttttgtatttttagtagagacggagtttcaccatgttagccaggatggtctcgatctcctgaccttgtgatccgcccgcctcggcccc

SEQ ID NO: 127936 - DNA, 309 bp, Homo sapiens
tctcagacaacaggaggcacaggcaagaggctgagaattatgttgggccctgaggagacagccatggctagcagaaagaaacaagcagaacttgcgcagtctgacaaggctatatggtagtaaaatgagagcacaagagaggtcttaagcatacaactgctttccctcccatggtatctgtcaaattctgagctgcgaaggccaaaaagataaactaaaactctgaaaagcagagctcaggatcaaacaaaaattagttcagaagcctccaaggaaatatggtgtagtgagcaaaatcaagcttccaga

SEQ ID NO: 127937 - DNA, 1441 bp, Homo sapiens
  misc_feature (1233)..(1233): n is a, c, g, or t
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggtgtggggagggaaatgggacagaaaagtcatttgtcatagttngtgttaatttccattggtccaactcgtcttttcttatttatttattattattattgtcatcattattactttctctccttcctcctttcttggtctcttggtctcattttcccccacctttccagccagacagagcaggccaaagggaaatacaggcccatcctcctctgaaactcacatctgagcatgaagcatggatctcctcctt

SEQ ID NO: 127938 - DNA, 1310 bp, Homo sapiens
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcgaatgctc

SEQ ID NO: 127939 - DNA, 802 bp, Homo sapiens
ccttctgattaagcaacaaattcttacccagtaattatgtataattttattaaaacttagttttgctttgttaataagtaaactatctagtagtaagctcgtctgacaatattatttacaatattgttggagaacaagaaacccaaaatgcaacaggactaaaactgaaaaggtttaactctttatttttatttttttatttttaaaatgagacggggtcttgctatgttggcagactggtctcaaactcctgagctcaaccaattctcctgccttggcctcccaaagtgctgggatttcaggcatgagccgccacacccggtgaaagggtttaaactctttctaaatcaccttgtgcagagaagatgaatacgtttttcacttgttggaagggtaattgatttagtaaatggtgttctcatttgccaaagttaatgtttgtcttgggagggggggcagtttattcccaaatatagagggtcagccccactatgtattgaggtttaaaaaacccaccttttaaaatgaatagttgtgctttttttagtgtgttttgagcctgaggtctgtcaagtgtttctgagggttcacacttgaattattgtgcttgaggtcagtgattcataagaggtcagcctcttatgaagcaaccaccttctaatgattgattgaatgatacatgatgtgcttctaaagtgctttctggtcagcattttattttctaaagtaaattttattttttacttttttttttaaaccctttgataacaggccttgagaagagtggaaaccactggctggg

SEQ ID NO: 127940 - DNA, 241 bp, Homo sapiens
gagaataagacaggagtgctgctggagagaccctttactttgctgagtagggaggatgacagagtctcaaaggaacaataaaagtcataaccaaataataaattataatcaaatatacctgtgactgttccaagtcaactcatcaacctagtactctaaaaagtgactctcctaatgaaaatcctcttactgtagaaaaagttgatatcatgacactggcactgagtaccagcaaaagaga

SEQ ID NO: 127941 - DNA, 725 bp, Homo sapiens
ccctaatataagacctaatataattaaataagaatcttaatttggatttgtaccacaaatttaattgaataaactgacttttcaaaaacttatttggtaattatgtatttaaatcaactaaatgaaaaacaaagaggagaaaagtcactgagcaagatgcagaattcctaatttttctttcatgttattcttcgtattttaccacctgacttagctaaataaagccagatattgtctgagctttcattcttaaggcatcatgttataaacagagtgaccttagagctcagtatgtctgcacagtcctggtgttttcctgtaattatcaatagctcctcctttcactttcataagtgtcctggcttggatgacaaagtcatggttacctattaaaatatgtgatcaagtaaatattggaagaaatgtttgagtaatacatacggttttaaatttctcaaaacctacatagtactatgtaaaataattagtgtgatttagtgttaaggtctttggttcttgattcatataattccttttttaacttggaaatgagaccattttcttgttgctcagatcaagaaataatctcagataactcaagtgtgatcattcaattctaatacttgaaaagaagatgatttttctcatgccttgatagatggtgatagaatacattgctgaattgtcctagtggcactctataaaacaggtaatgtagtggggtg

SEQ ID NO: 127942 - DNA, 838 bp, Homo sapiens
caagctgctttccacagtgactgacctcatttacatttcaaccaccagcatataagcatttccttttccctacagctgcaccagcatgttattttttgactttttaataatagtcattctgactggtgtgaggtgatatctcactgtgattttgatttgcatttctctaatgattagagatgttgaacattttttcatatgcttattggccgtgtgtatgtcttcttttgagaagtgtctgttcatgttcctttgtccatcttttaataggattgtttgttttttgcttgctgatttgataacaagatttttatgttggtatttataagttgaacaccaagatattgctaaataggctagtccctcaatctggcatgttagaaactgcgtaaattaggactcagaggaccacctggttttagtttctactttgccactccctacctatatcactagacctaaatttcctgaacagtaaaaacaaggatgttgccctgaataagctataatttacttttcatctcagatattctttaattttggaacccatgcaaaatatctggttaaatttaattaggagttaagaaggtgaggattttgcagaacaggtgtctcagatctttactgtatttattatggtttcatagtctagtagccccaagatgttctgtttctacaacttctctgtaaatggcactggcaaagtcttttaacagtgttttagaaactttttttctgacctggcacggtggctcacgcctgtaatcccagcaccttgggaggccgagacaggtggattggaattcaagaccagcctggccaacatggtgaaaccccg

SEQ ID NO: 127943 - DNA, 281 bp, Homo sapiens
ctattttctgtctggatgatctgtctgttattgaaaatggataatcaagtccctactattattgcactgctgtctattttctgtctggatgatctgtctgttattgaaaatggataatcaagtccctactattattgcactgctgtctatttcttccctcttttctgttaatatttgctttctgtttaggtgccccaatattgggtggatatatatttataattgttatatcctcatgatgaattagcccttttatcattatatagtgacattcctttttt

SEQ ID NO: 127944 - DNA, 454 bp, Homo sapiens
atggctcctcttctcagaaaaatgtacattgcacatacggatataatctgtaaaacttcaggagctttagacccccaaaagccccagcttaagaattcttgctgaagacaaatcactccttttcttactcaagagctgttttccagggctgattaactaccatcttagatgtccaacaggtgagtgaatattcagcactgaactctagtcatcccatgccattggcagatggctgggtctctgctgttgcctgaagccagaaggaagcaaagcccctagaccgagaccacattttgtttttcaaaggagcactctactccacccccaccagaaaacctcagacaccccaggcctggaacacagacacaaagtgacaagacagaaataaatctggtgcagtatacaactacatctgtgaagacagccatagactgggctcttcttgggctggcag

SEQ ID NO: 127945 - DNA, 921 bp, Homo sapiens
gatggttcatagcctccctcttttctcctcactaacacttgtcttttccaccatatgcacgaaaagacatatttgttcctgaggaaattagaaagggagggcctgagttggttgctattcctgaaagtttctttgaatggaatactggatcatcgtttttgaagaggtctgttgttacttcattattacctcctttagcagcacccttgttttcctccaacctctgccaagattagtgtcctgtgtctacatttgccccttctgtttctcatactcccagatggaaatattatatttcttaggacttttcgctctatttgaattagtattttctactcgaaacccttcagaaatcctgaaatccattcttatgctttctgtgtgagttggttttatgtttgttaataatgtttcaacagaatgatagtggacatgatagcaaaagggaaattgatactaatatgtaacgaagaaatcgtatgtgaaattgtgaagaaaatgaacgatatttttattgagtactttgaaggtacttgtcataaactaacaatgctaatgatttctagaggagttatatactacactgtatataaagaaccttggagattggttggcataaaaagaacttcacagttcatttcttttatctgtttacattcttttctctagaggcaaatgttctttaatcagttttcctttgattctctttcagagaggctcatgtagtgggatcaacaatcatatcactgttgtggcattgtatatatgttaactattgattttgcattcttttagattataatatttaatctcttggtctgaaggtagatatattcctgttttctcaagctgtttcttagacctttattgtccagtatggtacccactagccatatgggactactgagcacaggaaatgtg

SEQ ID NO: 127946 - DNA, 405 bp, Homo sapiens
ggtcaagggctgcctgagtcctgcaaggcccaaggcaagcacggactgtgccaggtgcactgagtgggggcctccagtgggcgacgcagagcccagagctttccctggcagtgatggccacggggccgccacgtggcacagcctctcctgagggcttgagcccccaccgggaggcaccctcgcaggcgggcgcacagcccatggggccttggcactgtggggagggtgcacaggcaagtccggctctggcgtgtctgctccagagcctcactcacctgcagctcctggaggctgtggctgttggctgcagtgacttgattgcttgttaattgctcattaattgggtaattagtgctttgttgtgctttgaagcctaaatactcataaaaactgaatttgctgagt

SEQ ID NO: 127947 - DNA, 630 bp, Homo sapiens
ctcctgaaccagcaaacggagaaacaaatcgtactctggctactcctccctcccgagggctcttacctgatcacactagctgcctgctcctcctcactcagaccttatcgggatgacaccacttcacatatcccattttattctcctcatggcactttccaccatctaaacgctccatttctgtacctgtgcatccccttcaggtctggcttccccctctacgccctcccattaaaatgtaaattccttgggagcagacgttcaatcgatcccacctcagtacagcatcctccagtgcctacaacactgcctggcacacagtaaacgctcaagaaatattttttggactgtctgaataaagcatataagcaccaaaggagcaaaaatgcacaatgtagaatgaaaagtgcagcccagcagtggttgggactgagctagaatctcacctacttcctattccaaggaaacattttctgaacactcagaattcagaaaaggcaccttccctccaaacccttagcatatctacatctacactgattatgaagctctctgggttgcttattgttgcttgtttccccagctacatcctgagtcccttgagattaaggtcagattttgcagcatata

SEQ ID NO: 127948 - DNA, 141 bp, Homo sapiens
agagcaaccaagtctgagtctataatcttaaaaatcaaatttatatgaaaacaagccaccagtctgggcaacagagcgagactctgtctcaacaacaacaaaaatctctatccagacaagacaaaataaaattcacagtct

SEQ ID NO: 127949 - DNA, 308 bp, Homo sapiens
acactttgtaaggatatagctgccatatatatggtgattctgatggatttggtcagagtaaattgaaaggcttttgaaaagaatttaccattctagaaaccattaagaacattggtgattcatgggaggagattaaaatatcaacattaataggagtttggaagaagttgattccaaccctcagtggatgactttgtgaggttcaagacttcagcggaggaaataactgcagatgtgatggaaatagcaagagaactagaattagaagtgcagcctgatgatgcgactgagttgctgtaacctcatga

SEQ ID NO: 127950 - DNA, 440 bp, Homo sapiens
actggtctcttagagtggggccggttaatgtcctgagtgctgtttatgcttcttggtctaagcatgcagagacagtgccagagatgagcacgcttgccttccattcccgtgggaggcccttaggagaagcttctaatgagaagtgccgggtctcccgccttctatctctaagaccttcaggagtttccttctcctatctgagcctcggtttcctcatctgcagcacgggacacagtagtgcctgctttgcagggctcagtaaaaagaccatagagcccacagagagagcgtcccccacagagagagcgtcaccccacagagagagcgtcaccccacagagagagcgtcaccccacagagagagcgtcaccccacagagagagcgtcaccccacagagagagcgtcatatcccccacagagagagcgtcgggtaccgagct

SEQ ID NO: 127951 - DNA, 1298 bp, Homo sapiens
agcatttgctactgctggtatggctttaggtgagtacttctctgagcctcaatatcctcaatggttaaatggagaagctatctcactgggttgctgtaaaagataaacaagattacaaatgtatagtgcttagctgcagttgctgacacatagtaagcaccccattgttattgttattgttagcaaaataagactccatggtagaaaaactatgcaagtcataaaatgtatcagcattaacttttatcaacagatagggtgctattaaatgtatcaccaacatagtaaaatgacagaaaggaatattacagtgtgaaagcatttatttatttgtttgacaacagctacaattgaaatacagcaattctgaaggtctttaaatgggttgcactttgccctgttaactcactatttcctgattggcaataattttacttggtaatgctctgtattatggtaaaagctaacaataataatttatcgagtatattctttgtagcaggcacagttatgagtgctatgtgaatacatttaatcttcacagcaactttgaagtaggtactattactgtgcatattttgaagatgggaaaactgaggcagacagtttgcctctgggagccctcactcttaaactcttatgatatataccagaaactgtgacatagcccaggtgccaaatctggccctccacctgcttttgtaaataaagttttattggaatacacccatgcccactcatttacacattgtctatagccatttcggtgctatagcttcagggtggagtagttgctacagagaccacgtggcccacaaaccttaaaacacctactgtttggcactttgcagaaaaagtttgctaacccctgatgtcaactttaaacttcacaaaaagactggagtttaaagggaaagaaataatatcttataataaaaatgccttatgtttggtatttactgtggatttgtacatatttatcttacttaattctcatagcaatcctgtgaagtaagtagtctttttatttccattttagaaatgaagaatcaggagttcagagggattaaatgacttacactctaggctgaagagcaaactccatgagtgtagggatcatgtgtcttcatcatcatgtccctgtcacctaccacgatgctagcacagggtggacactcagaaaatacttgctaaatgaatgacagttacaaaggtcacccagctagagaatccaggtcttctcctcttccagggttctttctcctgactccacagctgtctgacagttaaaaaaaaaa

SEQ ID NO: 127952 - DNA, 838 bp, Homo sapiens
atcttgattaaaaatcaatcaataaaaaaccttattatacttccaaactaaatttataagtctttttgaaaaacagcaaatattggataatagatcctctgactctagatattgcacctgctttaaattagattatcttttgagaagtgaccttgaaaaacaatgattaagtgggtaagtttgactttttagactattagacgtgactgtattctccctcaaaaacctttataaggcagaaatatatatggcatctgattctcttttctttagatggagtttacgatttttgaagtttggctttgacaacaaatgacaatgaaatcatggctatttgatatttagttacaattcatccaatatttattgagcactttctgtcttctgttttgatacaggaaggttataaaaagtataagacaccacttatttcctctgggatcttaaaatctaattatggaaagaagctatgtgggaaaaaataatggagattttgacaaaagatcaagacaagaattaaagagacatcacatgtctatgtatgattagttaacaaattcattttcagacaacaactatgcttggaagttcaggaatgagactggactcttctttgttcatttcttacttttctcctattgacctctcacatgctgacatctccattgtcttctcttcctatgctttgtggctttgttattaaattaagtgttaatttttttttttttcttagacggagtcttgctctgtctcccaggctacagtacaatggtgcaatctcggctcactgcaacctctgcttcccaggttcaagcgattctcgtgcctcaacctcccg

SEQ ID NO: 127953 - DNA, 652 bp, Homo sapiens
  misc_feature (652)..(652): n is a, c, g, or t
agtggaacagtcaatgaagcacaggatccttctgtccccaaggtcctgaacaactgcagaaaccttgtgcccgtgcattcatccctccttcttggatcctttacctgttgatctccttcgttttctttccagacaacaattatggacaacttattattaatatatgtgagccactgtgttcactatcggaaataaaaatatgcttataaggtagtcccaaatcttttttttttttttttttttttttggggggaaggggtttttaaaaaaaaaaaaaaaaaaaaaaaaccatgcggggtggcggggcgccccacggcgccccgaaggaaaaagtttttaaacaaacccaccgtggtggggggcgggggcgggccacacagaatgatagtagtagtgagaacaatgtgtgcgaccaacgagagggcggttcccagaaaagagaaacagcgcggggaaaaagaagaagagaggtgcggggggtctcccccaacacataaagaaaaagccgcggcggcggggaacaaggcgggtggtctgggaagcagcacaacacagaagaggaagtcagaggaggacaacaaggggggacatcaaccaaggaggaacaccagcagagaaggggaaataaaaaacccgcgcgcgcgggggggan

SEQ ID NO: 127954 - DNA, 873 bp, Homo sapiens
acactacaacatttcattaaaaattatggcagctttattgatagtcacaaaaacatgaaaatgaccagtgcatagataaacaggggtacatccatacaatggaataataattagcaatacaagaaataaactattgatttgtgcaacaacattaattcatctaaaatgcattgtgctaagtaaaaagaaaagccagacttagaaaagctgcatattatatgattttcttcatatgacaccttagaaaaaaaattatggaaattgaaaacagattagtgcttgccaagggctgtgggataggggtagaggttgactagaagaaagcagcacgaaggaattttggatgtgatggaaatgttttatatggaacattggtggtggatacatgattctaagcatttgttgaaagttataggattgtataccagaaagactacaattttctatgcataaagttttaaaaagtcaaattgaaaatatatggaggaggctgggcatggtggctcacatctgtaatcccaggattttgggaggctgagtcaggatgatttcttgagctcaggatttcaagaccagcctgggcagcacagcaagaccctgtttctacaaaagtagatttatttaagaaaataaaatatatgcaaggatagcatttggaccactacaaaatgtacagaaaagtgactatgatcaataataatatatagtattcttgaaaaatgtaaacagagtggatgttactctgaccacaaaatgataaccaagtgaggtaatatattttttaattagccaaaattaaccatttcacaatgtatatgtactttaaaacaccatgttgttcatgataacatttcttgaaatttattctcctga

SEQ ID NO: 127955 - DNA, 342 bp, Homo sapiens
ctttcagttaatgataccgcttactatattcaacaaatatttgttagcccttactgtgtcagaatctattctaggtagcagtataaaggaggcagataagttctctcatcacagagctaacattccagagggaagaaatagacaataaatgagcactttaaaaatagaataaggccaggcgcggtggctcacgcctgtaatcccaacactttgggaggccgaggcgggcggatctcaaggtcaggggttcaagaccagcctgactaacatggtgaaaccccgtctctactaaaaatacaaaaattagccgggcatggtggtgtgcactggtaatctcagcta

SEQ ID NO: 127956 - DNA, 446 bp, Homo sapiens
gataggcctgaacccatgagtcatcaacaactaaatgataattgaaagaatggacaggagtaagagggtccagggcattatacactgagaaaataggccttaatatttaagtgttgttgagaagaaagagctagaaaaggagactcagaagtcgtggtctgggaagtaggagggaaactagtagaatgtgacatcacagagtccaagagaaaatactattttgaaaacagatgttcagttctgtcaagtgctgctgctagaagttgtatatggactctctttagcatcttacaacatggaggtcatggatgactttatggagggtacttcagtagagtaataggatagaatccaaattggttttgattgaagaagagagggtggaaaggaaataaagattagttcaaggtctttaagcagttaggggaaggtggcattcacgaaga

SEQ ID NO: 127957 - DNA, 473 bp, Homo sapiens
ttccacctgacctcacttttcccactgccacctgcccgcccactctaaaggtgctgtccgagctccacagcacacccactgcagggatactcccacttgggagcacacttctgtgtccctgctcttcaaacccaaatgacctcccttctctttcttaggatcactgttttcctgagtattgtattatctttaggaaagtacagtgcttatgaaatgacacttcttagaaagacatgtgtcagctgggaagggtgacatgaaatcttcaaaattatcaaaatcagtctaaaataagcagagctgtgcttctagataaggccgaaaatgactactccataggtgtcaacagtctccaaatataatctacagcacaagtagcctcaggggtatgaagaatatgtctgtgaactcatgtcaacccactctcatgtctgtgtaaaacctgaaaaactaaatacatacacgggaggtac

SEQ ID NO: 127958 - DNA, 474 bp, Homo sapiens
caagaggctggatgtgcaaggcaagtgtactggcaagtgtaccagcaagaatgaggcagtgtgattccttcatcaaaaaacaggtggggccaggagtggtggctcacgcctataatcttagcactttgggaggccgagatgggtggattacccgaggtcaggagttggagaccagtctggccatcatggtgaaaccctgtctctactaaaaatcaaaaatcagctgggtgtggtggtgcacgccggtaatcccagctactcaggtggctgaggcatgagaatcacttgaatctgggaggcagaggttgcagtgagccgagatagcgctactgcactttggcctcgcgacagagcaaactccatctcaagaaaaaaaaaaatacaggtgggtctaagaaatttccattctattccccgcctgtccctctctgtctttgttacaggatacctcatcaaatgaaaacacaatgatga

SEQ ID NO: 127959 - DNA, 162 bp, Homo sapiens
ccaaaacctgtctcaaaaccaaaaccaaacacaaacaacaacaaccaaaactacacaatcatcttgtcactttctccttccaaaatctctaaatgattttctgtgccaggaatggtggctcatgcctataatcccagcactttgggaggctcaggcgggtgg

SEQ ID NO: 127960 - DNA, 542 bp, Homo sapiens
tttgctgctctccctccctctcatagcccagaccgtggaacgccttcaatcagttatttggcttggaggtggcagtgacagagcttcacagaaaatgttttttctcagttggaagtctgacactctaagaaataaagtgctgtgtgacagacccttaaccaaggaagagtccagaggacttcatgatgactcagaagcatatggacaggtacctcctcacaccaggagacctgtctgtacaatagtgagacaagtggagaatttctgcgcctacgtttttcccatttcaaaaagagtctggcattgattacattctgtgatcgaaaagagttttgtgtatgttcttgtccttgtcaggatcacagataattcattctgcagagaggcggtgactgtgtgcataaactgggtcctgttggtataatcatgtgcctcacctgttttgaccctatcagaatgctaaagatgcaaattaactctgaaggacacatctagacaatgaaaaaaaaattatgcttgcagacggtcagtgtaacattggg

SEQ ID NO: 127961 - DNA, 503 bp, Homo sapiens
atggcccctctccctttctgagcctccatttcctggcctgctctatgagcacgtggacctggcccctcgttatccttgtcacgatactttcagtagttcctccctcggccagcccagccacatggcttttgactgtttttcccactacggcatctggggcgcagtaggtgctcagctaaatcttgttggagaagcccaggagtgcaccactgagtggctgtcccgggctttcccactcccggcctcttgcttgtgtagccccctttgccaagaatgtggcccccattcatctctacttgtggaaatccttgtcctcgaagcccttcgcaaatgctgcctcccctaggaagcctttcccagtttctcccagccagaggagatgctggtccttggaacacttgctctgaggctctctggtggtccctgttacagtgcactgccgtgtccatagtaacagatgaatggcaaacagggactgtgcacttgctaggagccaggcacag

SEQ ID NO: 127962 - DNA, 362 bp, Homo sapiens
tgctgggattacaggcatgagccaccacacccagtctcagttttcaaacagttcttattcttcactggagtcaaaaaagagaatagaggaaaagacaatcatattgttcctttaagagttaagaccaacaagttttcctctttacatgttgtttttgacatgagcaaactggtgattaaaaacaacttgggtggctcatacttgtaatcccagcaccttgggaagctgaggtgggagaatagcttgaggccaggagttcaagccagggcaacatagtgagaccccatctctacaaaagatacaaaaattagccaggcgtggtggtacacctgtagtcccagctgctctggaggctgagatgg

SEQ ID NO: 127963 - DNA, 401 bp, Homo sapiens
  misc_feature (7)..(7): n is a, c, g, or t
tccgganccccggacgaccagctattcctgaggagagtgggccctcatagggcctggctcagccagcccatttataggcctggttggagaccagccagacattttcagaagcagcacattatatgattgcaaaggtacccaatgtctgacttgtgagccagtaatatgaacccacttttattttattttttttgagacggagtttcactcttgttgcccaggctggagtgccatggtgcgatcttggctcactgcaacctctgcctcccaggttcaagcgattctcctgcttcagcctcccgagtagctgggattaaaggcacccgccaccacgcctggctaatttctttgtatttttagtagagacggggtttcaccatgttggccaggctggtctcgaa

SEQ ID NO: 127964 - DNA, 525 bp, Homo sapiens
tcaacgctttatacttcatttctttcattaatatttaacagttttcaatgtacagatctttcaccttcttggtatacctaggtatgttattttatttcatttaattttttttttttttttttgagacagggtcttgctctgttgcccaggctggagtgcagtggtgcaatctcggctcactgcaacctctgcctcccgggttcaagagattctcctgcctcagcctcccgagtagctgggactacaggcacgcaccaccatgccaggctaatttttgtatttgtagtagagatggggtttcaccatgttggccaggttggtctccaactcctgacctcgagttatctgctcacctccgcctcccaaagtgctgggattacaggcgtgagccaccgcacctggcaagtgtagaatttttgtatgcaattgaagttgagttgttaccagtttaaacagaatgttttgttttatgtaaggtccatggtaaccccaaagaacctacctttagtagaaacacagaagata

SEQ ID NO: 127965 - DNA, 679 bp, Homo sapiens
taaagaagctgaaaaggtaagttacaaattggaggaatctgtttacaatccacacaactaacagagcatttgagtaaaaaatatatcagtaactataatcagtgagaacatcacaacaagtcagaagaaaaagtagcaggagaatggatgagcatgtcgtagaagagcgaacacacaggttcagcacatgtgtgcagaaatgttcaacagcatgggggtcatggagatgccaatgaagacaattagttaccattttatgccttttccatcagcagaagttaagcctgacaatgccaagtcttgatgaacatgtggacccacaggatccttttacatagttggtgggaatgtaagcggacgtcccctgggaggcattgccttctatagttacatgttcatgtaccctggaacccagcagccccactcctgtactcagagtaaccttgcctgtgtgcacgtgaatatgagcatggatatgaatattcattgcagcactatgcacaatatcaaaaacctggaagcaacccaaatgcccagcacagagagagtgaactaacaaaccctgtgttattatacaagagtcagaaccaatgaattatagcaatgcagaaaagcacaaattagttttaagtgaaaagttgaaaagtaagtccgataaattaacattcaccatttgttt

SEQ ID NO: 127966 - DNA, 568 bp, Homo sapiens
agagctgggactacaggtgcacaccactacacctggctaatttttctatttttagtagagatggggtttcaccatattggtcaggctggtctcgaactcctggccacaagtgagcctcccgccttggcctccctaagtgttgggattataggtgtgagccagcagccatacccctcttctcaatcttccttctcccctggaaaacctgctcacttctgaccccaagacagccccctccccttccctctgtcttctgtgtttggcagaccagccccagcgaggacttgttggttgtggtttttctatcagggaagtcaatggctggccagtgtagtgtgaagtcccagcttggcagagacttgcccaaggctggataggaggcttctttgccgctcaggctttatcagtcaggaaatccttagccctccctagaggattggctgtcccctctatcctcactgcttgaatttggtgttgcatgattgatttctaccctgttccctctgcttgagggctatcctccccatgcccatctcacttctccaccaagttcactgttcatcattta

SEQ ID NO: 127967 - DNA, 511 bp, Homo sapiens
cagacgaagtctcgctatgttgcccaggctggtctcgaactcctggccacaagtgagcctcccgccttggcctccctaagtgttgggattataggtgtgagccagcagccatacccctcttctcaatcttccttctcccctggaaaacctgctcacttctgaccccaagacagccccctccccttccctctgtcttctgtgtttggcagaccagccccagcgaggacttgttggttgtggtttttctatcagggaagtcaatggctggccagtgtagtgtgaagtcccagcttggcagagacttgcccaaggctggataggaggcttctttgccgctcaggctttatcagtcaggaaatccttagccctccctagaggattggctgtcccctctatcctcactgcttgaatttggtgttgcatgattgatttctaccctgttccctctgcttgagggctatcctccccatgcccatctcacttctccaccaagttcactgttcatcattta

SEQ ID NO: 127968 - DNA, 849 bp, Homo sapiens
actgcgctacaggccgcctgtaatttacatatgttttaacgctaacattgggaagcattgggcctttctgaagcctttttgtttcgttttgtttgaagctcccctccccccagtaatgagcctcagtttggtcctaagggctgggtcgccggatcgtagacccaaatccttgcaaaatgaacgactccctcccctcaaagaggagggagttgtgttgttgttttgttttgttttgtttttccgcccgttttcttttaacggccccgcagccctctgtgtggccttgttccctgtgaataattgcctcactgttcttcctgggggcttgcgtttgtgagactcaaggtgctagcctcttcactttccatttcccagacaggaaattaagctttcctctccattcgaactttttaaaaaaagcctgaggaggtatatgtgaaaattaaccccgtaaaatagcactttttttttttaattaaccacaacctttagttagcctagcagtagcgttttttaagggtggtcctggaaaaattactgtttggggtttgtttttaatgggggctacttttccctttctgagcctcagtttactgctctgttaaataaggggcgagtctggatgatctataccagacagtgatcgttagctctgtaatgtcttcaattgaaaagtgaagttatgaaactggctgtagttcaggctacctgctgtaggcagactaggttggaatagaagcagcgttggaacaggcgggaaatagccatcccaggaccacattcttgggggttatacttgatattaggcaattttggaacattcatttcacctcttagggactgtattgc

SEQ ID NO: 127969 - DNA, 819 bp, Homo sapiens
agtcttagcatcttattcattcggtcttataggatattaaccagtttcgtctctaacctattgctcctagttaacactccattgttaaatttcctatataaatcctgttcttcaaatgcttcttgaaccagtcttaatattcattcagtcttaagataaatgattaattcattagtaaatgaacagaataaatctttggtatatcttcaattggtatttacatgagtcagattaactttttgaaaattatacttttaacagctctcgctgaactctagcttccttctgatatttgctcaaatgctactcttgtggaggcttttcttaatcgtgctgtataaaataaggccctttgtacttgctcagcatcccctagccctttttatttttttcttttccataccgcttattcctacctgttattttattttgatttgtttattttctgtcttttctccactacagtgtaaattccttgagattaaggagttttccttcccagtagtacttggcatatagtgcatgttcaatgaatactgttggatgaattgaatagatgaactaatatcatgcaccctgctccccaaggactaattacattgtgtatagccacacttactgacctcatccttggaactatggtgctgattaaaaggcatagtactgaataatgagataactttgtgtttctttgtctccactgaatgacttattctggaccctttagtgagacatacatctttgagagttcagtttttccatctataaatgggaacagtaacatatcagagagactacgtgagacttaacgtatatcac

SEQ ID NO: 127970 - DNA, 278 bp, Homo sapiens
ctgaggctgaggcccagaggggttcagtggctcctccaagctccaagtgagctccaagtgaccacagaggtcaggcccagaccccacatcatggatggggagggggtgcagtggtgggaacaagctgactccccaaaacacctgaggttgagagtgaggaggtggagtttgaattctagctgcccctcacttgctgtgtgacctgggcaagcacatccccctctctgggccttagctgaaccagtcacccacccattcttgcccccttcaaccaaagc

SEQ ID NO: 127971 - DNA, 212 bp, Homo sapiens
tttctgtttctgcattaattaactttgggataatggcctccagctgtaaccaggttgttgcaaaaggtaagatttcattctttttaatggctatgtagtattctgtggtatatatgtacagcactttcttcatccaattcactgctaatggacatctaaggacatctaaggtgtccatgtttttgctactgtgtatagtgttacaatgaaca

SEQ ID NO: 127972 - DNA, 493 bp, Homo sapiens
ccccgtgatccaatcactttctaccaggctccacttccaacagtgggaatcacatttcaacatgagatttggagggtacaaacatccaaaccatatcagtacagaaggagcttatttagtaaaaccaccagaaacaagaacagcagtttcccctctcacctacctcccacaaaccctcctataaaatatctcagagaccagagattataacaactttgaataaaaggctacaaaacccaaaataatggtaacttaattgttttgaaaagctttgttataacttgcacaaatattctaaatgcctttacgtgaatgaacttaaaaatgtatattgatatcacactagttcctttaaaaaacaaaaaagaaagaaagaaacaagagaatatggactccatttcttctctagtgcagagttctttcttccttggcatgcaaagtacttccagtacagaactggtcacactgtatttctaaatatttgtttatctat

SEQ ID NO: 127973 - DNA, 772 bp, Homo sapiens
cagcgaaagcctgcaccttgttcttctcttgaacagaaatacagagctggtctcccgtggcttttaatgaatatgagtggggctttccaatgtccaggaatttgatctctaggctgaccaaagggtcaggaacaaagaacacattttttcacgttagagtggacccaggtgtaatttgtcagatttagtaactgtggaggaagtgccttaacttctccagcaggaaaattagatcaggcctaggcagtgcaattctaaaatggctgaaataggaagagaaagtctgttgagttgcattttcaaaggaagtgtgagcaggatttgttttcccttcctctcttcccctcatttcctatcataaccatgttgaattcattcattcatttagatgtaattttctcagcatttttcaaagtgggagttgatttcactctctgcagcatttctaattgtgtttgcacacaaatagctacaaggttgctcacatttcccttgttctgatcagtgcaatagtactttatgtttactctgtcaggaaagcgtcagatgtttttatttccaattataagttttgtaatgcatcatgtattttgctgacagtcttcaagttcttgaaatagtgaacaaattaacagcagatattgagtgagaggattagaaaaccaactggcaactcatatgatagaattcagatacagggatgggtggaatgggctcatttattttattttctcagtcatactttgtaattaacttaggcaaaaaaaaaaaa

SEQ ID NO: 127974 - DNA, 190 bp, Homo sapiens
ggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagt

SEQ ID NO: 127975 - DNA, 297 bp, Homo sapiens
gatgattatgataaatttaatgaggattattatgaggattttaacacattcacatggctcactgttccctctccttcctcgcaatatagtgataatgcaatttttgggtaaatccacattcactttattattaggcttaactgaagaactgcaatttcatgtgcctttcagagtcagtcttaagctattcaccatgaccaatgtggaaactggtgtcaccaaaaatgtggaagtctttcaggaggaatacacttatctttgaggtcaagagacacagaaaaattaagtgtgaatata

SEQ ID NO: 127976 - DNA, 265 bp, Homo sapiens
tggctagcatgtggcaggcactacgtatcatattgcctcattgattctcataacaactctatgggttgaatatgattattactccatttaacaactgaggaaactaaggcccaaaaacatcaagtaatttgcccagggtcttcagctagaaagtgacaaagccaagttgcctggatctaccatttctgttctttattaaaatgggaaggtcaccagaagagtagagtttacacacacacatacacacacacacatgcacacgcat

SEQ ID NO: 127977 - DNA, 318 bp, Homo sapiens
cttaaacctgctagaccaaaatgcaatttgatatagtagtagctatttttttctctttctcttgtttttctctctttttaaagaaaaaaaattgaatgattattctttaccttattataagataaatagcatctaatatagcaaatacaggaatgcatttgtaaagtctgattccacatcagttgtttacaacattatttgaacattttggctattgtctcatgacccatgttagaatgggttggagtgtttcaaatctaatacacagtgagctcttctttaaactctaatgaagctgggctggtcacctatttggga

SEQ ID NO: 127978 - DNA, 1762 bp, Homo sapiens
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127979 - DNA, 703 bp, Homo sapiens
  misc_feature (45)..(45): n is a, c, g, or t
  misc_feature (61)..(61): n is a, c, g, or t
ttgcggtacattccccggaccgcttgcttgttcgattaatccgcncacttaggaatttgcntcgggccaaattcggcacggggtccccagagtttgtggatgaagctctgtgtgcgtgctaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacataagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127980 - DNA, 1788 bp, Homo sapiens
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127981 - DNA, 1845 bp, Homo sapiens
  misc_feature (1787)..(1787): n is a, c, g, or t
  misc_feature (1813)..(1813): n is a, c, g, or t
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggaaaaaaaaaaaaaaaaccgggctnttttgggggggaaaaggttaagggcnggcttgtccgccctttttgtcagggaatcgcg

SEQ ID NO: 127982 - DNA, 2058 bp, Homo sapiens
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacatactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127983 - DNA, 1076 bp, Homo sapiens
  misc_feature (901)..(901): n is a, c, g, or t
  misc_feature (914)..(914): n is a, c, g, or t
cgggggggcaacaaaaagtaaggctaaaggtacgaggccgggtgtgtgctactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagagtcgatgaacccggtgtaaacgttaggcctgaattgcctgtccangcaatgtgcggancaggggtcgggctgagaaaacagttggtttgttgggttggtccagtcctttgggcacttttgggtcaaggaagggggggggagggggctttaaaatgctgtgtggaaaaagcttttgggggggagggggtgtgccttcgttctgtgctctgtttatatatgg

SEQ ID NO: 127984 - DNA, 959 bp, Homo sapiens
tagcccgcaaaccttagggctaggtagcgaggctgggtgtcgcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggcaaacaacacacaaaaaaaaactccggggtctttttccggtcgcggaacaaaggttttgatggcccgtggtcaagttttcccggacccctttttgtccacgggtaattcccggcccaaatagggctatcgaaaccggacgtg

SEQ ID NO: 127985 - DNA, 806 bp, Homo sapiens
ggtctaggtacgacctgggttgaatcggccgaggtggtccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127986 - DNA, 918 bp, Homo sapiens
ggtctaggtacgacctgggttgaatcggccgaggtggtccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggggtccaacaagaaaggagaaattggggcttggccggaaatttaaatttggggggcgaggaaaaagaaggccagagggaaggggttccaacggggggtgaaagggtggtaagg

SEQ ID NO: 127987 - DNA, 817 bp, Homo sapiens
tagcccgcaaaccttagggctaggtagcgaggctgggtgtcgcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127988 - DNA, 1923 bp, Homo sapiens
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggtggtctgtgggaaaacaaaaaaaaaatcgggccttggccggggggaacagcaagaagccaggaactttctggcgttgacaagggaagccggccatagcgtatgaccgggaatagaaaaagagaggaatcggaaca

SEQ ID NO: 127989 - DNA, 1248 bp, Homo sapiens
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtttcaccatgttggtcaggtcggtctggaactcctgacctcgtgatccgccctcccaggcatcccgaagtgctgggattacaggcatgagccacgtgcccggcctattttttattttgactgttattttttcgagacagtgtcttgctctgtgacccaggctgg

SEQ ID NO: 127990 - DNA, 1823 bp, Homo sapiens
  misc_feature (1680)..(1680): n is a, c, g, or t
  misc_feature (1741)..(1741): n is a, c, g, or t
  misc_feature (1745)..(1745): n is a, c, g, or t
  misc_feature (1776)..(1776): n is a, c, g, or t
  misc_feature (1781)..(1781): n is a, c, g, or t
  misc_feature (1823)..(1823): n is a, c, g, or t
caaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgtttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggaggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatgaatttaacnatgtttaccattttggaaaccacttttttttggtgttctccaaaaggaattaacctgccancttngggtttgaaaattttgttactggttttcctntcccnaaaattaaaattttttgggcttccttggtttgggtttgaaan

SEQ ID NO: 127991 - DNA, 632 bp, Homo sapiens
  misc_feature (6)..(6): n is a, c, g, or t
taaggntccccggatccagcaaacctttccaagccccactggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127992 - DNA, 410 bp, Homo sapiens
tcgtcttgactttggcaaatgagccggagccccttgggcaggtcacacaacctgtcccagcgagggacaccgagtggcccttcatgtacatccatggtgtgctggcttaaaatgtaattaatcttgttgggagcttaagctcccaacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127993 - DNA, 247 bp, Homo sapiens
gcggccgcctactactactactgctcgaattcaagcttctaacgatgtacggggacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127994 - DNA, 219 bp, Homo sapiens
ctactactaaaacagcggccgtgcgaccaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127995 - DNA, 496 bp, Homo sapiens
  misc_feature (66)..(66): n is a, c, g, or t
tcaatctcgaaattaaccccctcacctaaagggaacaaaagctggagcctccccacccggtggcgncccgcctcctagaacctagtggatcccccccgggctgcaggaatttcggcacgagcccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127996 - DNA, 609 bp, Homo sapiens
  misc_feature (567)..(567): n is a, c, g, or t
  misc_feature (570)..(572): n is a, c, g, or t
  misc_feature (595)..(595): n is a, c, g, or t
tcgtcttgactttggcaaatgagccggagccccttgggcaggtcacacaacctgtcccagcgagggacaccgagtggcccttcatgtacatccatggtgtgctggcttaaaatgtaattaatcttgttgggagcttaagctcccaacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggagctaagctcccaacaagaaggttaacattttctgattcatgttagactttgaagagactaaagaaaattttcagaggaacatatgcctgagaacctttgcatgaatttaaaatttcattatccattcttataagaaggaagatgattgtaaaganatnnnccgaagttaaatctgtataggantgatcatctctaag

SEQ ID NO: 127997 - DNA, 467 bp, Homo sapiens
ctgaatgatagggatgattaggttctttctgatcctggagctgaatggctcccaaattaattttattgaattttgattaggtaacgtatatgagtctgaattttctcacccttgcctaagcctttttattgtattttaacttttatttatttattcttttgagatgggagttttgctccttgtttgggagcttaagctccccacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 127998 - DNA, 736 bp, Homo sapiens
tgttgggattacaggcatgagctaccatgcctgatctggttatctttttcatgaaacttagatttctctgtttaagtaaagatatagatatacttatgaaagacagatatacttataaaagacagatatactaaatttctgaaacctaaatttctctctttacatatgtctgttcttctatttgattctactaaatttggggcagtctttttgggagcttaagctccccacaagaggagagtgaagaggaagagctcaaaaggtttgctgatagaactgggtccccacccaagctccctgctttccccagtaccccttcacggtttttccactgcctctcactggggccacatgggacctcttgtagggaccatggttgtggcagccccttcctagagggccctcggagaagtccccgtgcgtcttgttgggagccagctccccaccagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggtgagcttcagtcctgcgactcgtctct

SEQ ID NO: 127999 - DNA, 595 bp, Homo sapiens
aaagcctgagacagcgttcttttgagggactgagatgcaggatttcttcacgcctcccctttgtgacttcaagccctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128000 - DNA, 626 bp, Homo sapiens
agggataattggactattgggtaaaatttagatcatatggtcattattgcctgtgccaagaaacaaagaccttgagggaaagaaagcagttacagtatattaactgctcagctatttctagtgattagtcctcatttctggggttagggctgggtctttactagatgtgtacccgctagttagtgactaagttaggggctatcaagctgacttcacacaagccagttggtttacatttaacattcttaggtctagcatgaggcattcacctctagtccagggcaggctgtggtgaagtaccttctcttataatttctactataaagcagtaaaagttgtttctcatcttagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaagaggtaagatttgaaaaggatttcaggatcttatgaagcacctttatacagagtggaactgtttatttccataggtttttggggaacaggtggtattttggttatacaagta

SEQ ID NO: 128001 - DNA, 555 bp, Homo sapiens
  misc_feature (236)..(236): n is a, c, g, or t
aactcaggggcgagctgccagcaccagccatggccaaatacgtcaagatcctgtatgacttcacagcccgaaatgccaacgagctatcggtgctcaaggatgaggtcctagaggtgctggaggacggccggcagtggtggaagctgcgcagccgcagcggccaggcggggtatgtgccctgcaacatcctaggcgaggaactcaggggtgagctgctaactcaggggcgagctgcnaactcaggggcgagctgcaactcaggggcgagctgctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctcgcacctgagttgcgctacgcct

SEQ ID NO: 128002 - DNA, 714 bp, Homo sapiens
agttcgacggagactctcagccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128003 - DNA, 852 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128004 - DNA, 912 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagtggctgcatttcctttggaaagtgctgaccctgccggggtggctcccacaactgccaaagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128005 - DNA, 1252 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaacaaacaaaaaaaaacaaaaaaaaaaaaaaaaaaaaaaaaaaaaaaaaaacagaggggggcgcgccgcgcatcaaaagatataccccctgaggggcgcccaccaaactaacgccgcacccccgaggttttctgttaagaaagagaggggccccacataagaagggaggcctcgtttatataaacagccctagaggcggacgggggccagccgttgttttaaaaaacaaccgttcggcggaacgaggggagaaaaacaaagtgggatcagaggcggggaaactactgcggagagaagaggaaccacccattaagtccggggggggggggcaccaaatcatgcggcgacaaacactcaccccgaagcagaaaattttaagcagcgctggcggggcaacaattagagaaattttgaggggtcacaacg

SEQ ID NO: 128006 - DNA, 1218 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaacaaacaaaaaaaaacaaaaaaaaaaaaaaaaaaaaaaaaaaacccgggggcacatctattgtgcgcggggcgcgcgggaaaaagagggtatctagtaaaaggcgcccctgtgtgcgccactaagcttgtccctggtgccccacttttctgtggtgcgaaccacgagggtggggaacactctagccgcgcacactctcccaatagagagaagggcgcgattaataatcttgcagaaaaacgcggtggtatactgccgggatttttaaaaatgtcatcggtaggaaagaaaaaaaagcgagccacaagagcagcataacgcgcacccgcaccatattgtgcgagccgactatagatagatagagatccatcaccagcgagctcctccactag

SEQ ID NO: 128007 - DNA, 1254 bp, Homo sapiens
  misc_feature (1119)..(1119): n is a, c, g, or t
  misc_feature (1254)..(1254): n is a, c, g, or t
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaacaaacaaaaaaaaacaaaaaaaaaaaaaaaaaaaaaaaaaaaaaaaaaaaaaaaaaaaaaaaaaaaaaaaacaaaaaacaaaaaaaaattggggggcggcccggccccctcacaaaagcttttccagaacccaactgtgtgtgggggaccgggggccccagtaaggtcaactgcgacacatgagtgcgcaactaacgagggggtcccaagggcagaacgcggggggcagaagacaaagcggcgtgggagatctcccccccaaaataaaaacccggccgcggggaggcagancacggagcggtctgtagacacacctcccacaaggggactctcaggcagccgcaaatacgaggggcgctctcatcaaccgcgggagcctccaaggggaccacccgcatttaaatttaagccgcgggatggggaggn

SEQ ID NO: 128008 - DNA, 968 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggcaaacaacacacaaaaaaaaactccggggtctttttccggtcgcggaacaaaggttttgatggcccgtggtcaagttttcccggacccctttttgtccacgggtaattcccggcccaaatagggctatcgaaaccggacgtg

SEQ ID NO: 128009 - DNA, 1157 bp, Homo sapiens
  misc_feature (828)..(828): n is a, c, g, or t
  misc_feature (832)..(832): n is a, c, g, or t
  misc_feature (835)..(835): n is a, c, g, or t
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggcnacanaanaaaaacacaaacggggcccatacagaatcccccaggcggccaaattatcgttcacgtttggtaaaagtggcccaataggtagcgcacaatatgctcagagcagacaggataaacaactcgagcatgggaaccgtagcagcgaaactggagaggacaccatagtgggggcaaggaataacaagaactatacgtctgggataataattagctagcataagtatcttgtgtattcatattacaaaggcacaatcacaatacgccgactaacgtgtatgatgaaaatcaacaaatatcatatctccttcgttcccttccgtcgtga

SEQ ID NO: 128010 - DNA, 879 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggtgagcttcagtcctgcgactcgtctct

SEQ ID NO: 128011 - DNA, 1265 bp, Homo sapiens
  misc_feature (1265)..(1265): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaaaatttgggggggggggggccggaaaaagtttttaaacaccatttgttggggggggcgggcccaaggggtaggggaaaaggggccaaggggggcccagggaaccccgcgcaggactaagcgtgggggttcccccaaaaaaaaaagcggcgcgcgacaccgggtgttctgaacactccagatgggttgcgaggctaactggtccacacacagggtcacacgagcctaatacgccccgcgccgcgcgggggaacgcacaagacacgagaaagacgaagaagcacagagagagcgcgacacaaacaggagacagaagagaaagaagcagacagagacaggagaagagacaacaaaaagagcacgcaacgacagaagagcaccggacaagn

SEQ ID NO: 128012 - DNA, 1187 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaaaagggggcccccaaattttccccgggggccccattaccggacgttccccagcttttctggtggtaacaagggtgccccctataaggtagaagcggttatatataatcgctaaggcacctggccgcatcgtattaacaaaccgttcctgcagtctggcaacacgcgctcacctgagaacacttgggaaaagacccatacttcggtggggggcgacactcgtgggacaaactaccctacacaagtataaacgcctcacagcgaacatcaataaatctcagcggcctacacgggtgtaacaccagctgcat

SEQ ID NO: 128013 - DNA, 1260 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggagctaagctcccaacaagaagctaaatccaaagaaatatgaaggtggccgtgaattaagtgatattattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcggggccgagaggacagaatggatataatctgaatcctgttaaattttctctaaactgtttcttagctgcactgtttatggaaataccaggaccagtttatgtttgtggttttgggaaaatatttgtggtgggggaaatgttgtgggtgagtctg

SEQ ID NO: 128014 - DNA, 881 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaattcaatagaataaacgaca

SEQ ID NO: 128015 - DNA, 892 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggctatctctcacgggggatcgctctagatgtcgatcctgca

SEQ ID NO: 128016 - DNA, 1236 bp, Homo sapiens
  misc_feature (1101)..(1101): n is a, c, g, or t
  misc_feature (1236)..(1236): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaaaacaaaaaacaaaaaaaaattggggggcggcccggccccctcacaaaagcttttccagaacccaactgtgtgtgggggaccgggggccccagtaaggtcaactgcgacacatgagtgcgcaactaacgagggggtcccaagggcagaacgcggggggcagaagacaaagcggcgtgggagatctcccccccaaaataaaaacccggccgcggggaggcagancacggagcggtctgtagacacacctcccacaaggggactctcaggcagccgcaaatacgaggggcgctctcatcaaccgcgggagcctccaaggggaccacccgcatttaaatttaagccgcgggatggggaggn

SEQ ID NO: 128017 - DNA, 1084 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacagaattaacaatgtaaccatatggaagcaactttttttggtgtctcaaaggagtaactgcagcttggtttgaaatttgtactgtttctatcataaataaagttatggcttcttgttgg

SEQ ID NO: 128018 - DNA, 778 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatgaattaacatgtaccatattggacgagcaccgggatcctctaga

SEQ ID NO: 128019 - DNA, 732 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcatccggagtgactataatggggaagactttaaagggaatggaggaagagactgaaagaaatgaaagcatgtta

SEQ ID NO: 128020 - DNA, 787 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcaccccgcccctgcgttgagagcaatttcccccccccccctttttaacccccgtgtttccccccccccccccccctgggcctctctttgtttttgttgccggctcctttccctggggttcccaggggta

SEQ ID NO: 128021 - DNA, 807 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128022 - DNA, 1028 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagagcgatgatcaggtgcacaccacctgagtcgatgggtttgccggcggcctgggcctcttcgatcatttggatcaagggccaggcgcgtttgcgcaggctgactggctcctcgacaaaaggcacggactcgcgttcatccaccattgcagacgacacctcatccgataaggcgttcaacatggcaagagcccgaggcatatcctccggctcaatgatgcccggctgctgggcgaccttacccaacaagccaagcagcttgttacccaaatcattcaaaagcagcaaatccgcagtaacgccacagcgcagcctaatcgtcatttaacgtccccgcgagcctcacttgtagataagtctacgcttgcggatccagtggtcaatggcttaaagcgtgcggctcaagctgtaagcatgatta

SEQ ID NO: 128023 - DNA, 649 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagagcgatgaaacagtgtagaaattgaccggggtcctctag

SEQ ID NO: 128024 - DNA, 881 bp, Homo sapiens
  misc_feature (635)..(635): n is a, c, g, or t
  misc_feature (782)..(782): n is a, c, g, or t
  misc_feature (795)..(795): n is a, c, g, or t
  misc_feature (814)..(814): n is a, c, g, or t
  misc_feature (848)..(848): n is a, c, g, or t
  misc_feature (873)..(873): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggggagagccggccctgaggcagnagaatcccccctcaactggttgcacctcatgtccctcccgcacacgttgactctccctccttaatccccagggaccccgaggggttttcccacattttcccggcaggcaaggagccaccgattccccctttaaggaaggcgtttgantgttacgggcggncgccaggaggggcccaaanttaagttttggtttttcgggggaaacgttttttnggggagcatttttttttaaaatccntgtttggg

SEQ ID NO: 128025 - DNA, 766 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacagttgtagaagctaaggacataccattggccctcgcacaagcaaatgtgcccggcgcaaaggaagcctttccctggacaccccaggcttgatattctaaatgccatttcgaaataaccatgtcccatattgtaacgaatttttttccagcccaaagtataaccgcccctctcctaaatttgaaccgcacattcc

SEQ ID NO: 128026 - DNA, 603 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacatccggaatcactatcaggtccgtacggagccg

SEQ ID NO: 128027 - DNA, 1039 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacagaattaacaatgtaaccatatggaagcaactttttttggtgtctcaaaggagtaactgcagcttggtttgaaatttgtactgtttctatcataaataaagttatggcttcttgttgg

SEQ ID NO: 128028 - DNA, 503 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagtctctctctgtatgggggtg

SEQ ID NO: 128029 - DNA, 531 bp, Homo sapiens
  misc_feature (527)..(527): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacccttgaactttgaatttctcaacagctgctagttgtgcttgctgggataaatcttcgatctgcttccccgaaactatgtaagtatggtncaca

SEQ ID NO: 128030 - DNA, 396 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtagatccgatatctgggatcctctagaacaccgcagcaca

SEQ ID NO: 128031 - DNA, 309 bp, Homo sapiens
gatgatctagaggatcccggatatatttcacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128032 - DNA, 794 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaagaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagctcgcccctgagttagcagctcgcgcttgattcagcagctcgcctgaggtatcacctcgcacctgagtaaacagctcgccctgagtaagcccaggttccc

SEQ ID NO: 128033 - DNA, 694 bp, Homo sapiens
  misc_feature (559)..(559): n is a, c, g, or t
  misc_feature (694)..(694): n is a, c, g, or t
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaagaaaaaaaaaaaaaaaaaaaaaaaaaaaaacaaaaaacaaaaaaaaattggggggcggcccggccccctcacaaaagcttttccagaacccaactgtgtgtgggggaccgggggccccagtaaggtcaactgcgacacatgagtgcgcaactaacgagggggtcccaagggcagaacgcggggggcagaagacaaagcggcgtgggagatctcccccccaaaataaaaacccggccgcggggaggcagancacggagcggtctgtagacacacctcccacaaggggactctcaggcagccgcaaatacgaggggcgctctcatcaaccgcgggagcctccaaggggaccacccgcatttaaatttaagccgcgggatggggaggn

SEQ ID NO: 128034 - DNA, 826 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128035 - DNA, 931 bp, Homo sapiens
ctagttctagatcgcgagcggccgctcgcgatctagaactagcaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaacaaaagggggggcgtaaaatttcctagggggggcaagttacacgaccagcttttttacaaagggccaaaaggagaatttaagaagactgggggctaacagtgtgatggcatgtacggattggagggaca

SEQ ID NO: 128036 - DNA, 585 bp, Homo sapiens
cggggcggtctagaggatcccggtcaatttctacacaaaacagatcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128037 - DNA, 384 bp, Homo sapiens
  misc_feature (1)..(1): n is a, c, g, or t
naattcgcggccgcgtacgaccggctgcgcagaagacgacagaagggagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128038 - DNA, 675 bp, Homo sapiens
atacgctagtcgaggctgggttcaatcggccgagggcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128039 - DNA, 935 bp, Homo sapiens
  misc_feature (877)..(877): n is a, c, g, or t
  misc_feature (903)..(903): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggaaaaaaaaaaaaaaaaccgggctnttttgggggggaaaaggttaagggcnggcttgtccgccctttttgtcagggaatcgcg

SEQ ID NO: 128040 - DNA, 944 bp, Homo sapiens
  misc_feature (910)..(911): n is a, c, g, or t
  misc_feature (916)..(916): n is a, c, g, or t
  misc_feature (920)..(920): n is a, c, g, or t
  misc_feature (925)..(925): n is a, c, g, or t
  misc_feature (933)..(934): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggcaaaaaaaaaaaggggggcggctaaaaatcccgggggccaattacgtacccgttttgnncaagngccntaggnataaaaanngcggcgggta

SEQ ID NO: 128041 - DNA, 1226 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaacaaacaaaaaaaaacaaaaaaaaaaaaaaaaaaaaaaaaaaaaaaagttttttgcggcgcggccttgggccccggaaaaaaagtttttattataaacacatattctgcgtttggggcgcgcgcgggggccaagtataggggctaccgtggaaactatgtgggtaatataggctggggttcacatataggagaacatctctgggcgcacatagaacctataggtcgttgggagtttcctcaacaattataaaaaaggcgccgggggggaaaaccgcgagcgcggttctttaagacacaattctcacgaatgggggggtccagaggggtcttagcggggctcatctcaacggggaggtgtcatacggaggagtcgaatattaaattagcccgcatggtgc

SEQ ID NO: 128042 - DNA, 877 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggcttgggatcctctagagtcaccca

SEQ ID NO: 128043 - DNA, 892 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaagtcgacgcggccgcgaatttagtagtagtaggggccgc

SEQ ID NO: 128044 - DNA, 1011 bp, Homo sapiens
  misc_feature (861)..(861): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaacaaacancaacaaaaaccccggagcatatattacgcggccgagcaacgggttgactgggcatgtgctagctttcctgcccgtttttgtccaggggactgcggccccaagggggaaatcgacctgggtccctgaacatgtacctctctgctcgtcgag

SEQ ID NO: 128045 - DNA, 898 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgctctgtggtgaggtttttgcgtggggttgtgatgtggggggga

SEQ ID NO: 128046 - DNA, 1051 bp, Homo sapiens
  misc_feature (1009)..(1009): n is a, c, g, or t
  misc_feature (1012)..(1014): n is a, c, g, or t
  misc_feature (1037)..(1037): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgggagctaagctcccaacaagaaggttaacattttctgattcatgttagactttgaagagactaaagaaaattttcagaggaacatatgcctgagaacctttgcatgaatttaaaatttcattatccattcttataagaaggaagatgattgtaaaganatnnnccgaagttaaatctgtataggantgatcatctctaag

SEQ ID NO: 128047 - DNA, 988 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaacaaaagggggggcgtaaaatttcctagggggggcaagttacacgaccagcttttttacaaagggccaaaaggagaatttaagaagactgggggctaacagtgtgatggcatgtacggattggagggaca

SEQ ID NO: 128048 - DNA, 920 bp, Homo sapiens
  misc_feature (769)..(769): n is a, c, g, or t
  misc_feature (808)..(808): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatgaattaacatgtacatatggaagcacttttggggnctcaagggtactgcggtggtgaattgcgggcataaaaangtagggctcttggtgaaaaaaaaaaaatcagggatatttgggggagaaagagatagaagggaagggtaaggttcgtacactttgcagggaaaagggcaaagagtaaaacgaa

SEQ ID NO: 128049 - DNA, 1509 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacagaattaacaatgtaaccatatggaagcaactttttttggtgtctcaaaggagtaactgcagcttggtttgaaatttgtactgtttctatcataaataaagttatggcttcttgttgggaaaaaaaaaaaaaaaaaaaaaaaaaaaaaaaaaaaaaaaaaaaaaaaaaaaaaaaaaaaaaaaaaaaacaaacaaaaaaaaacaaaaaaaaaaaaaaaaaaaaaaaaaaagagggggggggcgcggcacacaacgaacctccccgctgcggcgggcggccgacgagcaacgacagcccgcgtcgtgtttaaaaaaagaaagcgggccccaacaaggggaggaggcggagaagtaaatcgaacaagaggcgaggggaggccataacaaaacaacgcggaggtgagaaaagaaacaacaccagcggcattaaggaaaggcacaacacaacatcagccgaggggagaaaaaaaagggagaaaaacacacgcagaaacaaagccgcggagaaggacaaaacagaagacgacagaagcgagggggacac

SEQ ID NO: 128050 - DNA, 744 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacacgtgcggtatgaacacgtgagacctctagacaccccca

SEQ ID NO: 128051 - DNA, 1199 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagggtgagtaaacttttcttgggcattgttccagaccagggtttctcaacctcagcactgctgacattttgcgtcagatagttctctgttatggaagggctatccattacatccagttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128052 - DNA, 750 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaagaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128053 - DNA, 1195 bp, Homo sapiens
  misc_feature (678)..(678): n is a, c, g, or t
  misc_feature (1188)..(1188): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagagcgatccgagagtcgtcggggtttcctgcttcaacagtgcttggacggaacccggcgctcgttcccncaacccgggccggccgggccatagccaggcctccgtcacctcttcaccgtacctcggactgtcccaagggccccggcgcggtccagcgcgcgcaggcaccggcgcggcgcgcgtctcctttagtgcgccgccatgaagaccgggttcaccttcgcaggtgcgccagaataacacccggggtccaaaaggggcgcattaacggcaataaacttggggctttagaccctaaagttcctgccacgttcaacaaatttgagcgcgaaaagtctgttagaacactgtgcacaaagactttccaccacatctcggaggaaaacactgtaaacactaatgcgcaccaggaggggacatccgagaaaacacacgtgtgagtaggagaagcaaaaaagggcccaaaaaccacaccgaagggaaaacacggtgtgaaaaaaaagcaaagagggaaggggaggaaaaagagagtagaggggattatatatagaattcgtcttcttgattctcttctggggnggtttgg

SEQ ID NO: 128054 - DNA, 811 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacagtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128055 - DNA, 715 bp, Homo sapiens
  misc_feature (578)..(578): n is a, c, g, or t
  misc_feature (583)..(583): n is a, c, g, or t
  misc_feature (595)..(595): n is a, c, g, or t
  misc_feature (661)..(661): n is a, c, g, or t
  misc_feature (669)..(669): n is a, c, g, or t
  misc_feature (694)..(694): n is a, c, g, or t
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacatgttacnaaggngggaggagttgnaaggaggggaaggaggttcggtttggaaacaggtttttagggagttttaagggactttagattttnggtccttnttccaccaaggcaattttttttccngaggagccaaaggccgttttt

SEQ ID NO: 128056 - DNA, 1431 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagggtgagtaaacttttcttgggcattgttccagaccagggtttctcaacctcagcactgctgacattttgcgtcagatagttctctgttatggaagggctatccattacatccagttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacagaattaacaatgtaaccatatggaagcaactttttttggtgtctcaaaggagtaactgcagcttggtttgaaatttgtactgtttctatcataaataaagttatggcttcttgttgg

SEQ ID NO: 128057 - DNA, 856 bp, Homo sapiens
acacaaaaatataggtcaggtacgaggctgggtggcgctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttttttccaacaagaagccataactttatttatgatagaaacagtacaaatttcaaaccaagctgcagttactcctttgagacaccaaaaaaagtcgacgcggccgcgaatttagtagtagtaggggccgc

SEQ ID NO: 128058 - DNA, 1003 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacagaattaacaatgtaaccatatggaagcaactttttttggtgtctcaaaggagtaactgcagcttggtttgaaatttgtactgtttctatcataaataaagttatggcttcttgttgg

SEQ ID NO: 128059 - DNA, 410 bp, Homo sapiens
acacaaaaatataggtcaggtacgaggctgggtggcgctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgg

SEQ ID NO: 128060 - DNA, 303 bp, Homo sapiens
ggagggcagtggggagagtggggagttcatgttgaatgggtatacagtttcagtccgagatgaggaaaagagttctggacatggctggtggtgagggttgcacaacaatacgaatgtacttaaaaccactcacctgcacactgaacaaatgattcggatagtaatttttaggtgtgttttgccacaatgaaaaaaaaaattaagacaggcacagtggctcactcctgtaatcccagcacttttcggaggctgaggcgggcaggtaacttgaggtcaggagttcgagagcagcctggccaacat

SEQ ID NO: 128061 - DNA, 220 bp, Homo sapiens
tgatctagcggtcctaactcccggtccagagctcttttccccacatcacactgcccccttgggagtccctgatgacattacaaatctctgaggggaatgggtggcagggtagaaggcatctagggtgctcgtccagcccagctttgttgtttaccagctgtgggccgtgcacaactcccctcacctcagcaaagcggggctaacagtcacaccctgcagt

SEQ ID NO: 128062 - DNA, 481 bp, Homo sapiens
gtagggttctaagactgtataggatctaaaaaatataaaaatattgtccacatggtgctcaaatcctcaagaagttcaaaactgcaaacatgaattttttagtgaaaaggtgtatacagttttattttgtggttttatcataaacagaatgtagaattcattttcatgttttaaaaaatccctttcagtggtagtttaataaggctggtatgtagttgtatagactggacactgcacacaggtatgccttctaagagggtacctttcactttgtggacatcttaaacatttgtcagcagatggcagtaaagaggaaggatgtccttttataatttgcacacaagcaccatatggactaatagcaaacatgtagttcagtatagcttttttcttgaaagaagagaaatttttatataagacaaccatttaaaatttcttttttggtggccgggcacagtggctcacacctgtaattccagca

SEQ ID NO: 128063 - DNA, 689 bp, Homo sapiens
tgaaaggcaccagggccttcaacggcagcgggcgggggcagacggtgcagcagagggttgggggggatggtggcaccagactccacacttttccttacagctcttgcacctcccagttgtgtgacccaggacacatctctctacctccgtgtgcctcatcttgaatcggcacagtaatgacagcacctgcctcgtagggtagcgtgaggtgtagtaagcaagttaatatattaacacacagtgcttggcacatgctaagtgctggagagacacagggaacagatctgacccatggcctggaaaggtcactttggcacagaataggccctaaagagtcactgggtcaatgggctggagcagctgtggacagaagggaagagaatccagtttacaggtggttgcagaatcccgtgaggggatccaggaggctggaactggggaagagcagaaggatcaacacgagagatttggacagtgattctatctacattcagcgtctgaccacaggcctggagttgagtgcacacgtggagcctctgcacacactgcactgattgagtctgggaaggtggtcaggggagacctccttgcgctggagcagacgggaaggaagagaagcctccagcagcaggaagggctggagaaaaggcattctaggcagaaggaacagtgagcgccaagtccctggg

SEQ ID NO: 128064 - DNA, 678 bp, Homo sapiens
tacccccagcaaccccactgcttccccttcttggtattaagtgcaattaaagccgtgggtgtcgcatcttctccagcgctgggccctcccttgcccccaagctcaagaagggggcactgcccggcccggctgtgaggagggcggcagggggcacggcctccagcttccaaagagcagcgagccgcggagccggggagtgcccacagaccccagcccccgcgcccccgccctccgccgctggtttgtaatggaaccttttctgtgcccctatcttcccggagaccacgcttctcctccgtgccgtgcgacccccaccccatgactattgtgcgattcgtgagcgccgcccgagcggagttggtaacttgttgggtttttttccaaccatcatggccttatctgttccagttttctcagtgttttcagcctgtgagatagatgtttatggcaagaaaaaggaaaaaaaaatggaaatctgacctattgtataaaaatcactattttgtgtgctccgcgtgctatagcttttggggcggccctgcccagtccccgtgcccacggggctccctctcccggtggtgaaagtgtccacacgtgtggtagtctagtgtgccgagctgttttctacctttttgtagtctttcttaaaacaataaattccgctgtgatatttgccta

SEQ ID NO: 128065 - DNA, 209 bp, Homo sapiens
  misc_feature (43)..(43): n is a, c, g, or t
ttggggtttgggacccttacccaccgggtccggggtttgggtnccctttaaatagcttttggggcggccctgcccagtccccgtgcccacggggctccctctcccggtggtgaaagtgtccacacgtgtggtagtctagtgtgccgagctgttttctacctttttgtagtctttcttaaaacaataaattccgctgtgatatttgccta

SEQ ID NO: 128066 - DNA, 384 bp, Homo sapiens
ctgaatccaagctggtcacgtgactccagttccagccatgacaccctaatgcaggtacccatgcaggatgaaaacaaaggaattatagggctctgagcacgtttcactatatataacctccctctcatccaatattctaagcagcaaatgaatacaatgaatatcaacttctaacttcaaaaaacttgtaggtggaaatgtatctgcataaaaagcagttgaaaagagatctattaaactctacacagattgaggcacttagaaggtcctagcgatcagggcttatctttatttattgccaggttggaggtatatgagtaaatattgacactgtttctgttgttatatttctatatgaatacaagctaacggcttcaccagtcc

SEQ ID NO: 128067 - DNA, 194 bp, Homo sapiens
cggtgaggtaccggagctgccaggatttctctgcaggcccctcagtgagtgtctgatccacacgttctgacagaaggaaggtgaggtgtgcaggaggcaggggcagtgaggacaggctgtggagttcctcacctggtacaactgagtcatgaaggaagaatcgggccttggtgagagctaaggggctactgttc

SEQ ID NO: 128068 - DNA, 598 bp, Homo sapiens
aaggacagctactcaaatattagatttttttttatttattttttattttttaaagtcagggccttgctctgtctcccaggctggaatgcagtagtgtgatcatgactcactgtggccttgacctccctggctcaggcacttctcctgccttagcctcctgagtagctgggatgacaggcacacagcaccacacccagctaatttttaaattttttgtagagacggtgtctcattatgttgcccaggctggtctcaaactcttaggctcaggtgatcctcccttcttggcctcgtgaagtgctggtattaaagcatgagcaactacatccagccactagaatgtattttcaaggaagtacttatagaataataatatttgagtgcagctgtgtcttcactagactgtgtattcagatgactgtatatttcacatgactatacagtcatccttcgatacctgtaaacctccctcggataccaaaatcgtggatgctcaaatccctgacacaaaatgcatagtatttgcgtgtaacctatgcacatttctcttatatgctttaaataatctggtgtgtgtatatatatatatatatatata

SEQ ID NO: 128069 - DNA, 408 bp, Homo sapiens
ctggggaaggatgagacaggttcagggggtagcagtgcaacaacgtgagttggtttcagagagaaggacgagcaggagtctggaccagagtgagaaaggccaagatggtgcagagaggacaggcgggctggcattctgctttttgattgggggaaggtatgtggttgccaccctttcatcctatcaaataagaataattaaaaaaaaaagactagaatctattcttctcattattttgcaaaaggacattcatttccccagttaggaaggaccactatcagcaggtcataaaattacaatattttgccttccagatggcatcccttatactcctccttattcctggaaaaagcatacaaactccctgtcaagctgcctgtaggatttttggttcccagcttgctcaga

SEQ ID NO: 128070 - DNA, 506 bp, Homo sapiens
ccacgcccggctaatttcttttttgtatttttggtagagacggggtttcaccatgttagccaggatggtctcgatctcctgacctcgtgatctgcccgcctcggcctcccaaagtgctgggattacaggcgtgagccaccgcgctcagccattgggtgtaaaattaacagggactactttctatcactatgtcggaggtggatgactatgctaactagacttgaaaagctacagactacggatctcttcattggcacacaactgagccacctgagtaaatcactctcccttcatcccttgttgacattcagcaaatcctgatggtgcttctgccatgcaccaggcctctaccaagggctgcagcaaatataaacatgactgtggttcaggctgccccccaaaaaggagcctcctaatagaaggagtgcccccttcatcttcctgtgtcccctgccctgccagtgtttgcctcccgtcttcagtcctgttttcagtcacctgcttca

SEQ ID NO: 128071 - DNA, 603 bp, Homo sapiens
gcaacaggaaagtatgatccattcacaggatataaagaatttcacagaaaccatacctaaagaagaccagactttggaattattagtcaaagatgttaaatcaattgttttaaatatgttcaatatgttttctaaaggaaaccatgaataaacactaatagaaatcaagaaaacaatgtctgaacaaaatgaaagtataaatagaaattataaaaaggagccaaacaaaatctgcaataactaaaatgaaaaatgcaatagagggattcaacagcaagtttgaacaaggaaaagagaggactggcaaaattgaagataagacattgaaaattacccagtctagggaaaagaaagaaagagtgaagaaaaatgaagacagcctgaggaacctatgggacctcatcaagcataccaaatacacattataggaatcccagaaggagaagacatagagaaaggagcagcaaaaaatttgaagaaataatagctgacaacttcccaaatctgattaaaaacatgaatatatacatctaagaagctcaatgaactccaagcaggaaaactttgaagagatacacactgagacatatagtcaaattatca

SEQ ID NO: 128072 - DNA, 393 bp, Homo sapiens
tcatcataacgtgacccagcgacctgtgtgtcccacagcccgtccgtccctctgcagtctccctgcactggcatgtcctgggtggtcccagtggcaccttctaggcccggcccctggatgcggtggaggctgcccggggtgggtcagcatggggttgtccctgtgagcacagctccgggagacccgtactcagaatcctccagctctctcgcctgaggcggaaatgtgacttgggaattgtcctccatataaaggaagcaaaatcagggcctaggggtgagctgcttactgtgcttcttccctctctcagcctccaatcggggggcacaggcgtttgattcccgcgacgtctgtgggctgtcactgtccagcctctgcgtcccacacctgggc

SEQ ID NO: 128073 - DNA, 789 bp, Homo sapiens
aacgttaatcagggatattgacctgatcttttcttttattttcctttcctctttcctttcctttcaatttttcttttttcttttctttcttcctctctctctctctctctctccctccctcttcatttttcttttttaaagaaacttgaccaaaagacagtacataaacactggcaattgaatgttgaatgtcaccgtatgcatgaaagtatgtattttgtggtaatgtgagcttttaatattaagtcatattaaattcttaagttaaattaagcaggcctggcgttggcagtgtagccatacctttctgatgttagtaaaaacaaaattggcgacttgaaattaaatcttgccaaggttttgatacacttgtcttaagatattaattaaacacttcagaacattgatacgaagtgtccagattctgagatgtttgttgtgtgaattttgtttagttatgtgtgtggttttttttttttttcagtgaatggcacattgcaatcctcaaacatgtggttatctttgttgtattggtgtaatcagtgacttgtagattcagcaatagcatttgagcagtcagttttatcagcaagcaatattttcagttaataaggattcaaaaatcatgtaaagatttaaacttgccgaatgtaaagattgaacctcaagtcactgtagctttagtaattgcttattgtattagttcaggttctagcactgcatgtgctgtgcatattctgattttattaaataaaaagatgaactgcaaaacaaaaaattttctgaaaa

SEQ ID NO: 128074 - DNA, 150 bp, Homo sapiens
cttggcttcctatttcacctagaaaatagaagcaatggagagaacctctacaagcagcataatccaccagcctaactccatctgtacccacaccctctgtcttttctcccgtttctcctgaatggtctctcctccccgctggagtgcagt

SEQ ID NO: 128075 - DNA, 322 bp, Homo sapiens
acatttattgattgaatagtcattacatttacatggttcaattttagaaaatgtaaaaggcttcctcctgtctgcgctgctaaattccctgtccagagtcaatcagcgcttctactgtattctaccagttacctttttctttggactcttttgttattggtgtcatgtctgaggaataattgcctgacccaaggtcatggatgttttctcctgtgtcgtctcctgagagttttataggattacaggtgtgagccactatgccaggcctgaaacaagattttaattctgaaggccagatacctttttcttttgtcacttttga

SEQ ID NO: 128076 - DNA, 278 bp, Homo sapiens
aaaaaaaaagaattttttagagcagtttgagatttccagagtgttgcaaagagagtgcatagtttcattgacaccacacccactttctcccatgttgatttttattggtaacaactaatgaaccaataccgacacattatttattttattttttttttttgagacacggaatttcgctcttgtcacccaggctggagtgcaatggtgcgatctcggctcactgcaacctccgcctcctgggttcaagtgattctcctgcctcagcctcctcagtagct

SEQ ID NO: 128077 - DNA, 618 bp, Homo sapiens
tgaggggagaggatcacttggggccagaagttcgagaccagcctgggcaacatagtgagacctcgtctctacaaaaatatcaaacaaattaggcaggcatggtggcacacgctgatagttccagctactcaggaggctgaggcatgaagatagcttgagcccaagagtttgaggttacagtgagctatgacagtgccactgcactccagcctgggtgacagagcaagatcctgagatacatacatacatactcaacagtttaaaaagcaaacaaatccagttagaaaatgggcaaaattcagcaggtcacagaatgaaatgaagagaaaaaaaaaattttttaaagaaaatgggcaagacatgatgagatatttcactggagaacatatataggcagcaaatacacaagtgaaaaagatgttcaagatcaccagccatcaggaaaaagcagatcgagacctcagtaagatactgctgtacacctgttaaagcagctaaaaaaccaaccaccaaaccaagacaaccagcggcaacaccaagcggaggtgaggaggcggagaccccggacctctcatacactgctagtgggaatgtcaaatggcacaaactagaaaacag

SEQ ID NO: 128078 - DNA, 442 bp, Homo sapiens
ggctgaaggctactgggtgcggccactgccccagctgactggagtgggagatctggctattcattctggctccacatggacgctccagccaccttactgcctcctgacctaccacctgcacccccaaccttccaggtctcactcgcaggtgtcaccagcctaactgatgccttagcagtgacagcttcacctgtgtgcacagcaaggccatgtgcaattttatggaaccactagaagactcaagacactttcagaaccatctatataaattgctaatgctgaaaagacctgaatttggtcaagatggtagaggaagtgttttcctcctcggttgggactttgtgagtctgctcagtacccctgaaattacacaaattggcagcaactcattctactttggaaatggtcactaaggcatgccatggtaaggagcttctctgtg

SEQ ID NO: 128079 - DNA, 445 bp, Homo sapiens
gcccttaatgggttttttgatgcagttggagcaagatttcctttataaggggtttggataatatttctctttggtttagcaatatttattttctttttgaattttcattagcacctattttttaaccttttaatgtaggtaaaaatccatatttttatgcctccttataattcttttagtaaaagtatatttcactttccttacatgctttgcacataaactgtttctttaatagttttacatttaggacacctaattacttttatacaatattccttgcataaattccctattataacattttttacaactttcataggccatctttgacatgcctcaactttctgacttcttttaacactatttctttccccagtcacaccttctgtgtctttctgtaatctctgtctctttcagcctctctttcacttattctctccctctg

SEQ ID NO: 128080 - DNA, 468 bp, Homo sapiens
  misc_feature (238)..(238): n is a, c, g, or t
  misc_feature (421)..(421): n is a, c, g, or t
agcccagaaaaggaaatgacaggagaaaggcgttggaggtttcctgaggggcaggaggcgagagctttctcataaaggccaaacaagagagaaaataaagacccccacagtttaatatattttgtaaaattggagaatcttgaagataaaattctaagttttctgaaaaaaaaaatccagattgcttataaatgaacacgtatcacaggtacttggaactttcagcagcaaaacacanagaagacaagaaagtaagttttgacgtgttgaaggaacctagaattttataccctgctaaactctcatttaaatctgagtgtaaaataaagctattcttttttttttttttccaacagaatctcactctgtcacccaggctggagtgcagtggtgcaatcttggctcactgcaacctctgccntcctgtgttcaagtgattctctggcttcagcctcccaagtagctggg

SEQ ID NO: 128081 - DNA, 463 bp, Homo sapiens
tgcccgtttaaaaatctgtaccttcccagagaggaccaaatgagagtgggcagtcctcacgtcaggaccacatttcttgtccagacggatggggctagaaagtgagtgcagtgactcccaaagatcagggtcctgtttgggggaaccaggtagtgtctagagttagctgggcttcttccaaataggcagacagtggctatggggccacgcccgatgctgaggagcaagtcaccaggaaggcttggcctgctgagtcatgctcagctgcaggggaggtgacaggacttttccaagtttgctgggcatggagaccgtgggcccatgcttggaccagccccaagccctgcatttgctaagtgctcttgacagctcttgccaaagtgtgtgcttcagaactggctccctttgggaatccttacagatggaaagtctgtaagacaggctgggaggaaacagagggagg

SEQ ID NO: 128082 - DNA, 476 bp, Homo sapiens
ctatacaaatgcaaagtgtcatcaattatccagcaaatactttttgagcaccaactatgtgtaaagccttgtagaaagtacactgagaaaataaaagagaaattaggataactcagctgggtgctgtggctcatgcttgtaatcccaactgtttgggagcccaaggtgagtggatcacttaagcccggttgtttgagaccagtttgggcaacacagtgaaattccgtctatacaaaaaatacaaaaaaaaaaacaaccaaaaaacctgagtatggtggtgcacacctatagtctcagccacttgggaggctgaggtgggaggatcacttgagcccaggaggtcaagggtacagtgagctgtggtcatgccactgcactccagcccacatgacagaaaccttatctcaaaaaaaaaaaaggaagatagaaaaattgagataactctttactcttagagaagatttaatatgttataa

SEQ ID NO: 128083 - DNA, 225 bp, Homo sapiens
ggttctaccagcgggaggttgtctccagccggcggttgtaccccgcaggttgtacgagagaggtaacagagcaagaagagaaaaaccacataaacttggtttgcctctgcaaaattaataccaattacaaaaacatttatgtgaactgcttaccatttacacctaattaccatgcagcacaattatgcatatcattaagggtatgccagattaattatgctgtac

SEQ ID NO: 128084 - DNA, 712 bp, Homo sapiens
catggtggcttatgccagtaatcccaacaatttgggaggccgaggcgggtggataacttgaagtcaagagttcgagaccagtctggtcaacatagtgaaatcccatctccactaaaaatacaaaaattagctgggcgtgggggaaggcatctgtaatccagctactcaggagactgagtcaggagaatcacttgaacctgggaggcagaagtcgcagtgagctgagatcatgccactgcaagcctgggcaacagtgcaagaccccatctcaaaaaaaaaagacaattcaaaaaaggaaactacagaccaatgtcactcaggaacatagaaacaaaaatcctcaaaaaatattcaatcaaaaaaaagaatccaacaatatataaaaagaattataaacaatgaccaagtgggatttatctcgggtattcaaggctgattgacattctaaaccaatgtaatccatcacatcaacaggctcaagaataaaaatcacacaatcatatcaaattcaacacctatttattaaaaaaactatcaggaaattaggaatataaactttttcaacctgataaagaacacacacacacacatacacacacaaatccacagtaacataataactatgagaaacttgaagttttcccactaagattagatactactgcttttaaacatcatattgaaagtcctaactaatgcataaagacaagaa

SEQ ID NO: 128085 - DNA, 800 bp, Homo sapiens
  misc_feature (679)..(679): n is a, c, g, or t
gcagagattgacagtttttagtaacttgactttgacctccagtgtacacagacatagccttggctgctggactctgagctttctggccctgggaagctcgagatttgcaaacacttgttcgacaatcacctcgtttatctgcattgtcaccagtgcagcctctgagccctctccctgtctttacttgaccctgtatagaaaaatgctttcagggccaattgcagtgactcatgcctgtaatcccagcactctgggaggccaaggcgggcagatcacctgaagttgggagtttgagaccagcctgaccaacatggagaaaccccatctgtactaaaaataaaaaattagccggatattgtggcgcaggcctgtaatcccagctaccagggaagctgaggcaggagaatggcttgaacccagtaggcggaggttgcagtgagccaagatcatgccattacactccagcctagctgggcaaaagagcaaaacactgtctcaaaaaaaaaaaaaaaaaaaaaaccggggtggggcgctgggacctgagaaagattccccagaacccatccgggctgggggcgccgcgcctcatggttgagtggacaggtcccatagacgtggtccccagagacaccggtccggaacatagtggcgggtttccccaccataaaaaggcgcggcnccgcaggcttcgaacaatccaaggggctcgaggcctcgggtctacacgggcccagggacgagtacccgcgccggccggcgcgaagagagaaacggagacagaagcaccacggagcgacact

SEQ ID NO: 128086 - DNA, 364 bp, Homo sapiens
gaatttaaactgctgtcacagaggggacctagacagctgattcatcctggtggaaaccctgcctcttccccaagttttaccctaatggtccatccaacttgccaacccctttgccatctaaaggccagcaacttgcccgtctctccaccctacccagcccaacataccaggaagagcaagatagcaaccagacaatgagaaactgccagagcttcagcccctgtccctgcctgcagacctgccgtctctgcaaaatgcctcatctgtggatgctacaagcttctcaaggaatctcaagtcctagctgtcctagaggctaaccaagaagtcatctctccatttcagtcctcaacagctcctgcag

SEQ ID NO: 128087 - DNA, 398 bp, Homo sapiens
cctcagcctcctgagtaactgggattatagacatctgtcaccatgtctggctattttttttgtatttttagtagagacagggtttagccatgttggccaggctggtctcgaactcctgacctcaggggatctgcccgcctcggcctcccaaagtgctagggttacaggcatgagccaccatgcccggctgcatctgtctttttaaagtaaaaagttttccctgatgcctgacaaatatctgatcagcctccagcacatggccagccttgaacaaggtgctaggagtatagcaccaataagatagctgtggtttcatcttttccagagctggcattctagtaactgagagtccttgcactacccattgtagtatgcatggtagtatttgtggtagtatc

SEQ ID NO: 128088 - DNA, 527 bp, Homo sapiens
tattccagcagggtctaatctgtgccaagtgctaaatttgaaaggaagggatacttttctgaatctgcggtcttctttggtgtcagttttagatagacactaaagatcaccaagtgtggagaaagccaaagtggttaattatcaattaattacacagacacagggcgcccaagcaggcagaagcacttcctgggtcctgaaagcacacacatggctgaatcagaacgcgggctgtttctccctgcagatgggtcgtaaacgtgtctccaaattgctaatcattaccccatacctcctatcgcagtcaccaggaagcacatatcacacatacttgcatttgtaaatattaacttctccctcacacccatcaaacattttgagggcacagtaaggagggtgtcacttgaagaagtcaagtcattgaggccagcggcctggatgtccccacagggctgaggggctgcaatcagttcccatttatccagggcttctctggagctggacactggctgctccctccatgcccg

SEQ ID NO: 128089 - DNA, 145 bp, Homo sapiens
ttcaagaccttgacatttttgaagactacagaacagttaccttgctgaatatccctcaatgtggttttgagggatatttggcatatggttcccatttgtcccatcactgcttttgttacctttattgcttgttaaggtggtgtct

SEQ ID NO: 128090 - DNA, 391 bp, Homo sapiens
cagacagcttcatgcagggctgcaggtatcttgagtcggccatccctcgattccttccagcccagaagtttagccttgtgtttaagttccatgtcttttttttggagacagagtctgactctatcccccaggctggagtgcagtggaatgatcttggctcaccacaacctctgcctcccgggttcaagcaattctcatgcctcagcctcccaagtagctgggactacaggtacctgccaccacactgggctaatttttgtatttttagtagagatggggtttcaccatgtgttggccaagatggtctcgaactcctgacctcaggtgatccacccacctcggcctctgaaagtgctgggattacaggcgtgagccaccatgcccagctgta

SEQ ID NO: 128091 - DNA, 887 bp, Homo sapiens
gtattctaaaaactttatatggggccaggcatggtggctcacacctgtaatcccagcatgtcaggaggctgagatgggagacaaggagtttgagaccagcctgatcaacatagcgagactccatctctatttaaaaaacaaaaaacacacaaaaaaactttaaatataggtcttgtttaatcctcacagagctctgtgaggtaggttttattagcttgtttttatgaggaaactgattgaagaaagttaagtagcttgtatgagaatatatgttaggcagtaatgaggaattagtgccctttgtatgtatatgcattctatatacttgatcacacacacacacacacacacacacacacatatatacattttttttttgagatggagtctcgctctgttgcccaggcggaggttgcagtgagccaagatcacgccagcgcactacagcctgggcaacaagagtgaaactccctctcgaaaaaaaaaaaaaaaaaaaaaaaaaacaaacatttggggggcagcaaggccccaaaaaaggtttagaaaacaataggggggggagcgcggggagccccatataggacatagagaaacgtgtggcaaacagcggtgtcccacaagagaacacgtggacacaacaacaggcgggggaatccacccaaataaaagacggcggggagaaaacagaagctgttcagacaaaacccaaaggagaataagaaggcaaaaaaaggggggacacacaaagagagggaacacaaggggaccgtcaaaaaaaaaacccccgggaggcggacacaaacaaaaaacagagaaagacaaacacgaacaaaagaaaaaaaaagaaagcaagacaaaagagataaacgaagaagaaagagagcacg

SEQ ID NO: 128092 - DNA, 531 bp, Homo sapiens
aagcacactgccatgttctgaaatgcctgccatcagacccatgttagatagtccaacgcagtaatttctgcagagcatttaatgcaacttccatcttcttcagctctatctggccagccactctaccaggtgtcttttctttggtcaactttttgttaaagtggtctgggggtgggctccctttgtagctcatctcttctctcactgttccagaggcctttaaaagctatgtgcagtggtggggagtttgccaactctctccctgcccaggaatggatgtacattaacattgtcaaatgtctaatcagcgaggcagctgcgttttgctgaaagggctccaaaccacctgattcatgtcttccctataaaataaattatgatggcccttgtcaggtgacacctgttagaagccttacaaagcatttttcctgaatataaaacagtctccgcctctttttataatcttctgggcaaggctttaggacattctgctgcatctgccgagggtataaacaaccctatcccttagtc

SEQ ID NO: 128093 - DNA, 700 bp, Homo sapiens
  misc_feature (560)..(560): n is a, c, g, or t
gctatacattttcctctggctatggctttccaaaaccctccaatcctgttcattcttttctctgtagtttttctgacttattccagggacttccctttctagattataatcttcttagtctgtaccatataatttgtcacctaattatctactgtttcactttctgttggtttcgtggacattaatcttctccccagccaactgatggtagtcatattataataactccccagattggtttgtgctctgcactttacaaatcactccactgtttaagacctgtctttttgcttatcatgcccacagctgctctgtgaggtgggacaggaggggattgttatctccatattattgtaaacaaattcaaagaaagcaggtgacttcccaatgtcatatatgtaattaggggcagaacagaaactatatctcaggtttactaatttctggcttagaattttatctgcaggctcttctacatttgtttttttccttaccatttcccctcttgccttcaagggtcactcaaggcagaacatctaccttgtgggtttttaggaggntttggttggtgacccagtgaatggtaaagtagcccagatatcaatcttaggtacttctcagtggcatcagtgttctgggttgctattgccgagagaattctctttctgtggctattaggattaatgttgaactaagaagc

SEQ ID NO: 128094 - DNA, 644 bp, Homo sapiens
ctgacttgacctggcagccttagctgggagacactgttccatttttcatgggcagctggagttgtggccaccattgtgattcttgtgactggcttacagaagaaacatggttcctaagaaggccaggagggacagtccctgagacatacgtgtaaaatgaagagtataaaaagcaaataactaccacaactggttttatccagggctgttaatttttagatactcattgctacacttattagaaataatgtttaccttatttccttttcttcctcctttctcctcttccttctttctatttaaaaaccatttgccaggtacttctatggcaggcagagtgagaaatataagataggaacttgtcctcaaattgcttacctctgggagaaaacgaaggcgctttagggcagctcttgatcaggcccttgaagataacttaagtatagcatagcacttaacccacaatatgttctcaaagaaagtcctgaaagatgaatccagttttctccaagattgcaagctccccccttgaagatgggtaaggtcctagtgagccatgctttattcatctttgcatgtctagaccagtgcctggtatatatatttgatgcccaacaaatgctagttgaaggaaggaagggagg

SEQ ID NO: 128095 - DNA, 497 bp, Homo sapiens
gtgcaatggcgtgatcttgactccccacaacctctgtctctcgggttcaagcaattctcctgcctcagcctcctgagtaactgggattacaagcaggtgccatcacagccggctaatttttctgtttttagtagagacacggtttcaccatgttgctcaggctggtctcaaactcctgaccacatgatccgaccgcctcggcctcccaaagtgctgggattacaggcatgagccaccacgcccagccagagagacccattttaaccacacagggacccagctaaaaacccttccctggttctgtcaccatcagattaaagcctaagcttctagatctctgtcctgcactttttcactttaataacgaccctccaggctcagtagctgatgcctgtaatttcagcacattgggagacttgaggcgggaggattgcttgagtccaggagtttgagaccagcctgggcaacacaccaagactccatctttacaaaatatt

SEQ ID NO: 128096 - DNA, 434 bp, Homo sapiens
gaattgactgataggattctagtgcatttgctctctgaaaactatatttctgggaaccttcagattaagtacaacatgaaaagatgataaggacggggaaaaaaaaaaggaagaaatttatgcttgccagaatagtggagggaataaatagagcttttacagctctatcaggtgaaggaaatactagaaattaaagcagatattaagtctaggaggaaagtgaaatgcaagatgatcacacagtggctgggtactcaagtgcccttttgaacaagaggcaaaaaaaaaaaaaaaaaaaaaaaaaaagctcaagcctggttctccactcagtcagttatgtggccatggcagtgaaaatgctgtatgtatgcaggcacagtggaaactgtccccagagaaacgagcactcctcatcacagtctctactatgttgt

SEQ ID NO: 128097 - DNA, 506 bp, Homo sapiens
tggaccaagcaacagtcctagtggtgtagttattgtcaataatatatacttgatttttttccctctcttcagtcattcccttgtattatttatatatcttccctattgactagatgtaggttctgctgagagcatgagaactcttgtattacctttgaatccttttaaatgcctgtgtggtgttacattttttcggtgctcaatgcttatggtttactaaaatgggaactcttagtggacttacatagggcccacttcataattgttttctgttctacaaatagatacaatttattagtttttttttcatttttatggcatagaagaacattcttatttctgcctatcttatgttttaaaatttcatctctatgctcccctgaattcctgattcatatccaactgcttactttatctcgacttggatattaataagcatctcatgctttatgtctaaactgaactggtattcttgctcaaaactgccccttgtctagcttcccgct

SEQ ID NO: 128098 - DNA, 282 bp, Homo sapiens
ctgatattgacctggagaggaaaggggtctagaaaggccactgcttcattatcatctggggttggggtaggggttgggggagtatggtaaaattattcccacagcaaacctctatggggcagaagaccactagagacactttcaatgatggtgcccatctgtgcaagagcttagaagctataaagtatacttacatatgtcatctcatttaatctctgagagagaggtcacttgcctactctgtcaggtaatgccaacaacagcatttctagatatattggt

SEQ ID NO: 128099 - DNA, 347 bp, Homo sapiens
tggcacaccatctgattctctgccatacactcgcttatcagctctgctcggaagaaatgttcttaaccagttcggcttgcactgatcacacttcagcaataaaggcctgaatctgacagaagttcctgccttccaggtcattgtgggtagggccaggcaagtttggttggctcctacatttgcactaacgttgagagaagtactatcccctcccctgccgtttcacgtagattcagagagtgggtgtagcagctgcaagagcaccccgtaagaggaaagggcccctggccagaggatgagaggcggtcctgtggcctcgagctcctccagggagggagggcaccgcg

SEQ ID NO: 128100 - DNA, 618 bp, Homo sapiens
aaagctggggcagaggaaagcctcccagaaatatgagatcctagagcttgcaagatctgaaaacagtcagagatgattaggatttgtgtggagtggtggaggattggaaaggaagagggggagcacactggtcagaggggtcttgcggaaggctgacaagaggaagacacagtagagtagggagaaatggcaaacactctttccaaaggcttaagattgtgaggcagtcagattttttttttccaatggcacatgtctgttaggtagagtgacaactatattctgcttctctgtgttgctctatggtatttgtgacaactacttgatctctcagttaaagatctgcattaacctccactgtaacttatgcatgtgttcggtttgagcaagaccagcaaggtacctaggaacctttccctgatcatcttgtatttcaggcagagatttagctgacaggaaccagcccatcatttatagattgcagaggtgcttcctaatgaccagcagctaaagagaaaatgccacaatctggtggaaggctctacgtgtttaggaatcatgaaaattaatttcctgattttctcctgcaggcagaatgtggcaaagattgctatccat

SEQ ID NO: 128101 - DNA, 407 bp, Homo sapiens
ggggggctgaggcaggaggattgcttgaacctggaaagcggaggttgtagtgagccgagatcatgccactgcactccagcctgggcaacgaagcgagactccgtctcaaaaaaaaaaaaattgtattttaaagttttgttttccatgaatttgtggggggaaaacccttatttcttaccttatctgttgatcaaagaaactgctgaagaatgaggaaaaaaatttagtaacttgataaagagatcaaaattttcagctaaaaaagtgataataaatttattattgcataagactgagtagcaaaaggctgccaaaaataattaagcagcaaacactaagtcaggcatatatatatatctagtggaaaatccactttttttttcatagagagtatttctgtacctagt

SEQ ID NO: 128102 - DNA, 588 bp, Homo sapiens
atccaggaaaaatgtacagaattatatcatggcctcaccccctgcatttacaaagtgaagagagccagtggggtggtagaaataataattctgccattaatcaattatatgactgtggacaagtaacgctgctcctgagtttcatcttcctcatctgtaacaagaagtttatgccgtctgatttctaatgcttctgcgaagtctgggttcatacgtgtgaattactggatggtttgttttgatacgttgaatttgagattcaaggtcttcaaatggggctgtgctgacctctgtttttaagggttaaggtcagagggtttggcctttccaaagaggtgaactaagttcttcgtttattcttttatttgtgagagccgggggctgcgtggatttaggagtgagggctggggacttagaaacaaaacttttataggcaggtgttagatagctatcctttaaggacttttgatgtgaactgattaatgaagcccattatcagatttgtacttaggaacactctggtggaaagaactaagataatagcagctttccttttgtagcatagctattacccctttctgtaactta

SEQ ID NO: 128103 - DNA, 406 bp, Homo sapiens
ctgtccccttgcaggcctgtcacatgcattctacttgacagtcagtcagtcacgtccatcccctgagcataccctgtaaggcagcctcttgctctaatttccaccaggctctctttactgaaagataaccaattcttccagagccagcttccctaggaagtatgactctcttacaaactacctctacattccagtcacacctgactactccccattcctcagtgatatcctagactttgatgctttcattccagccacaaatttccactgcttctctctccaccacacacccccatccttaattttcagcttctggcaaatctctggaatgattcaaatgtcactcactctaaaggcttcctcaaatccaccaagtatgtgcttacctaacacatcaattagttct

SEQ ID NO: 128104 - DNA, 311 bp, Homo sapiens
cagtgagtgggatgcttctcaagccacagcctaaggacagtcacctgcttccaagtggtcacagtgccacccacgggaagggcaaagctccctgccctgtgccctgagctgtacagcctgagctgtagcaggtgaccctcatggtcatccactgggagggcctacttccagccccacagccactgtggaggagggaacacctatatttgaaggattctggggtctctggtagtgggcctcctccgtgggcttcaatgggctcactaaggggtgagcccgtcagtctctgagtgaggttgactttcgtagaa

SEQ ID NO: 128105 - DNA, 328 bp, Homo sapiens
ctcgcctagcctggggttctcagggaagagggaatgtaactgggagcaaagtaccccatactaattattttatcattttagtgtaaccagtgccttctgcaagaaggagatggtagagttttcaagaatcagactaagtctgcccaagtttaaatcaggatatttgggggaaggattagggttggggtggctatgccatatgagctggtgcctttggaaagccaagaactgtgaaatgttaaaggggggatgggcacctgtgaaccgccaggagacaggaccatagaggaggctgaggctgaggctgaggctgagcctgatccgcact

SEQ ID NO: 128106 - DNA, 312 bp, Homo sapiens
agtataggggtaaggctcagcaacatgtgttttaacaaaccttccaggtgattctgatgaatatttatagcacattataatcagaatataaattgaacataaaggcatcctaaattgattttgatcgagccactgtggtctcctcttacatttatttttgtggtaatcctacatttccccccttggacttaaccttcctgcatcctaaccctagcccaaacagatgattgaaacacattttcactaagtgtaatttgtttcactttcagaaaacatatcactttttgctttctctccttttcatggttattc

SEQ ID NO: 128107 - DNA, 362 bp, Homo sapiens
tacccatttaaatgtttacattttcaagtatataaaaccaggattgtaaaataccgttgtatttccagttgtaaatagccgtttagttaagttaggcatttgtttatcacgcgtcctaatctctgtttgtgtcgttactgtctcagagatcatcatcatctgtgtttacatttttatgcatcattctttatgcaagtagttcttattcagtgtttttgatgatgttaagcaaaattctgttgctaccttacctcattaccttcccgggatatattttgcagatataaaccaataatattttctggttctttcttgactagtagcttttggttaactctaaggtttttctgtttgtttttctc

SEQ ID NO: 128108 - DNA, 279 bp, Homo sapiens
ctgttgcccaggctggagtgtagtggcacgatctaggctcactgcaacctccacctcctaggcttaagtgattctctcatctcagcctcccaaagtgctgggattacaggcgtgagccaccatgccccacctgaagcaatttctttgttgtcttttttttttttaacttctctcatagaaataattaaccctcaaaaacactcagtgttgacaaagggtggtgtgaggacacagaaagtatcacactatcattggcagaaacttcctggaaagcaactt

SEQ ID NO: 128109 - DNA, 335 bp, Homo sapiens
gactcaacgagactcacatcttcaacggaagtaattggatcatgctgatctataaagggggtgatgaaaatggtctgggattagacagtagtaatggttgcacaaccttgtaaatatagtaaaaactactgacttttacatcacagaagtttggattttatagtatctgaatcatatctccagaaaaataaaacagaaaggaattagagctttatcagatgacttacaggaacgaccagacacaaaaccatttgtcatctcatcaggccagaagccaagaatttcattttatttttagcttatttatttttttcttgagctggagtcttgctctg

SEQ ID NO: 128110 - DNA, 366 bp, Homo sapiens
ttgaaggctctggccttcccagtcacagcctcatgttctctgtcttcaagtttcacgaagccacgtgacatgcccataaacgatggaaaccaggccctttcaacagtgtcttggcccatccaggtcctggctgtacgaaactgttaactcatcaaggtacagctccagtgccattccctaaccagagctttccctgacttctcagcctgaattatgtttctttacctctgctgccgtcatacttgataaagggggcagaatacgctatcccaaaatatgctccttaggcataggattattttgagttaaagacacttgaaaaccatcacatgcaagaagagggctccgaccttcctttttcatcct

SEQ ID NO: 128111 - DNA, 333 bp, Homo sapiens
aatttcaggaaccattgtaatatgctatcgtttggatgtttgttccccaaaacctcattttgaaatttaattcccaatgttggtggtgtagcctaatggaaaatattagggtcatcagggaggatccctcatgaacggcttgctgtcatcctgcaggtaatcgggggatgtgagttatttcttaattcccatgagagctggttgttaaaaaaaagtctggcacttcccttagcactcttgcttgtattgctataaaggaataccagaggctgtgtaatgtataaagaaaagaggtttatttggctcatggttctgcaaactgtgcaagaaaaa

SEQ ID NO: 128112 - DNA, 351 bp, Homo sapiens
  misc_feature (169)..(169): n is a, c, g, or t
aaatgggctctgatcttcagtctgggctggagggatgacttctcccccgggtcacgggcacgggcatggaggggtggctctgcccgggtcccattctggtccttaggccggggccggggcttggtaaactgggccttatggagcagatactgcacctctcggtccaggnccatcatcttagcttcaaggtctattatttggccaaattagtcactaaagtgcccttatagaagataactctgggagaggtatttatttctctgaaatttttattctcctttcccctttcctttcctttcctttttctttttctttttttctttcctttttctcccctcccccccctcccct

SEQ ID NO: 128113 - DNA, 315 bp, Homo sapiens
ccaaagtgctgggattacaagcaagagccaccgcacccagccttaatcattatagttttatgatatgttttcatgttttcctttttaaaaaattttcttgaatattcttgttcacttactgttctttttatttaataaatcagcttattattccattaaaatcctgacgggaatttgattggagtcatatttttaagagaaactaatctttcattacccagtaaatacattcttattaaaaataaaagcattttaaataatgctgaagtctcctgggaacgctatgcctaatctcaatcccctaccctacccttt

SEQ ID NO: 128114 - DNA, 277 bp, Homo sapiens
cttaccggctaaacaggttcctcctttcattcccaaagcagtcaccagtctcatatgatagatatcactgatcattcttcccaggtattctgatgtaccagcatctatgcatgtgaagatatcccaggtattccgatatcccagatatcccaggtattctgatgtaccagcatctgtttcttcctctaccaatatctatttagcctggagagcccatatcatcatacttcaaactctggacagagccagtttcagccaggttacgtgaagtacggag

SEQ ID NO: 128115 - DNA, 319 bp, Homo sapiens
aaggagccagtggtcagatggtcacgtgttgaagggcatcctgggcctgaacaggaaatatactcagaggaaagttacagtaacttaactagctctgtggtcaggagggaggtgctcttctatgccagggaaatcagcatcaccttcacagtatgctcacaaatatcacagggcaaaatggctgaaagtagaagctttcattgtttttggttcctacctaacatgtgaaattctgttcagtccgaatttttaaaaggaaacaagataattagaatcttacaacctgatttttcaactgcaaaagaaagtcagactatga

SEQ ID NO: 128116 - DNA, 849 bp, Homo sapiens
taagagactatataatttacttacttattttcattgtagtttgtctgtcttcccttactcctgctggaatgggagctccaggaaagtagatctaagtacttagatctatttagtactccaggaaagtatcctaagtacttagaatagtgccagcagataataggtactcaataaataattattgaactaatgtatatatcttacttagcatagtgtctgacactttgtaaacactcaacatttttgatgacttaatttaagaaaaaatcttggatcagtggtcctcaaagtaaaccctgcagctctagttttgtggaaaccagaggactgaagcaaaagtgtcctgacatcttagactgtatgttaatctcaggaatgtttttcctatatatgtctactttgagagaaaaatcagaattaggtatggttctacaaatataggagcttttcttcctccatgctttgtaggtttgtcttatcttaaagcctttattgaattactagaatgcaaacaaacaaaaaatgatagttatggtatatattttatattttattctaaaaaatggtctaaatttgacttttccaaatggccaattatttagaaattctaacactatactatgcctgaagtaaaaatttgcttagttttccagtgacaaactaataaccaaccaaatttacagtgaaaaataaagtataccacctttaaatatagcagcaaggtatttcaacatgaactttactgttttaacctactaaactcaaagcaaaacaagacattcttatctcttattcatttattatcttgggaaaatatttaatagtttcgttttttctgattctagaacc

SEQ ID NO: 128117 - DNA, 292 bp, Homo sapiens
cctggccaatgtggtgaaacccaatctctactaaaaatacaaaaattagctgggcgtggtggcgcgtgcctgtagtctcagctactcaggaggctgaggcaggagaatcgcttgaacccgggaggcagagattgcagtaagccgagatcgcatcactgcactctggcctagggggtacttttcttttttacagtgtttacagaactttttctcataatatttattgagctcttattatgtgcaggcactgtgctgggcactttacatgcattgtttgcttgaatcaagctgg

SEQ ID NO: 128118 - DNA, 532 bp, Homo sapiens
caccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctct

SEQ ID NO: 128119 - DNA, 596 bp, Homo sapiens
ctatttacaacaaaagcttaataaataggcacttcccccttaccattttctttcttgttttttttttctcttgtttcatttttttgtttttgtttttgttttcactttgagacagggtctcgttctgttgcccaggctggagtgcagtggcaaaatcacagctcactgcagcctcaacctcccaggctcaggtgttcctcccacctcagcctctgtattagctttgactataggcatgcgccaccatacccagctaatttgttttgtatttttagtagaaacgaggttttgccatttgggcaggctactctcaaactcctgagctcaagcaatccacctgtttggcctcccaaagtgctgggattacagggatgagccaccacacccagccttgtctcttttcttaaaggaagactgtatctttcaaaaatatctacaaaaagtttgaaaacctctattggccgggcacagtggctcacacctgcaaacccagcactttggtaggccaaggcagatggatcgcctgaggtcaggagttcgagaccagactgaccaacatggagagaccattttagtctctactaaaaatataaaat

SEQ ID NO: 128120 - DNA, 271 bp, Homo sapiens
atattcttagctacttatctaaatagctaggtagctagcatctacctagctaaattatcagctttgttctaaaagctgaatgttcccactatttcataaactgtattttgtaccttgaattttagagctacaagaaacattacttttctagtattttggcattgtatgagttaatccaagaccatctctatatttttttccccacaacaacattgtagcacaaagaatactgaacttaaagccaaaagacctatgttcttttttttttttt

SEQ ID NO: 128121 - DNA, 596 bp, Homo sapiens
cctggctggaaaagacaatggaggagaaagctaaagggccctgtaagtttctgtcacacccagagaacaatatccccctttttgctgggaaatgagccagtcagtatcacagttggagaaaaagcagggcacggggtgccactgtgtggcagggggggccacactacgaggccatttctgtaacaaggccacaggcgtcctcagaatactgacgtgttacctgagatgacaagcacagttttgcgccccgtt[344 bp omitted]

SEQ ID NO: 128122 - DNA, 314 bp, Homo sapiens
aaaaaacaaaaacaaaaacatcatgagccgttattatagctttacctcagcaataatatccacaaaatgactgacttgaacaactagttatatttttccaattcatataaaaatacatactattaagccgggcacggtggctgacacctttaatcccagcactttgggaggccaaggcgggcggatcatgaggtcaggagattgagaccatcctggccaacacagtgaaaccctgtctctactaaaaatacaaaaaacttagccaagcgtggtggtgggcacctgtagtcccagctactcggaaggctgaggca

SEQ ID NO: 128123 - DNA, 136 bp, Homo sapiens
tgctgggattacaggcgtgagccaccgtgtccaactcctgtggcagatttctgaagcctcttctatatatagttctctgtagcaccctgccccataaattccagcagtttctaattctcatatctactcaggtcag

SEQ ID NO: 128124 - DNA, 717 bp, Homo sapiens
ccaataatatataaaaagagtttgatgcacccaaaatcacaaaaatcctaatacatacaggttattgttggattttccaagtactttctatcctttaatgcctaaaactccatcaagggaagtaaacagcaagtaatataatttttcaggcagcctgtggacttctctggtaggatcaggttgacatatcgtttattaggtgagtaagtgaaaagacaagtaaagcataactgaaccaacaggtaacctgttgggctccttcctgacatcactgagatctgaggagccctacaatagcagcacattcaggaaatcaggtccctcaaaatttctagctcccaaccccattgagagattttgggagctttccaatctgccacaaactccctgctacatatgtactatatagttcaaatgtgtgatacagagcaccctgaaagggaataattgaaacaaagttataatcttcttagtcttatgctaaatttattccagccaccctactgaagggaggaagatctgatcattagaatccttttcctagccatgacacatttacatacttgtaaaatttattgtagtaagtctagcattgcaacagaatagatcttataatggccaatcctcacacttttgtattaaggatattatgacagactaagcatggtagctcacgcctgtaatcccagcactttgggaggctgaggcaggcagatc

SEQ ID NO: 128125 - DNA, 3595 bp, Homo sapiens
  misc_feature (1509)..(1509): n is a, c, g, or t
  misc_feature (2335)..(2335): n is a, c, g, or t
  misc_feature (2419)..(2419): n is a, c, g, or t
  misc_feature (3440)..(3440): n is a, c, g, or t
gccacatatgacataaatgccatctgactttttaagaagtttgggtttgatgacaggtataatagaaagccaccagaggttttgaggtgacagaagtatgagctgatctgtcaatgtataagagggccaacatgatgagagcagggccagtcagagcctgctgcagtggtcctatgcctggactcaggtgggaaaggtggggaaaatgatatagactcatatttggaataaacctgaagccagagcctacagtgcctgctgaagggtgaccaggaaaagagaagaatcaaagatgacatctagggttttagcctgagaaagtaagaatggcaatggtgtttaccaagattgagaccccatgaaagggagcagatttcaggggaagagagtggtggtgaaaaggaaaagtcagttttgctcattatgcatatttaagggcgctgttggacatccaagtgaagttgccatgtggatggttagattgaaggacttgagaagagggattgggaatagaggtgtgtatcccaaagccattaggaatgagtggttttcctgggcacgaactcagtgagatgaggcagggagggagagctgatctggatgaggaggaacaaccagccaagactgagacagacgatggaggttaggtcgaagaaaagcctggagcgtgctttcccagaagccagttgagaaaagtgcttcaagaggaagaaggagtcatctgtgctaaaaggcactgaatagaataagaggaaatttcatcattgttttttgcatgggggaattcctaggtgatcttgacaacagaaatttcaatcgcaaaatgggaacagagcctgactggagtggatggaaaccaggggacagaaagtaaaaagtgcaaatcagagagcatatgtgatcttttacgaagagctttgttgttaaagagagcagagaaacaaggcagttacaagagggaagggcatggagccaagagagggtttgggatgtttatgatgatgattatgataatgaccgtgatcatcataatcacaatgcacgccatgcgttgagggcttaccatgtgccaggcactgtgccaagcagtctccatcatgagctcaaggcatttttcagcaaacctagaaagaaggctctgacattatcaccagtgtagaggtgaaagaactaaggatcagggtcccaaatctggtgaatgatgaactgggagtccaaccaagatgtgtcataaacacagcagatggagatgttcctgttcaaaggccagctgaaaatgaatgaaattcttaactgttgttagtcaagacctgttgtggttgcaatgaatagaataccacctcaaaatgactcaagggagtgaaaaagtgagggaggtttaattcagatatctcaaaagtctctaagaagaactgacttcagaataactggattcaggggctcaaatggtgtaattaggatcctctccatccctgggctcaggcctctgctttccactctgttgccctnagtcttggcaggttccccatgtgctggcgtctagcagatcatggctcacttccaaccatttggaaaatccaggagtcaaagtctcatgtggctgggtggctctcattgcttgactttggccacctgctcatctgggaaacaatcactatccccaaggacacacagtgttctcaaagggactggcccacatgcctggctccagagccagcagaactgatctggacatagaggttgctctctaaaggcaacatccaggtgccatggacaaaataagggacactgggctggcggtgaagggcagatgtcccctaaagtatgaagcacgtggacatgaagtctcctgcagacagtgtcaagatatgcttcccagcattctgcccaaatctaagctctatgagggcagtgacctctttagtcctgttcatcaagtatagtttctagcacagtgacaggcacaccatagactcaggttaaaaatatgtttattgaataatggagtgacctcaaatgattattctataatgctggtctgtttcacttgatttagttgctggttattttaattttagctggagagctcttcatgtatttgaaactcatcattattcgtcctaactataattctccaactctccaaaacccttagtttatttggaaatagggtattcaattaatgtcctactcatcagaacagtgtttttggtgtattttaatcaaagggggaaaaaaactgccttagtataaaatcttcaaatctctttgtgatgtcccctgagggtatgaacctggtggtttagccagaattgaaatccccacaaattctaangaagctttgctttgttgaacccctgggggtttatctcctccccgctgactctgtaaggtgaggcagagctctagggaaagacangtgcatgacaaaaagctgtttggggtatatttgcttctgatactgaagtgcctgcagcagagctgtccatctggaaaatgcaggcttgggcggtggagagaggaacaccacagaatccttgtacaggatttgaaatgttgtcttctgtgcggtgtcagtgggaggatgctgaagggcttgggctgcctagaagacatttgagctttgtgttatggttgtggggagaggcttacaagaaaaaatacagaatgccagtcttgtcctatgtcgacatgatgccttctttcccaatggtcatcaagagatagccatgtgctgctggggagatgtgtgaaccgaggagtggggcaggcaagtgagaatggtagagggctaaaaaacaaacaaacaaacaaacaaaaacccagcaaaacctcctggaaggcatgcagaagagaagcatagtgtagtgagtaccctgaacaggaaggggtgctttaatgatgaagctcaggggctgcagccctggaatgtctgggtgcagactctaactgcttcactcttccttttttcggttgggagacttcaggcaagatgcagatcatctgtgtctcagttcccctgttggtaaaatacgggtaataaaatagtactacttcacagacgctagacacccgttgatatatttaaagcattttaaacagtgcttggcacagagaaatcaatatgtgtgggtttgtttccattgttattagtccgaatgggaaaaagatgggaatgtaagtctgagtgtgcatgggagaagttatgagctttggtctgaatattcagagggcataagctttgagaggtgtgtgtgtgtgtgtgtgtgtgtgtgtatgtacacacatggaggagggacaggaggaggcaaggctggtctgagatggatctctctggctgtatgcaaatatttaacattctgggcagagagcacctgttgggtgtctcgcaagtttgagaagagcaattgctctgaagtcagaaatggaattactgtcangaaaagaagcagaggctgatgtgaataattaagcctcctaatgagagcattaatatttccccaatagattgatttagagcttctttctctgggattgttgcacaaacttacctgagctggccatctatcttgattgttcaggacaaaatgcactg

SEQ ID NO: 128126 - DNA, 243 bp, Homo sapiens
cggccctggcgttgctcagcctctgtctccgctgctgctcgggttaccccactcctcacctccaggatttcactcccgttagtgttttttctttactgcgtcatccatttatcccctgataagggatcattccaactggggaaaaggatgatcataaagaagttccctctaacccagtcatgccccagttcctgctcattatctccagaatcttgcctcctggtctctcttcagccgaatcca

SEQ ID NO: 128127 - DNA, 306 bp, Homo sapiens
aaatctgcaatggagattattctaaacttgatcatgatgatgagtgagaaaactggtgcattctcaaactcctgctggaaacgtaaattggcaccacctctcaaggtcactctttcaaacttccaagtttggccgggagtagtggctcacacctgtaatcccaacactttgggaggcagagacttgagctcaggagtgagaccagcccgggcaacatggtgaaactccaactgtaccaaaactacaaaaattcgccatggcatggtggtgcgagcctgtagttccagctactccggaggcaggagt

SEQ ID NO: 128128 - DNA, 338 bp, Homo sapiens
gaaaaattgttgaagttgagtgttatttcatgctgataagtgagctttcttagagtatctttcttagatgttagcaaatattttaggatttgggaataatgtttgaaaagaaaatagttactttaagccggatgtggtggctcacacctgtaatcccagaaatttgggaggctgaggtgggtggatcacttgaggccaggagttcgaaaccagcctgaccaacatggtgaaaccccgtctctactaaaaatacaaaattagccaggcatggtggcacatggctgtaatcccagctactcgggaggctgaggcaggagaattgtttgaacctgggaggc

SEQ ID NO: 128129 - DNA, 856 bp, Homo sapiens
ggctgaaaaaacaattattgtaattataataatatttattaagaactattaataggcaagtaactgtgctaaattatagtagtaacacttaagtagtgcttacttctaaattagtttattgaacactcatactaatgtaagaactgttactattcctgttcaacagatgaggaaactgcatcttagagttgttaagtaagatattcaaggtaacacagtttaataaggtgtggagcctcaaaaaaaaaagttgaaatactactattgtcatcactgtttttgagtgaagaaatgaaggcaaagacattaactttttgaagctcataccactagtgaatggtgaaagccaggatttgaaatgcagctaactgactttagagctcattctttagctacaactttttattgcctcagagtaaatgaaaaaagagttccaaagattgagttattgcagggactagtgcataagctactaggaaaatggcctagttattgaagagcagtacaaaattagaacttagaaataagagcaagttgagcctgggtgcagtggctcatgcctgtaatcccagcactttgggaggccgaggtgggtggatcacctgaggtcgggagtttgagaccagcctgaccaacatggagaaaccctgtctctactaaaaatacaaaattagctgggcatggtggtggatgcctgtaatcccagctactcgggaggctgaggcaggagaatcgcttgaacccagaaggcattgcagtgagccaagatcgtgccattgcactccagcctgggcaacaagagcaaaaaaccccatctcaaaaaaaaaaaccaaaaaaaaaaaaaagaaataagagc

SEQ ID NO: 128130 - DNA, 285 bp, Homo sapiens
gtctgggtccttactggcaactttcccgtgaggtaccagttatgggaccttgaacccttcacgtaacccctttgcacttcagtttcttccttagcatttgctatttagaaattggggaaagtaatgaggagtgaatgagatgctgcttgtgaatattctttgcttgtccaccagtgttagaaatgatgcattatcagtatgtggcagcatccgcaggatttcttaatttaggacattctcctggaatgctaagggcccactgaaatattctttaatctgtcatga

SEQ ID NO: 128131 - DNA, 809 bp, Homo sapiens
tgttcaattctattgctgagactttccagagtgttttgcatttctaaaagtgtatccaaagttttctgaatttttgattgtttttttctttaagctatctattttcttgactatttctccctttatgtcttgtatcgttttttggatttccttgcattgggcttcacctttctctggtgcctctttgattagcttcatatttttattaagctgattatttttcacataaatcagggatttattcttggtttggatccattgctggtgaactagtatgattcgggagggtgtaaagagtactagatcaagggaacacacatgagacaaaagaatctgaacaatggccttcagccctagacgttccctctggacagagcgtaccctaaatgacgaatggaagcagacacagagaacacatggtcaatcatgacaaaacaaggctcttgcgacagcccccacaaaacaagtattcaaacccaggcttaacgcagcacacggaatcgcaaaccaaagagaggtcattcgctgaagtgttcctggggaaaagaaggtccagggggggagcttcacgcatcacgtactgcaggcataagcataaccgcgcgaagagggaaccccgcagtaaacagcgcggacagcgcgcaaacttgcaccaggcgaaacaatccactacaacatgttggaagtacgaactcggaaatctgcaaccgggaaggacaactaggggacccggaagcaagacggaatgtcggaccgcgcgggggggaccatccgcacacttcacaaagaagtgctcgagagaagtgtgg

SEQ ID NO: 128132 - DNA, 596 bp, Homo sapiens
ccgccaaaccgcattgagagcccatttctcaagtgtcactttggagccggcttcgggctgtgaaatgtctcccacaaagctgcccttggttttcttgaggctgatggaactttcatgcggttgttggttttgtttcggatgaggaggaatggctgtattttcacctggcctctggtaggtgtcctcttgtaattggaaatccctacatttctccttgggggctgggtttctgccaaggccacgttggaggaggatctggggaactggcctttggagcattgaaggtcagggaagccacagcaggagacccagttttgaatctgctgaatggcacttggaggatcaagttccctctgaggttgaagagcccccctctgaccttggttcaggggaatcacgtgggctggccttaccagcagatgtggcaactgggatctaagaatccttgtaaaggcgttttgtatccttcctggaaaactggagttggacataccttcaaggaaaaactagctgggcttcctgtcctggaagaggaagggcgctgggagagaacactgacatgcattcattcattcatgcattcacaatacagtgca

SEQ ID NO: 128133 - DNA, 175 bp, Homo sapiens
gtgttagccaggatggtctggatttctgacctcgtgatctgcccaccttggcctcccaaagtgctgggattacaggcctgagccaccgcacccgggattgtatgcttttttcttaagccactcgggcattttctttttctttttcttttttttgctatttatttattaacttttt

SEQ ID NO: 128134 - DNA, 329 bp, Homo sapiens
tagggagttcaaggttggggccctgcggcaggagctggccacgctactatcatccgtgcagctgctaaaggaagacaaccctgggcggaagatcgcggagatgcagggcaagctggccacggtagtcctggggctgcccgcacccagctgggagagagggggagccatcaggttcagacggggcagccgtgcggagaggcaggacccccagcctacggggcattttccagccagcaggagacgctcagaaaaccacctgtcggaggccaggcggggtggcttacacccataattccagcactttgggaggccgaggcgggtggatcacc

SEQ ID NO: 128135 - DNA, 456 bp, Homo sapiens
aaaacaaaagcataatagaatgaagacaaaccaaccataactcagccaaaaatacagaaggttatcaatattgtttgaaattccctttctgaagataactctagctttatttgctgcatattattcccctgctttttgttgcagttgtataatatatttgagacaaattatgtactttcttctttaaatagcttaacctggcttctcagtctgtattggaaggactcaatgcttgttttgaccaccgaggagaaatctatgtgcctgagttaggaatgagctttcaagtgcagcatgaaaagacgaagatttttgggtgtcagaatccctttagacaaggaggtgggaggaaaggcttgcccaggtctttccttaacagattcactcaggtcttcgttgatccccttacagtaattgacatggagttcattgccagtactttgtttccagccattg

SEQ ID NO: 128136 - DNA, 224 bp, Homo sapiens
cctttaaaccttgctcaatttgaatgctttcatttagtggaaaacgtaatccgaattttatgtgttgtcatggtgcatctgtctctattttctaacttagcagagtggcactgttgggaaagaggaataatcacattagcagaaaaagaagataaatgagaactagagaagcaagcaagaatggtcatggaatggagaaactatatagagcaatattattaaag

SEQ ID NO: 128137 - DNA, 265 bp, Homo sapiens
cagcttccacccctctcagctaccaaaagtgcctagtccacatctacatttagatgtctaatggatggctcaaactcaacatggccaaatctaaacttctgatctttgaacccaaacctttttcacccatagtcttcaccacttccgttgagggcaaagccatccttctagttgctcatgctaggaaatacaaagtaatatttttcttctttttttttttttttttttttttgccctccacatcccaatctgtcaggaattctta

SEQ ID NO: 128138 - DNA, 1323 bp, Homo sapiens
gtgttgaaagccggcaggaagagaatgctggctctgtgtttagcagccgaagggacttgttatttaatgtgtcttctgaagccacgaggcctcggctttgtaacttgctttctttattcttataaatcttctaggatgctccatggactgtaggaggagctctgacttcccgaccatacccttgtgtttaccactacagggacagaggttcacagctgcttctggttgctgtagatgatctggttccctgataatttgagataagtttgtgttagtttggagtcttcggtgaatacgttagggtacatgtttcttcgtcgttcctggcagggctgatcatagaccacatcaacccaagaatgtgtttgcctctctgatgaggctacatctagaatatgaacttgtcgagtgcttaagtatctttctacatagtttattcattagcctgttcatttatctgttcaacaactatttcttgcttgtcaaccatgttctaggcatgtcatgggctctggaagcagagtgagaagcaaggctaagtcctgggctcacggaacttaggttctaatgaggaagacaggcaaacaaggcgccgtggagaggcaggcagagaaccttgctttccaaccctgctcagaggtgcagtctctttatatatcccacttccgctatccccaaacatgcccattagcactgacatctaaagggctcatggtgaattaaaatgtgaccccacctctgggtatttagtcatttagtattgaactggggttaaagtcctaaggaaaggcatgtggagctaatatttttggggggacaggccctactggcagccatggaatcttactccgcgtggctcattgctcctgggctttacaactcaacgcagctgtagttcattcaccatgctgtggcttttgtcactcccacctcacctgtggcccacattcttctctatttgaatgtgtggcaggcaggcgagatagacaatggggaggagttgttctgcaggagagaaggggacagtccttcctccagcctggagcacttcctgcaccgctccccaccccgtctactctccatatcccaccacgccctcagggccttgccctaaccccggaagcccacctgtctcttggctgaaatcctatgggctgagttgggtccccccaaaactcatgtgttgaagccctgtctcctgtacttctagaatgtgactgcatttggagacagggtctttaaagaggtgattaagttagcatgagaccattagggtgggcctactccaatatgattggatttataaaaagaagaaacttggac

SEQ ID NO: 128139 - DNA, 466 bp, Homo sapiens
ttcaaatgtccccactgccatctccaagttgtctctctcgggttcctatttccctggcttttgtcactcccacctcacctgtggcccacattcttctctatttgaatgtgtggcaggcaggcgagatagacaatggggaggagttgttctgcaggagagaaggggacagtccttcctccagcctggagcacttcctgcaccgctccccaccccgtctactctccatatcccaccacgccctcagggccttgccctaaccccggaagcccacctgtctcttggctgaaatcctatgggctgagttgggtccccccaaaactcatgtgttgaagccctgtctcctgtacttctagaatgtgactgcatttggagacagggtctttaaagaggtgattaagttagcatgagaccattagggtgggcctactccaatatgattggatttataaaaagaagaaacttggac

SEQ ID NO: 128140 - DNA, 381 bp, Homo sapiens
  misc_feature (18)..(18): n is a, c, g, or t
tgtgggcaaggatgtctnccatcacaccttcttcgacctgctgggctcttggtccccttggagattactttaaggaattggcatgtaagatggccctggaactcctcacccaagagtttggcattcccattgccaagactttatgttacttaccttggagaggccctggcactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccacccaggggc

SEQ ID NO: 128141 - DNA, 908 bp, Homo sapiens
  misc_feature (339)..(340): n is a, c, g, or t
gagggtatgtgctacacatggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaaccatccaggcctacggnntgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggagattggtggctgtcacaggtgccgaggcccagaaggcctcaggaaagcagagagcttgaagaaatgtctctctgtcatggaagccaaagtgaaggctcagactgctccaaacaagggatgtgcagagggagatcgctgaccttggagaggccctggcactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccacccaggggc

SEQ ID NO: 128142 - DNA, 488 bp, Homo sapiens
tttgtagagacgggatctcactatgttgtccaggctggtcttgaactcccaacctcaagggatcctcccacttcagcctcctgaagtgctgggattacaggcgtgagccaggagcctggcctaaactctgctgtttaatcctaacaacaggccttcctctgccaacacctacccccctgtcctgacttgctgagtcctataacaggtctgctttttgagccctgttactgctgctcatcactgttggcagagccagtctcagctgggcaatgcccttagcctcaggggctgggttgccttggccactggtgggggcggacttgagactctggtgcctcccatgtggaagacccaagtctctagtctgtgaagggatcctcaggatttcaaaaagtcctttgcctttgattaggggattattgctgctaccaaagtttttgggtcactttcctttggtctggagtcgtgtgggcaccattcatgatgag

SEQ ID NO: 128143 - DNA, 680 bp, Homo sapiens
acaatctaagtggttggactataaatatgcacttcccacaacatttttatatgtttaaacagttttataataccatattagggaaactgtttgtctcaaggaaatagagattgtgatatattctagtacaatgaagtgtaatcatgtaaaataaaagcttttacttctggcaattaaagttagtcatgttagaacactgtctaggaatggttggaaaatcatattttattttctaatcaatatatttatgtcatctgtcaatcagaattacactgactttaaaaagcaataatatgactgtatattcatgatgaaatatagcctaagaacaaaataatgcacaaaaataatctcagattgcttattatttttcagaaggctgtatttttagtcttaggctattggtttgtcttatattgcaggattttaaaaaaatgattagttcccagcactttgggaggctgagatgggcagatcaccaggtgaagagattgagaccatcctggccaacatggtgaaaccccctctctactaaaaatacaaaaattagctgggcgtggtggcatgtgcctgtagtcccagctacttagggggctgaggcaggagaattgcttaaactccagaggtggaggttgcagtgagccgaggtgtgccattgcactccagcctgctgacatgta

SEQ ID NO: 128144 - DNA, 357 bp, Homo sapiens
tataatcatctgtgtgaaataaagtaagaaagactaatctgcctcctgtaactaatatgcacaaatataacttgaataactcaaagagaaatataatttcttaaaaaaactagacaaagtgctatagaaataatctgcatgtttggattccaatatgttacaaaatgttattcaatacagatgtaagtcacttcctctttctgggtctcagttttctcatccataaattaagaccaacgaactggaatgtttctaaattactttccagtcctaataaataaggatgttatctttatagagatcttgcttagataggctggcactgggcagtgaaagaaaaccaaggaggcaaaccag

SEQ ID NO: 128145 - DNA, 487 bp, Homo sapiens
ttactgatacactacacttttcccaagattatttcctccattctcatggctttacatattattaatacgttgataatgcccaagttttgatctctagaccaaacagctttcttcagcctaaaaaccatctattagacaactccacctgcgtttctcatcagtacctcaaatctaacaagaccaaacggaactcttggttttcacagcatcatcatgagttgtaattatatttgtttacttattatatatctccctcaataagtgataagctttgtaaaggagcaacgatatgcttttgtaagtctgctgtgcttaccaaagtatactcagcaactaaataggacttggcaagagtaagcactcaaagccaggtgcagtggctcatgcctgtaatcccagcactttggggaggctgaggtgggtggatcactagagctcaggagtttgagatctgcctgggcaatgtggtgaaaccctgtctctacaa

SEQ ID NO: 128146 - DNA, 403 bp, Homo sapiens
ctgagcgtcccaagttggaaagagaaaaagacagagagagaaaagagttcccctgtatggagcagagagaaaaagggaaaacaaaaagaaaagaaaaataaatcccaaactctgggcttacctcctggctcactcaccaaaatatgtcaccagtggagggtcttgactacaagtcatccaggctcttggtattttgaacaaagaattggaaaaaatgcacaaacaaagcaatgaaaaagtgaagcaatgaaaacacagatttcagagtacatgccacagagtgggaacacgcttgagcaagtggctgaagagcattggttacagaattttctggggcttaaatactctctagaggtttcccgttggttacttggttataccctatgtaaatgaagtagtggcc

SEQ ID NO: 128147 - DNA, 383 bp, Homo sapiens
aagtccaaagttcttgttttctgatgtatttattcatccaaaaaatatttattggagtctgtactatgtgccaggcactgtattaagtttttgggatacataattgagccagacaaaaatcctaccttccaattgaggacagtgggcgcctataacaacaaataaaaaataataagtgaattatgtagtctgttagaagataatacattctttgctgggaaaagagtaggaggcgtgagatgggccaaagatttaggagtacacagaggggcagtgggcaggttgccgcttactattttaaaaaaagggcctgagtgagtgtcattgaatgtaacaagtaaagatttgaaagttagggagttagccacatggatattcaggag

SEQ ID NO: 128148 - DNA, 440 bp, Homo sapiens
agcgattctcctgcctcagcctcccaagtagctgggattataggcacacaacaccacgcccagataatttttgttattttttagtagacatggggtttcaccatgttggccaggctggtctcaaacgcctgacctcaggtgatccgcatgcatcagtctctcaaagtgctgggattacaggtgtgagccaccatgcccagccgaacgttactgctcttctgttgtggcctgtgaaaccagggcatgcagtctgttagaaccatgtgtaaagtaaaagtaatgaggctttgagcaagaaaatctcatgggagaaaaatacatccctcttgtgttttatttgatcttactttcttggtgatagctctaaagttctttgtagcctaaatgagttgatactggcactgccctacaggatcgtctgtgatgatgcaaacgctccg

SEQ ID NO: 128149 - DNA, 876 bp, Homo sapiens
gtatcctgtcctcttccctcttggcttttttcctgctcccagcggaacccagtcaggggattctataggagaagagggagcccaacagaatactaacttcagtggagctgactctgcttatacaataggggtgggctgcacagagtggaaaccgagtacctggtagaatgtgcatttccatggcccactgtaggcgcctctcttagagcaaacagtattttaggtgtgctctttattgaacacaggaccacagtgtgtcactgaatcttcttaaacagaagcaattagaacgatttagatatagggagggcacaagtaataagtaacccaggggatagaccaagaagcagctctctggaagagtctggaattaaaaagacggctgtactagaacagtagccactgcctgctccagaactaggggggagatatttgagctggagccaccagagaacatttctattgagaagtttttatttgtttgttctgttggttttttgttatttctgttttcttctaatctttctctgaagtatcactctggtattgagaaatttttatttcattagctaacctgggcttggtggttaaggctagtacttgtacttagaatgattctctgtcaggaaaagtcttggctttagagtttgttatagttggggatataacaattactgtgatcgaagagaaaaaatagcacctttggttgtagatagatgtagttttcctcacagccctcacgtcccttcatgtaaaagggattttaacaggatttacagagggaatggctctcagttcccacactgtgacatgtgtttgaggaattttgcctttaagcatttttcttgcacatggctgaaacacccctggctctct

SEQ ID NO: 128150 - DNA, 491 bp, Homo sapiens
tgtttgtgttggggtgtggcagctctctgacaagtcaaaagaaaatgagtaattgatttggtgctaaaacatgattatgcttgctataatgaaagcaccctagaaatattaaaactaaaaaacaacacgtactatctctgttagacaagtgccttttgttatgttaagatattccatttcttcttcatgcgagatggttcagcatttactaatcttataccagaagcagtttacatggagagatatttagataatgaaaacttgtctgtacttaggtaaatggaaaggttgtcacctgaactagccagagactccaaagcatttagctgccagtcatgccttaaaccttgggaacatcccatgttagacttagattaagaacccttttggggtttcaaagaggtgacgggctgcattcaatggtgaatgatcccaaggttgagttaactcatcactctgaagaagaacaaaatgaggaatttacttagtta

SEQ ID NO: 128151 - DNA, 167 bp, Homo sapiens
acacacagctagaacacagagtagggtagtgactcaaggtcacacggcaagtcagtgtcagaagggggccagcactccagactcctaactcctggctgggggcatttccctctccaatgatagatgacactgaccattcactcgagaatttgtttgtttgttttttt

SEQ ID NO: 128152 - DNA, 490 bp, Homo sapiens
aaacgagcatccttacacagtttctgagggtcagtcatctgggagtggcttagctggtggtccaggcccaaggtccctcctgaggctgcagttacctgcaggccaggaggatccacttccaagcttactcatgtggctgtgggcagggaccttccattccgcaccacgtgggcctctctttacgaaccaaaatagaagttgcaatggctcctataaccaaccttgggagtgacataccaacacttcctccatgttctgtggttcagagactaaccctggtacaatgggtgtgggtctgggggacttcacagggtgtgtgagttggaggcaggaggctggccaccacagccatctaataaacctctaaaaattaacatggcccaagctcaaattcatcactcgcagcagccccacaacttgctcttccctgtcttctccatcgtagtaaatgacagcatcattcactcaggtccctgtaaggatgcaagtc

SEQ ID NO: 128153 - DNA, 541 bp, Homo sapiens
atcattctaattggtatgaagcatgcaggaggtaattagcttaagatgcaatggtggagaacatgcataatttatatacaagccttgttacatgtgcagctatgaaagagttctttttcatatggtcagttatatgttatatgtcgacaagataattaaaagtagatttataagccaaaatttaatgatggttaagttaatggaaattttccctcaattaaaaacattcaacaataatgtaatatcacctcccctgggtgaaatgagtttattttatcttattatttttttaataggctttactttttagagcagttttaggtttacactgtgaaattgagaagaaggtacagagatttctcatgtattttcttcctcccatcacgtatgtacagccgcctccattattaatatctgtctccagagtggtacatcattataattgatgaatctacacatcattatcacccaaaatttcttttatttttaattaaaaatttttttaaaaaatagtacaaagccccctgaaccttgctgaagg

SEQ ID NO: 128154 - DNA, 466 bp, Homo sapiens
ggactgggagtggctcctgcaccagctggcatctgcctagagacaggaaggtgggtgcctcctgggttcagctgggaactctgagctttgggtgctggaggtcactgcgtttgggatggctgtctcctggacccagctgtctctgtgtgtggagtcagtaaggcaccgtcctggctgcggaactgaggcaggcatgctatgagaagataaaattgccttaacaactgtccccaggatccttccagcaggcacttccttgctgtgccctggaaaagcggggtggcactctggatgacagcacagcctcagggtgcttctctgtggcccacacacccttccggcctgatggccacgtccgttcctgtttacccaagccccacttcccctgaaatccaggcagggagagatggggcctggctgtgagaaacctggccccaggtgtcaccatttccccaaaagccttgtt

SEQ ID NO: 128155 - DNA, 371 bp, Homo sapiens
tttttaattgcttgtatggctagcctgttgaggtcctctttttgcttagtccccccattctcattccataatacatattgggaaaagattataataaatattgggaaaaggttatctctacactgatacctttcatgtttacatctttgtttaccatagagtctgctcttgtgccatcaaagtatctaactgaatataaaacatagcattaggagtatctatcttctatagatgctatctatagaagcatcttctagtggaaagattaggatgagaacaaagtagaccataacaagtataatagccatacaaatagctagatggttatgcttagttggctgaatttaataggctgggttctggagcaaacc

SEQ ID NO: 128156 - DNA, 378 bp, Homo sapiens
tgttgacagaggggtgatggaggagggtcttgaagccagaatttagagctggaggaggcaggaggacataaataaccccaggcaatctgcaaaagcactcaacagggcaggccagtgcagtagggcttaatgtttttatttggattttagagggaagggtagaaggaggctggtgaccccaggacacattttggtcgcaattatgttccagaggctggtatcactcattttgaggaccaagttttaatgtcttgtgcagctaaggtctctcaggatatagagggtatcacccctagaaagcatagcctgaaggaagcattagaaactgagaggtttgctttgtcacctcggttttctggccttcaacaggtcaattgc

SEQ ID NO: 128157 - DNA, 115 bp, Homo sapiens
ttggctggttcttcctttgccacatctcccacattcaccattccctctcctgtcaccaccactatcctcatctgccaggactgctgacccctaattcctccgcctaacactagtc

SEQ ID NO: 128158 - DNA, 891 bp, Homo sapiens
tgtaaacatgttttactgttgaatgtgctctctcagtatgcagatcctagggaattctgctttgccttcaatcccatttgaattatgattttagcttatctgtctaccttcttgtggaagtggaagcgtttgaacaagttaaagagtgaaaaaagtcagataccccattatttggtctgtgtagcagtatcagtcactatgaccagctcctggtgcactgatagaaggtaatttgagtgtcctataggcaactgaccatagcttggctcctactctggaggtcattggcctgtgtttcggcgacttctcagcctgtctttccccccagagtgctccgactgctgctagggcacccctgccacaccctgttcccaaccgccttggcttctccttgtccgcaggctggctgggttgcctgggtgcttggctgcttggcttctgagtgtctcatgcccaggttacctcaagagctccagcagctgccttcctacagggagaaacgtgctcatccacacagtttgtgccacaccctgtccctcttgtgaacacacctgtggtactgtcctgacctatacatattgaaattctaaaagagaaacacagttcttttgcctttcaaactgtgctccccactatactgctttcacttttctaagaatcaaatacaatggggaatttggccatggagaaatgaaactcgcttcagctcaagttcaggatgccttagggtgtggcagtaacattgttcccataaaggggtcttggggggaggcagtgtgccttaatggaaccgagagaacattttcgggagctttgggcctttggttggttatgagagaggggatttaaaagaagagggatctatcgggcccagagtggaaaaaaaattct

SEQ ID NO: 128159 - DNA, 684 bp, Homo sapiens
ggggggtaatccaaaaaacacgtttttatctagacccccaggtggtcctgacataggtggctgaatgaactccccccagtgtgttgtcattgtactttctacctgtctttaacattttcctacatattcaactgtattatgattaaagtaatctcttcccaactttgagtttatctggcagaaaattataaaatcagaacttttttcctctatatttttccaaaacttggagaatttttagtataaaaggagttattcatttgagaatatttagaaaaaaagataatgcagaaataggaagtaggggtgtctagccaccacagagaacctaaggatgtgaagtaactgtggaccttagaatgacagtcctgaagctgttactccagtggacattgagttctggtatccccaagaacctacgtccagagactaaaaagcctaatcatgaggctgcaagggtcagtgaagacagaaagtataaaatgagcatgggacaaggaaaaatgatatgtttttaatgcatatgttaatttcaacaaagtagaacaatttaccctgccaaaattttggaggaaggaaattctagaatttgctgataaatatgtgttaataaaagggtatttgttgtattatatattaccattgtagggcaggaaagactttcttctaccctcttaagttcta

SEQ ID NO: 128160 - DNA, 316 bp, Homo sapiens
cctctgagtctgaatctgattcggtggactgacaaaacatcacaattgaaggaatctctctcctcactcattacttttccaaaaaagtcccactagctgatagctccaggtttcttgctggttcctagatttattgcttggaaattataatgcatagtgggcctttcaaaaaaaaaaaaaggtacaagcaaatgaaaacaaccacggttttaaagccccataaaagaccgtatatgtagcagaaatgaaccctgccaatgtttactatgaggacctattactcctttatgctactcgagtggattttaaactcaaa

SEQ ID NO: 128161 - DNA, 509 bp, Homo sapiens
ctgcttctttctctctgggactcttctcaataagcactcattgaattcctagaatatgtgaagcacaagctcacattttttggcatggtggaaagtgcaaactagggtcttctcccagccattgtttcttccacccccctctccccattgaacctaggccctttacacactttaaaatgccacctttccagtactcaggttttacttatgtgtattgttttgccttttataacaaaagccaaaataattttgttataaaaggcaaaagaatattttggcctgttttaccccaaaattcaaatctagatagtactgcttctgaaaggcaaatattaaaaacacaatctgaaatacaagtgccaaaataacatatacacctgactcttaaaaaatcatgatgacccagcagccttaactgctgctgttgcaaggacagtaatctccttttttgtatatgatgtcatgtttcagccctttctaaaactgaggtcagatatccaaatgaagag

SEQ ID NO: 128162 - DNA, 640 bp, Homo sapiens
gcatatctaaaacataaggatacagaaaggttagaagtaaaggctgaaaattgatctccatgcaatacataatcaaaagaaagctacaccagctatattaatgccagacaaaatagactttaagacaaagggcattcctttatctggaagacgaagagggtcactacctaatgattaaaagttccattcaccaggaagagaaaaaaatcataagcttgtatgcacatgataacttagccttaaaaggtaggaagcgaaagtgaccaaatgtacgaaaaaataacacatccacctaatagtgggagaatctaatagatctttcctgataatagttgaaacagacccccaaaaaatcaggatatagaacttgtaaagcacaggagctggatatactgaacatgtttataatactgtaccaaacagctgcgcaaacacactctttgtaagcacatgtagatttatgaaatttgatgacactgaaccaaaagcaagcctcaaactgtcaaaggattactatcactgtggatagcctactccaatcagagggaaaatgagttagacattaaaaagataaaaaactcccatctatttgcaatttgagaaacatacatctaaataattcatgagacagggagagatc

SEQ ID NO: 128163 - DNA, 376 bp, Homo sapiens
attactcaagacagtaaagcagaaaaaaaaaattctccatgtaagaatatttaaggcactcttgccttagaatttgtttacaacaatgactcttttcagtcattaaattaatcctgagtcaccaatatcttagaaccagtatgttaaggtggcagtgctcagaaggtcttaggacaggctttggaaatcatgtcagtattatctaacttacttcaacacatctcctgccgcaagtcactgatatactgaacggttaaaaagcaattacaggcctggcgcagtggctcacacttgtaatcacagcactttgggaggcagagatgggattgtggggagagatcacttgaggtcagggatcacttgaggtcaggagtgc

SEQ ID NO: 128164 - DNA, 308 bp, Homo sapiens
tctcgccgtctctcattgggaatctgtgtttgcctcaattcatctgtgaacccttgggcttgtctcaagcggggacccaggcaaatcaagacacagccatgaaaagacagcttatgagacacaggcaggggagtgggccattcctgggactggggctggcactgcccgagtataggggattgagggatgggggatcaagtgcagggacagcggctggcctcaaggccacacacaggattttggtcattccactggggcaagggggagcagtggggttttaatcagggcagacatgatccagttggact

SEQ ID NO: 128165 - DNA, 761 bp, Homo sapiens
cagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaaaaaaaaaggc

SEQ ID NO: 128166 - DNA, 746 bp, Homo sapiens
cagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagacgctcatgacatggagaagctcaagagccgcgaaaag

SEQ ID NO: 128167 - DNA, 1152 bp, Homo sapiens
gaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggaggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctc

SEQ ID NO: 128168 - DNA, 1219 bp, Homo sapiens
gaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggaggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaaaaaaaaaggc

SEQ ID NO: 128169 - DNA, 874 bp, Homo sapiens
ggcatcgactttctctctcctgccagcctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcga

SEQ ID NO: 128170 - DNA, 1121 bp, Homo sapiens
  misc_feature (15)..(15): n is a, c, g, or t
cataggaatggaggncccccccgcggtttttaaatcggacgagggatcaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggaggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctc

SEQ ID NO: 128171 - DNA, 817 bp, Homo sapiens
tactgagtgagaaagaaattttaactataaaagtataggtaagattaactttaatcttaactgtaagattaaaatagataatctacaagtgaatagcttataatcagataatcaagagtttgttataaaacagttgataaaattagagtaattttttcaaaattaaatcataaatcatatagaactgaattttaatttcatttttccagaaacatatactgtgctcttatcctttctttacctcaacttcttctacaataagacagatgctaactgttcagcttacgttttgtgaggataacctgaaaattggttattttcaaaaacaaaagtggtgattattggtaccttcttttaagatctcattataatatattttcaggatagggacagttcaagaaggcctctggagaacatgattgaacattcattgtccatacccttcatctccaacaaagaaccctttactaaagatttgttttttttttgttttttttttttgagacacggtctcactctgttgcccgggccggagtgcagtggtgccatcatagctcactgcaggctcaaattcctgggctgaagcgatcctcctgcctcaggttcccaagtagctgggactatagcgctcaccaccacaccggctaatttttttttaaattttaaatagagacgcggtctcactatgttgcccaggctgatcttgaactcttctgctccagcaatccttctacctcagcctcccaaagtgctggaattacaggtgtgagccactgcacctggcctccctgtatactcttaaaagttattgagaccc

SEQ ID NO: 128172 - DNA, 255 bp, Homo sapiens
catgtgcatgtagtccccagctacttgggaggctcaggtgggaggatcgcttgagcctgggaggtcgaggctgcagtgaactgtgatcctgccaccgtgctccagcctgggtgatggagtgagaccctgtctctaaataagtaatttgtcagtggcattcgtaatgaactactttcttgagatatggatgggtgcatttgctttattgttattcattatgctttacatacacactatatgttctttgcacataaa

SEQ ID NO: 128173 - DNA, 146 bp, Homo sapiens
tacactttttcctccttaggttttcctttgaaggaaaacaaaagcccttagctctcatttcaagaaggaaagaaaaaaacccgtaagccaagtcactcaacgagcaccaagccggatcgcctggagaggagccaaagagccgcagg

SEQ ID NO: 128174 - DNA, 516 bp, Homo sapiens
cacgcatcacggcgtcgtgtaggacggggaacgcgggtcccaacatggggctgggcttaagccactggattcacagcaagtgccctcatgaaagatgcatctgacggcacatgactgagtgacaacgctgagaaacaggagctggagatgcggcccccgcaaggcgctggggccacaggcgtgcatcacacccagctaatttttgtgttttctgtagagacagggtcttgccatgtttcccaggctggtctcaaatcctgaattcaagcaatccccccgcctcggcctcccaaagtgctgggattacaggtgtgagccaccacgccttggctagctctttgttttctaacctagtaatatgggtatgtcattttcagaatgaacaaatggatgtacatatcaaaggaaatggcttatttggatgcccagaacaggtggagtctgggcagctggtgggttcagggtactaaagattccagaacgctaaagcccaggtctgccttggtagctgatacg

SEQ ID NO: 128175 - DNA, 548 bp, Homo sapiens
taaagcaaatcatgtacatgaaagcccagtttgtccaagacatttgcattcatttcgctcaaattttatgatgtcatcgtgaaccactaatcctttcttttgctaatctataacttgcaaagctaattcagtataaatgctgaatttttcaaatcagattttacaaacacacataaaaagtattgagcaagtaagatttccatgaaataaaccataacatggttaggaagagccaactacttcaaataagataataacagaagagtgaccaagatgacttctggatgagaatttttatttctatcctcccaatttttgtttgacagactttctgttttataggtttcctcatattaaacaacagtgtttcagaaaagataagtggtaaaaccagcgtgaagagacagacaaaaaaataggtttttaaacttcgaaaagttgcaaaaagttgcaataagaagtttgtttaagactaaagatagacttcataaaacatatcaagagattttggtggggcttggctgcaggcatggaagttgagctcatta

SEQ ID NO: 128176 - DNA, 697 bp, Homo sapiens
cgtggtggtgcatgcctgtaatcccagctacttgggaggctgaggagggagaatcgcttgaacccaggaggcagaggttgcagtgagccgagatggcgccattgcactctagcctgggcaacaagagcaaaactccacctaaaaaaaaaaaattattattgcctaaacattccaggaaacgtgtcaggctcaaaaacacaaaaataagtaagatgcagtctctgcttccaaataaactttccagtctattggaaacctctcaattgagaaatgggggcatgtcagcagttcactgtaatatattttgacagatgtgagctcaggtacctggcagcacagagtagggatatccattagggtactaaagtaaagctttcaaagtggcaacactggatagagcatgggtgactgcctatccaagcagtgaatgcaacatacgaaaacaaagacaatgaggagtaaaaaatgagacacacattgggaaatatgaacagtattgagttgtttctttgcagatgagttaagtataccgaaatgataagtagaaaaaaagaagccagcgaaaaagtttctaaagcttgtgatgtttaatgtgattttagactttaacctagaattaatattcatgcaaacacttcaagcgaaagactggaatgattagctctgctttttagacagctcactggtcccctaagaa

SEQ ID NO: 128177 - DNA, 153 bp, Homo sapiens
ctattttgtgcacttggagaaggcagttaaaagatcaaagatgtggaaagcacatgtgaaaagttaagaggacacccacatagtaagaaactcagggccaggtgcagtggctcacacctgtaagtaatcccagcactttggagaccgaggtgg

SEQ ID NO: 128178 - DNA, 416 bp, Homo sapiens
gccattcagtcataattacaagcggcctgtggactcccagtgggcatctggtttctaaagtaaaggcagtcatgttggggaccatggcgttaaacctctggaatctgacactaactccccatgtttagggtcagaattaaattgcagtacaccacttgtcagaataaatattatttgcttttccaaggtgagagataattaatgccaaagaggggggcattctttcatttaactcttagcacatatgcttgaagggagggatgaccaatataagactggcaaattctaacaagttggggttaaaggtatatctacttttgaatctggttattttttctgacctggagtaaattttaagaaaagagtgtcacaaatttgtaactctgttgcccttagaatctttaaaaatgattacc

SEQ ID NO: 128179 - DNA, 317 bp, Homo sapiens
ttcatctctaggtgaggtcagcatcactctaaccctgcttggttcttgtcccctgtgccacccttccactcacctctcgggcccacgcctctccctccactccaccagtaatctgaaaccttcttctgatcccacagcccacagcttctgatctgctaaatcctggtacttctctaaacataactgcatcttaagttagtttttgtgtacctgcaaattcattatttgctacctatttatgacttttgcctttctcaaaggcattcaaaagacacttgacctgtcagtataattcattgtttcagcaatcactaaaa

SEQ ID NO: 128180 - DNA, 224 bp, Homo sapiens
atgatctgagctaagtggagagtcagggatgtttctgtaatgcacttgggatgagagggtggaaggtgaaaggagacaagtgagaattaatagaggaagaggcaggacaaggctgggaaaagagaacatctaggaggatgatgcagagtcgctgaggtccaacagcttctgcacagacatggtgcaggtggaaccatcagaaagcaggactccgtcacgcccag

SEQ ID NO: 128181 - DNA, 707 bp, Homo sapiens
taagaaaatatttagccagttctgtttcgtaaagtcttcaagaaagataatagcttgggtggactgcttcttcatgcactttattaatgtggcttcctgttaagatctgaagccaggcagagatgtccacttttgctacttatatttaaaattgtactgcaggttcagaaatcaaaggcatccggattgggaagaaagaaagaaaactctctttattttcagatgaattgagcctgtactagaaaacctaaaggaacacatgcccaatcccgattcccccaaagtacgaaccgactaatgagttcagcaaccttacaggataaaagattagtatacaaaaatcaattgtatttttacatactagcaccaagcaatctgaaacccacattatgaacacaattctgaggaataaatttaataaaatcagtgcaagactagtttattgctaaatgagagttatcccatgttcatggattggaagactcaatattgttaaatcttcctaaaatgatttgtagattcagtgcaatccttatacaattttagtatgcatctttttaaaaaaaattgtcaagctgtttctaacagtatagaaatgtagatgacctagaataaacaaaacaattcggaaagggaagaaaaaaagattaggggtcttatatttcttagtttcaaaacttactacaaagctatactattcaaatcag

SEQ ID NO: 128182 - DNA, 267 bp, Homo sapiens
gcccaaggggtcttctgttttgtttgaggggcaggagtgaggcaggaagcagggacaaacccagtgtgggaggggacttgggtgtgaagtgaagccatttggtgggcctgagcctggtggcatcaaagtaaataaaggccgcctggtttgtgtttagcttctccatgtcttaggcgcatggccttgggtcctcatgggctctctccaggcatcagtgtcctcatctgtgaggtgggattgataatgtgacacagctcacagaaatgt

SEQ ID NO: 128183 - DNA, 332 bp, Homo sapiens
actctgtgtgtgtgtgtgtgtgtgtgtgtgtgtgtgtgtgtgtgtgtgtgtgtgtttagtactgggttgtctgctggccagcttttcttcacccccaaaatgccgtgaggaagtatttactctgaggtatcagaattcgcatcagaagccttcacaagccatctcttactccctgctgccacagttggttcagtttctttagaaatgaaccctgagatgtgttgtctgtcaatacactcagcctcagctaccacgcatgcctggccactctttgaagtacagtactcttttgtttcccaaattaacacttcgctttcagggtcagttttccc

SEQ ID NO: 128184 - DNA, 196 bp, Homo sapiens
tctatttttttaaacaaacaaaaattataaaattgggaatgacttgttccttataagctatgaaaaactagtctatgtattttctttaaaatgttaggcagcatagtctagtgatggactgtggattcaaattttagctcctccattgaactctgtgaccttgggaaagttttctctttgtgcctgtattctttag

SEQ ID NO: 128185 - DNA, 485 bp, Homo sapiens
ttttttaggcccatgttccaaagtgatgataaaacatccaactacacttccattcctagctcagaaaccacaacagatggaagcgggtgtgggccataattagtgcccgaggtgagtgaagaaagccaggaaaacctcgtcaaaggaaatcagcctagagaataaaggctccctgggtttgctttggaagaaaggacaggggattatgtccttgcgccttcaagaacaagagacctggcactggattaaaccatccaaatagtaaaaccaataattatgtgttgtgggcagggccagcctggtttctcagtgccacatccacttcctgtggtgcgtggcaggtctacagggaacggcaatgccaaatttcctcagctttcttttcagtgcagggaagttagaataaagccagagagtgtggcttgaagatacaaagcaagccactgagaagatcatttgagcaagacgagccaggtttcaaccag

SEQ ID NO: 128186 - DNA, 415 bp, Homo sapiens
tgaaggcagacagagataaagtaaaatataaggtaaatatagtgaattatcagatcccaggaggaaatgtggaatgtgccttacaagttaaaaggaaactttcaagcaaaaaaggacatgagtaccaagaaactagaaacaaattctaagcaatgatatgtggactaattcgatgatctacatggaggtttactgcctttgaaagaagcagtgatgactcgaagcctatgtggcctcattagtgaaaataatttcagaggaactttatctttgacaggatttacagctggatagattaggaaaaataattcaatggcataggatatttggccttttacagggcatttcatgacatacttgtgaaagatggagaaatataggccatgcaatgatatgaatgggtgaacatagagct

SEQ ID NO: 128187 - DNA, 196 bp, Homo sapiens
acagtggtcctttctggatgggctgcagtctccgaaggcttcccccactggagtcagccctttaggagtttgtccagtgcctccagaaagctgttttttgggggacggaggacttggcctggaattctggaattcccagggggtcagacatggttatgggaagtttaataaaaccggtgaatcacgtgaattctgc

SEQ ID NO: 128188 - DNA, 135 bp, Homo sapiens
taaaaaattccattttcaggatctacagacatagaacacaaagatactttgtgtccacatcaaaagttcagagttcaggccaggcatggtggctcacgcctgtaatcccagcactttgggaggctgaggcgggtg

SEQ ID NO: 128189 - DNA, 373 bp, Homo sapiens
acaagcaaaagctgagggaatatatcaccactagactggccctagaagaaatgcttaagaaagtcctacatccagaagcaaaagaacactatctaccatcacaaaaacacaaaaaaatataaaaaccactgatagaccaaacacaaacaaggaagagactcacaactacagaaaaccaccaagccaaaataataattaataagagacagagggaatagatgatatactgaacagccataaatcagttaataaaatgacagaaataagccttcacacatcaataactctgaatgtaaactgatcaaactttccacttaaaagatacagactaatttggccaggcgcggtgtggctctcacctacaatcccagca

SEQ ID NO: 128190 - DNA, 666 bp, Homo sapiens
cctcaagttcattcggcaacctatgcaattctctggaacttccctgaacgtaccattctatttcaggcatctacactttttgtgtacagtttgccttgcctggtaaatttgctcaactgccactatttttgctggtttttctccctctttttcaaagcttagctcaggcaatttcctctctcctattgaagttaattcctattaacttcataacttctagctttaaggtgagtaacttgtttggaggataatcgtcccttaggctgttctccaaattagatatagtcacatggagagaacaggtgggaaccacatagttcagactctatagtagtttcctctgtttggtatttgtcttagtgacaacgacatacacatgcatatacacacatgcacacgtgtgcacatacgatccagtaagttcccagaggggagtgactgtttgattcttgtagttctaatatcaatatgtttaataaatgtaaactttgccagactaatcttcccagatgtttgttaataacagaattctttgacaagtcctaatgaatgcaatgaaacaggccaaagttaggtttacaccattttatattggaacattaacataagagttacttatatccccagctgctgtatttaatgataacattttatttcccaacttag

SEQ ID NO: 128191 - DNA, 204 bp, Homo sapiens
ctcaaaaaaaaaaaaaaaaagtaaatctaacagaaaccagacaatgttgttgccttcaagctgggctctttgttaaaaggaaaattactaagtgttagggaggtgttaaaggcctattagcatctacctgaggcttcctttctcgcaaaagcagagcgtctgaaagatacgtggaaaagaaacttaaagtataataaaaaagaa

SEQ ID NO: 128192 - DNA, 325 bp, Homo sapiens
actgacaataagatacccttctttagaaaatccagacgaacccttcagcaaaaaacacacacctactaaggatctctgatgtggagtgttagattagacaatgcgagaacctttcctggggaaagagacctggaacaatgtggggagagagcaaagtgttctccaagatgctgtagcacatgatttaatactgggagagtatagtggttcattcttggggtggtttcctggcagaaataagaaatgcatttcttttaaaatatttacacttaaggtacatttcaatgccttcctgagtaaagaatgaatttagcacatgttcata

SEQ ID NO: 128193 - DNA, 391 bp, Homo sapiens
taagatgagaaaataagtatgagatgcaacttggaattaaagtgatcaaatgtttgctctgacagataagcttcagcacctgttaacttggagaatcaagtgaaactccaccggcttcatgtggaagctcgtcaggcagcatcacaacatgtacataacccaagagccgttctgtacaaggttctccttaaaatataatgggaggccgggcgcggcggctcatgcctgtcatcccaacactttgggaggccgaggtgggtggatcatgaggtcaggagttcgagaccagcctggccaacatagtgaaatcctgtctctactaaaaatacaaaaattagctgggtgtggtggcgcacacctgtagtctcagctacttgggaggctgaaggag

SEQ ID NO: 128194 - DNA, 338 bp, Homo sapiens
acacacagggctgaagacatgatgagtgtcccagcatgcagtgggggaagaaatggactaaaaagacacagcctcgcactctgggaggggtgcggacgtggtcacacccccgcctgcagtgcactcctgtcccttctccaagcttcaggtgacaaccaggatcctgtctggagaccccccgcggactccaagcatggagatgcagacgcccgcatggcacccacacatgaggaaagccggtttgaaaacaccatggaaccaaagtcccggctccaagatctttacactatttgggaagaaaacagagacacccatgcttgcgtcagcagtacgtgtac

SEQ ID NO: 128195 - DNA, 320 bp, Homo sapiens
ccatgagattaaaacatcgggtaaaataaagagatggaaactcggtaagcataataacacagcaaaatcgtggagatgacagttggtcttgcagatggtccactcttaacaaagagaaggatttaaagctttctcctacaaatacacagtaagaacatgccaaccctcagtctcactatagtgtcagaggcaatgggcccttcatgactgcaacagggacacctaggccagagaaatagaaaagatcagggaaatcatggattggggggaggtgagaaaaaggagggaccagcgagaagggatttctgaagtggattctg

SEQ ID NO: 128196 - DNA, 459 bp, Homo sapiens
cattttacaggaaataaactggttaaaactacatgatgacagaattatatcagagttgaaacaaacgccatacctaagcatttttttcaaaatcctttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattagacaccttgc

SEQ ID NO: 128197 - DNA, 316 bp, Homo sapiens
gggcagccactcctatctatgcccatctttacctaagcttttgggatttctctagcatttctgctccctgaggctgggtgagacaaaaagcaagtgttctctttttcctggttctgagggcagaaagccaaaggcaagccctgaagaacggtagagcccactcttcctggctgttctttactatctgtcagttctctgagggaaaggatcttcaaggaaagcacatcacagggacaaagttgtgaaaaagttctactctggagtctaataagaaatgaatggccaggcgtggtggctcacacctgtcatcccacca

SEQ ID NO: 128198 - DNA, 477 bp, Homo sapiens
ttccgcacagacgtggtctcggggaccatgaatgaggagatgctttctcagggcagctctattcctcaacttcctagtgcatccactctgaggacaagcgattgcgctcagactgtcatattctttatttatggggggcttctttctagcaaattctgcgagctgtttaggatctgataggtcaatgccaggtattcctccaggcggaagcttcttgcctgtcatgtactcagaatactcaagcgaattctctccaactatcttttgtggaagctctttctttaccccttttttcatgtattccaaagaacattcaagggagcttgcttcgaaaaccttttgagaaagctgttgttctgatcctttctttaggtattccaaggactcaaaaagtgagtcctcttccaggatgggttgagaaaactcaccccttatgacgcattctatgtaacagtctgagaaatcatcccctccgag

SEQ ID NO: 128199 - DNA, 270 bp, Homo sapiens
cactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgttttggctattaattttccctttttataaacatgctttttaggctgaattctgtatatgcgtaaaactgagttatacagagaaatagctttcaactt

SEQ ID NO: 128200 - DNA, 161 bp, Homo sapiens
acaatggctatagtcaaatgaaattatgagcccaagatgcattttcatagatcatctactctctgcagtccttaaccaagatgagagcttcctaaggaagatggacctcccctgctaaagctgcctagctagagaagctgatcccatgttatttggaatct

SEQ ID NO: 128201 - DNA, 411 bp, Homo sapiens
tttctggacatgttgagtgtgaggagcctgctagacacttgggtgggatggccagtgaggaggcagctggtcatgtggtctcacttacagacacatttggaggacagcaaatcacagatggtcatctgagccatgggcatagatgagagagctcaaggagagggtacagactaagaagaggggcccaagaaagccagcctacaaagcaagaaactgacagccaaccagatcccctaagtaatctgttaaccaaggaactaaatagctaacaactcactaacgcctgtttcttttctttttctttttctttttttttttgagacagggtgctgcatgggagccagtggagggtcacctcgccctgctagggagagcagcagcattcctcagggctcctaaattcccctgacc

SEQ ID NO: 128202 - DNA, 414 bp, Homo sapiens
tcctgtcagtttcaaggtggccagtcacacaggtacctggcagcagccgggtgacctagatttgtcagaccttatcttattggctttcctttctcgtgtatttacccagcacctgcccccacgatgctcagagcaggttggcctcttgtttttatagagaaagagatggacagggaggaactctcctcccacacagacacactttgtgttttttctttttttctcccgctgcgggaagaatcaagaaatatgggggcttcgagcttcaaaaagctccatgaagtctagtttcactggcttcctctctcctcaggcttcctaggtgaatgtttctggcatgaaccttaacggccctctcagagttgtacctgtcgtttggaacatttggcatctgaaggggaaaggccagctgtg

SEQ ID NO: 128203 - DNA, 260 bp, Homo sapiens
tgaagcagggcaagaggacaggaagtgaaggagggcaacagtgtgtgtgggcacagatgtcatggagagggtggttagaaaaggcctctgcagagaagacatttgaccatagctcgaatttagtgaggccacaagccacaggcagatatgagggaagaacactccaggcggaggaacaatgcgtacttttaacacttgccccaaccagctgaactggaacacatgctacctggtatactacacttgggcacatagacaag

SEQ ID NO: 128204 - DNA, 790 bp, Homo sapiens
ctcccaagtagctgagactataggcgcatgccaccatgcccacctaatttttgtatttttagtagaggcaggatttcaccatgttggtcaggctggtctcgaactcttgacctcaggtgatccacctgctacagcctcccaagatgctgggattacaggcgttagccaccgcacccagccctaatttgcattttctaaagtcctgaatcatacagtagtcctcacttgtgcaaaccctcctcattcagttcatacaagctaagttgctgcttgtgatttaacagagacatctccttccaactgtgtcattctgggccataaataattcagaagtacgggcaattacatagaatcttgatcttagtattataatttcaattaaattagcaagatagattttttctttgatttttacatcattttctgattctcttagtgacatacgatcagccccctgtatctgagggttccacatccagggattcaaccaatcaaggatcaaaaatatttggaggctgggggcagtggctcatgcctgtaatcccagcactttgggaggctgaggcaggaggatggcttcatctcaggagtttgagaccagcccgggcaacatagggagaccctgtctatacaaaaataaaaataaattaacctggtgtggcggtgaattgctgtggtcccagctacttgggaggctgaggatcactagagcctgagaggttgaggctgcagtgagccatgatcatgccactgcactctagcctgggccacagagggggcccctgtctca

SEQ ID NO: 128205 - DNA, 712 bp, Homo sapiens
attgtgatcgagagaaaagtggacctagaatagaaaggatagaggtcaaatcccaattctgtcgtgcattatctctgagcaagttacttttcatccctgagttccattttccttttctctaagaagggaccaataatccctaactcaagaggtcatttgggaaactggaacaaaagaatatttgtgaaagtgcttagcacaaagcataatacttattaggttaaaggctcaataaaactgcagtccttcctttcagtcctttcagaagcaacatgaggcatccagatgtggatttcttctttttgctaaaccgctatgttattggacactctcacctaagtagcagaagcctggactcctttaaaccttatatgactaggggaactctgaaataatgaaggtatctgatgtacgttcagtgtggcctggcttgtcttccagcccctcctggtcctggtctttgcttattcattaaacttagtgtgccttcccctgaattcctttcaaagcttagtcatttcccaaaaaaaaagaaagaataagaagaaaaacacagtgtcagagggcaacagaggaccacaaaaactgagaaaaacacatagaatagaacacaagggcacagaaaagggacagacaccagagggaaaaaagggagtgaccaagggaacaccaggaacaaaaaaaagagaagaggaaataaccacaaataacg

SEQ ID NO: 128206 - DNA, 596 bp, Homo sapiens
gaacagcaaatatcagctgggctgctgtagcactaattgtggaggattgctcaaagtgaaagggaaggatgagaaacacattggaggatgtgttctgttctctgacggttctcactggatgagatttctactttctgacttccacgttttctatcacttacgtatatctttgcattcagtgctatttatattccagatacgtattagacattgtgatagaggttgtgtgtgccagacatggttcctggtttagtgttgttaattaacaaaactttaagtacctgtgttttgcttttctaaattgattgtaagttttaccacatcagggaccatgcatttttatattcattctttaaaaaactgttgagtatttatatgtgacagccactattgatataaaaggaatgtagtggttctggtttgcaagatatccagatagtttttaaaaggtatgagaattgttaccaatgaactgcagtgagattaattgttaaatttttctggaagaggctgggcgcggagtggctcacgcctgtaatcccagcactttgggcggctgaggtgggtggatcacctgaggtcaggagttcatgacc

SEQ ID NO: 128207 - DNA, 510 bp, Homo sapiens
ctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtct

SEQ ID NO: 128208 - DNA, 447 bp, Homo sapiens
atgctgtttaaagatatggtctggagctggccacattggctcatgcctataatcccagcactttgtgaggctgaggtgggagaattgcttgaggccatgagtttgagaccagccctggcaacatagcaaaactccatctctacaaaaaatagaaaaattagctgggtatagtagtacacgcctatagtcccagctactctgcaggctgaggcaggaggatcacttgaaactgggaggtcggcctgcagtgagccataatagtttcactgcttcagcctgggtgatagagtgagaccctgtctccaaaaaagataaaagataaaagatgccaggcgtggtggcttacgcctgtaatcccagcactttgggaggccgaggtgggtagatcacttaaggtcaggagttcgagaccagcctggccaacatggtgaaaccccgtctctacta

SEQ ID NO: 128209 - DNA, 297 bp, Homo sapiens
gagggagggaagcgggaggggcgcagagccgagctgcggggtgctgcaggtgcctctggggagagggcgcgaggagaaggcgccctgcggggggctgggcgccagccagtcctgggatcttggttcgtccccatcctcgtgaagcccctcggccttcccgcgactccgagggtgggccggaagcctctctgcgggtccgtttcccaactggcgggttgcaccatcccgggccagaccgtttaaccccgggagtggccgcgggggacaactccgcccctgtccagcagggggcgtgcc

SEQ ID NO: 128210 - DNA, 683 bp, Homo sapiens
gggtctgttgagtcagtcgctacgtttccagtccgctttccaccttcctaatcttattgtcatctcctctcttattatctggctcattttagtgagtttttggagagaacagagttaaatgtattcgttcaattcatcttgtttacccttttcttctttttgtttttatgtttctcctgtcactttccacatatcacctccctactttctgttttccatttcttccgtccatgttggttctccttagaattagaattatgaaggtggagaatcctcagagagcatctggctcagtcacttcatttttcaggtggtgaacctgagacccaaggagaacaacagtccatccacgggccacacaattactgctcttatcttttctacctttaatagcaaagagacttttgcccttctaccccttcagctagtgagccacaaccacacaagaaagaatagtacccgctactcaaatgggaagctggaaagcagatggaggagaaaatgtcattgctgaccaggttgctgtgggtcctgaggagagaacaactccagagacaactctgttaggactgcctcggtctcctgtgcccactgcaccccttccccactgcagtgccaggtggaggccagtagctaggagagtgcttagccgtcttgggaccctcaagctcttttcacttttt

SEQ ID NO: 128211 - DNA, 418 bp, Homo sapiens
tctttttggcaacaataatacggcgcccaacgtgggcctcagagaagactcggaaccccaaaggagttgcccgaaaccggagagagaagcggagatcctgatgtttctcagtgccattgtgatgatgaagaaccgcagatccatcactgtggagcaacatataggcaacattttcatgtttagtaaagtggccaacgcaattcttttcttccgcttggatattcgcatgggcctactttacatcacactctgcatagtgttcctgatgacgtgcaaacccccccctccccatatatgggccctgagtatatcaagtacttcaatgataaaaccattgatgaggaactagaacgggacaacagggtcacttggattgtggagttctttgccaattggtctaatgactgccaatcatttg

SEQ ID NO: 128212 - DNA, 642 bp, Homo sapiens
gttaacagtgcattttgtgtttatatgtatagaagagtactttttctagcatcagagcttgtgtcccatggtcctttatagctgcaggcttatttctctgactaagcctctataacagtcgttaaatttgaggtaagaagttcctattgatacatccatttgaatagctagctttggtttcactcaccactgacttcagcataatatgatccttcatttgataacagttgactctttgggtggaatttgtttgactcatacatttttggaattaaagagaatctagcctggtagtttttaaactatcttaattgaagtcttcagaggaatctcagggccagttctccaacaactggaacaccctaagggctaaacccaagcccagatcccaggcccagatcccagtcccagatcccaggcccagctctttagattttccattccagcaatcctgctttgatcccttgtaaaggttaggttctgcgtaagacagcatttgaagagagggttctgcagctagcagagcttgaaaccactggtctggctagcatttgccctattcctttgacagattaggagcttgaggattagcaattatgactgaaggtcatacaccaagatggtagaattgatgatcacagc

SEQ ID NO: 128213 - DNA, 2265 bp, Homo sapiens
  misc_feature (873)..(873): n is a, c, g, or t
ttttgttgttgttacttgtttgtttgaaataatattagcctaaatttgacattcacactgagtatcagtaagggtcatggtttttaaaccttgtgctttcttatttttttcaaactaatttcagacttaaatagaagttacaagaatagtacagggagtttcatgtacccttcacccaaattcctcaagtgttaacattttaccacatttataggtttttttctgatacacttgagagtaagtttcaggtagatgtccctttacttctaaatatttcagtgtgtattttctaaaaaacagggatattcccttatagaatcatagttttattatcaaaatcaggaaatttaataattatatgtctcatctaactatagatcttattagtatttcactattcttctaatctctttagagcaaaatggaaaaaaatggtttttctgttctggtgcaggatccagcggaggctcacgtgctgtattggattatcacatccttaatgttctttaatctgaaatcgttcccaagtcttgttattcatgaccctgactgacatttttttaagagtaaaaacactaggggggattttttgttgttttttgtttcattttgttttttgtttcgttttgttttttgtcttttgtttttttttgagccagggtctcactctgtcacccaggctggagtgcaatggtgcgatctcagttcactggaacctccacctcccaggctcaagtgatcctcccacctcagcctcccaaggagctgggactacaggctacagccaacatgcccagctaatttttgtattttttgtagagacaggatttcgccatgttgcccaggctggtctcaaactcatccaatccgccnaccttcaccttgacctcccaaagtggtgggactacaggcgtgagccactgcacccggccaaagacccattcttttataaaatgtccctccctcaatttggatttatctgatgttttctcataattcgatttaggttctgcatttggggcaggaatagcaatgaagtaatgatgtgtcctctgtgtatcatgcaaggaggtttacaaagtctacttgtgccgttacttatgatgctaattttaatcacatggttaaggtgtctgcagccttatgctttcccagtttccctggtttactaaccattccattaatgaatttacaaagtaagcaaaatgtatatttcccaagtcagttcctgactgttttctcctaaaataaatccttgcgtgctgttgtcaacctaaactatgaaatgctctaaaataaatccttgcgtgctgttgtcaacctaaactatgaaatgctctgggattctgtcctgtgctgttggggtgcatcaagatgccaaacccacgaaccaagtattttgtcaaatgaactgagtcttcagggacattgaggcatgtctgcatttagctcaaaaggtagaagtctcacaaaactgatactagcgaatatcatgttactgaaaattcttggttattcaggcgttcctagctatgtataagtgcttcctacctacatacaacgtctttcttctatgcacatcatctcaggtaccaaatagacagtattatttaaaatccccctttgacattttatgctcagtttttcagaccatggaaatctacacctatgatgctcttccaagatcactgggcatttttttgtagtttagtaagtgacttatttaatttgcaattctcaattatttcatttatatgtaaacttttttacgagacacaaggttccactctgtcacccaggcaaatggtacaatccaatggtacgatcatatctcactgcagttgtgaactcctgggctcaagagatcatcctcctgtctcagcctcccaagtagccaggattacagacacacaccaccatgcccagctatttttttttttttttttaaatacacagggtctcactatgttccccaggctgatctcaaactcctagcctcaagcaaccctcccactttgggaggtcaaggcatacgtatcacctgaggttgggagttcgagaccaacctgacgaacatggagaaaccctgtctctactaaaaatataaaattagccaggtgtggtggcgcatgcctgtaatcccagctactcgggaggctaaggcaggagaattgcttgaacccaggaggcagagattgcagtgagccgagatcacgccattgcactccagcctgggcaacaagcaaaactccatctcaaaaaaat

SEQ ID NO: 128214 - DNA, 1127 bp, Homo sapiens
aaactgggaaagcataaggctgcagacaccttaaccattccattaatgaatttacaaagtaagcaaaatgtatatttcccaagtcagttcctgactgttttctcctaaaataaatccttgcgtgctgttgtcaacctaaactatgaaatgctctaaaataaatccttgcgtgctgttgtcaacctaaactatgaaatgctctgggattctgtcctgtgctgttggggtgcatcaagatgccaaacccacgaaccaagtattttgtcaaatgaactgagtcttcagggacattgaggcatgtctgcatttagctcaaaaggtagaagtctcacaaaactgatactagcgaatatcatgttactgaaaattcttggttattcaggcgttcctagctatgtataagtgcttcctacctacatacaacgtctttcttctatgcacatcatctcaggtaccaaatagacagtattatttaaaatccccctttgacattttatgctcagtttttcagaccatggaaatctacacctatgatgctcttccaagatcactgggcatttttttgtagtttagtaagtgacttatttaatttgcaattctcaattatttcatttatatgtaaacttttttacgagacacaaggttccactctgtcacccaggcaaatggtacaatccaatggtacgatcatatctcactgcagttgtgaactcctgggctcaagagatcatcctcctgtctcagcctcccaagtagccaggattacagacacacaccaccatgcccagctatttttttttttttttttaaatacacagggtctcactatgttccccaggctgatctcaaactcctagcctcaagcaaccctcccactttgggaggtcaaggcatacgtatcacctgaggttgggagttcgagaccaacctgacgaacatggagaaaccctgtctctactaaaaatataaaattagccaggtgtggtggcgcatgcctgtaatcccagctactcgggaggctaaggcaggagaattgcttgaacccaggaggcagagattgcagtgagccgagatcacgccattgcactccagcctgggcaacaagcaaaactccatctcaaaaaaat

SEQ ID NO: 128215 - DNA, 686 bp, Homo sapiens
agttgaggattaaatgagttaatacacaaacagctcttggaacaagtgcttgtcacatagtaagcctgcagtgaatcttcgtgctgctgctactgttaaatattattactgaggctgagctggcctagggctccttggattggacttgctaagagctaggcaagagtcacaactgtatgaaacttgattgagttaaaacaaacagtgctactcctctttattatctccatgcctggtaagcacattttctacccccaaaattgggactgactaatatgagaatatttatggccttaataggacaggttatttgatacaattactagcctagacattttaggagattggccgctcctcaatactataaatgcatatatgggtgtgtagatagagatgttgcttcccagattgccacacatcctgatactgcaagtaggcatcaactgaaaatgtgccgtgatgtgaagaccaaacgcagagaagtgagagggacaaggctgtgctcagtgacccatatccagatgagaaatccatctgctcacttgggagcaaaaatgccccaagaccctgctatctctgggcttgcacgaggctttaaatgaatcaccattatgatgtcttatattcagagggaaataccaatattcatatattcaggtactgaaacttttaagggaatttttctt

SEQ ID NO: 128216 - DNA, 9037 bp, Homo sapiens
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgtcccagcggcgtgtcacatttcacctgccagaaggctctcaggaaagcagcagtgatggtggactgggagaccatgatgcaggcagccttaccagcacatcccatggcctgccccttggctatcctcaggaggagtactttgatcgtgctacacccagcaatcgcactgaaggggatggcaactccgatcctgaatctactttcatacctggactaaagaaagaaataactgttcaaccaactgtggaagaggcctctgacaactgcactcaagaatgtctcatctatggccattctgatgcctgctggatgccggcatctctggatcattccagctcttcacaagcacaggcctctgctctatgccacagcccaccactgtcacaggcctctactcagcaccacagcccaccagtgacacagaccattgttctctgccacagccctccagtgacacagaccatcgcattgtgccacagcccaccaccgatacaggtgtctgctctccaccacagtcctcctctagtgcagggtactgcacttcaccacagcccaccatcagcacaggcctcagccctctgctacagccctcctttagcacaggctgctgcaatcagccacagctcttctctgccacaggttattgccctccatcgtagtcaggcccaatcatcagtcagtttgcagcaaggttgggtgcaaggtgctaatggactatgctctgttgatcagggagtgcaaggtagtgcaacatctcagttttacaccatgtctgaaagacttcatcccagtgatgattcaattaaagtcattcctttgacaaccttcgctccacgccaacaggccagaccgtccagaggtgattcccccattatggaaacacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggcttatcatgacagagcgtactatttctgatgtacagtattttttgttgtttttatcatcatgtgcaatattactgatttgtttccatgctgattgtgtggaaccagtatgtagcaaatggaaagcctagaaatatcttattttctaagtttacctttagtttacctaaacttttgttcagataatgttaaaaggtatacgtactctagccttttttggggctttctttttgatttttgtttgtggttttcagtttttttgttgttgttagtgagtctcccttcaaaatacacagtaggtagtgtaaatactgcttgtttgtgtctctctgctgtcatgttttctaccttattccaatactatattgttgataaaatttgtatatacattttcaataaagaatatgtataaactgtacagatctagatctacaacctatttctctactctttagtagagttcgagacacagaagtgcaataactgccctaattaagcaactatttgttaaaaagggcccctttttactttaatagtttagtgtaaagtacatcagaaataaaactgtatctgacattttaagcctgtagtccattattacttgggtctttacttctgggaatttgtatgtaacagcctagaaaattaaaaggaggtggatgcatccaaagcacgagtcacttaaaatatcgacggtaaactactattttgtagagaaactcaggaagatttaaatgttgatttgacagctcaataggctgttaccaaagggtgttcagtaaaaataacaaatacatgtaactgtagataaaaccacatactaaatctataagactaagggatttttgttattctagctcaacttactgaagaaaaccactaataacaacaagaatatcaggaaggaacttttcaagaaatgtaattataaatctacatcaaacagaattttaaggaaaaatgcagagggagaaataaggcacatgactgcttcttgcagtcaagaagaaataccaataacacacacagaacaaaaaccatcaaaatctcatatatgaaataaaatatattcttctaagcaaagaaacagtactattcatagaaaacattagttttctcctgttgtctgttatttccttcttttatcctcttaactggccattatcttgtatgtgcacattttataaatgtacagaaacatcaccaacttgattttcttccatagcaaaactgagaaaataccttgtttcagtataacactaaaccaagagacaattgatgtttaatgggggcggttggggttgggggggagtcaatatctcctattgattaacttagacatagattttgtaatgtataacttgatatttaatttatgattaaactgtaattttgtaacataaactgtggtaattgcataatttcattggtgaggatttcctttgaatattgagaaagtttcttttcatgtgcccagcaggttaagtagcgttttcagaatatacattattcccatccattgtaaagttccttaagtcatatttgactgggcgtgcagaataacttcttaactattaactatcagagtttgattaataaaattaattaattttttttctccttcgtgttgttaatgttccaagggatttggagcatactggttttccaggtgcatgtgaatcccgaaggactgatgatatttgaatgtttattaaattattatcacacaaatgtgttgatattgtggctattgttgatgttgaaaattgtaaacttggggaagattaagaaaagaaccaatagtgacaaaaatcagtgcttccagtagattttagaacattctttgcctcaaaaaacctgcaaagatgatgtgagattttttcttgtgttttaattattttcacattttctctctgcaaacctttagttttctgatgatctacacacacacatacacacacacacacacacacgtgcacacacacacatttaaaggatataaaaagaagaggttgaaagattattaaataacttatcaggcatctcaatggttactatctatgttagtgaaaatcaaataggactcaaagttggatatttgggatttttcttctgacagtataatttattgagttactagggaggttcttaaatcctcatatctggaaacttgtgaagttttgacacctttcctatagatataggaatgaaccaatacgcttttattaccctttctaactctgattttataatcagacttagattgtgtttagaatattaaatgactgggcaccctcttcttggtttttaccagagaggctttgaatggaagcaggctgagagtagccaaagaggcaaggggtattagcccagttattctcccctatgccttctcttcctaagcgtccactaggtctggccttggaaatctgttacttctacggcttcagatctgatgatatctttttcatcacattacaagttatttctttgactgaatagacagtggtataggttgacacagcacacaagtggctattgtgatgtatgatgtatgtagtcccacaactgcaaaacgtcttactgaagcaacaatcgaaaaatggttctgttttaaaaaggattttgtttgatttgaaattaaaacttcaaactgaatgacttatatgagaataatatgttcaatcaaagtagttattctattttgtgtccatattccattagattgtgattattaattttctagctatggtattactatatcacacttgtgagtatgtattcaaatactaagtatcttatatgctacgtgcatacacattcttttcttaaactttacctgtgttttaactaatattgtgtcagtgtattaaaaattagcttttacatatgatatctacaatgtaataaatttagagagtaattttgtgtattcttatttacttaacattttacttttaattatgtaaatttggttagaaaataataataaatggttagtgctattgtgtaatggtagcagttacaaagagcctctgccttcccaaactaatatttatcacacatggtcattaaatgggaaaaaaatagactaaacaaatcacaaattgttcagttcttaaaatgtaattatgtcacacacacaaaaaaatccttttcaatcctgagaaaattaaaggtgttttactcacatggatatttcaacattagttttttttgtttgtttctttttcatggtattactgaaggtgtgtatactccctaatacacatttatgaaaatctacttgtttagacttttatttatactcttctgatttatattttttattataattattatttcttatcttcttttatattttttggaaaccaaatttatagttagtttaggtaaactttttattatgaccattagaaactattttgaatgtttccaactggctcaattggctgggaaaacatgggaacaagagaagctgaaatatatttctgcaagaacctttctatattatgtgccaattaccacaccagatcaattttatgcagaggccttaaaatattctttcacagtagctttcttacactaaccgtcatgtgcttttagtaaatatgatttttaaaagcagttcaagttgacaacagcagaaacagtaacaaaaaaatctgctcagaaaaatgtatgtgcacaaataaaaaaaattaatggcaattgtttagtgactgtaagtgatactttttaaagagtaaactgtgtgaaatttatactatccctgcttaaaatattaagatttttatgaaatatgtatttatgtttgtattgtgggaagattcctcctctgtgatatcatacagcatctgaaagtgaacagtatcccaaagcagttccaagcatgctttggaagtaagaaggttgactattgtatggccaaggatggcagtatgtaatccagaagcaaacttgtattaattgttctatttcaggttctgtattgcatgttttcttattaatatatattaataaaagttatgagaaata

SEQ ID NO: 128217 - DNA, 5118 bp, Homo sapiens
ggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacatggcgaaaccccgtctcttctaaaaaatacaaaaattagccgggcgtggtaatgggcgcctgtaatcccagctactcgggaggctgaggcaggagaattgcttgaacccaggaggcggaagttgcagtgagccgagatcgtgccgttgcactcca

SEQ ID NO: 128218 - DNA, 4864 bp, Homo sapiens
cccctttctccccctctgttaagtccctccccctcgccattcaaaagggctggctcggcactggctccttgcagtcggcgaactgtctgggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggaaaatcctgttgtgaataagaaggattccacagatcacataccagagcggttttgcctcagctgctctcaactttgtaatcttgtgaagaagctgacaagcttggctgattgcagtgcactatgaggactgaatgacagtgggttttaattcagatatttcaagtgttgtgcgggttaatacaacaaactgtcacaagtgtttgttgtccgggacgtacattttcgcggtcctgctagtatgcgtggtgttccactctggcgcccaggagaaaaactacaccatccgagaagaaattccagaaaacgtcctgataggcaacttgttgaaagaccttaacttgtcgctgattccaaacaagtccttgacaactactatgcagttcaagctagtgtacaagaccggagatgtgccactgattcgaattgaagaggatactggtgagatcttcactaccggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccgactgattccaggacatgaactattgaaatctgcagtgagatgtaactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcgcaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattgactaacataatattgctgagaaaatcatttttattacccaccactctgcttaaaagttgagtgggccgggcgcggtggctcacgcctgtaattccagcactttgggaggccgaggcgggtggatcacgaggtcaggatattgagaccatcctggctaacatggtgaaaccccatctccactaaaaatacaaaaaattagctgggcgtggtggcgggcgcctgtagtcccagctactcgggaggctgaggcaggagaatggcgtgaacccgggaggcggagcttgcagtgagccgagatggcgccactgcactccagcctgggtgacagagcaagactctgtctcaaaaagaaaaaaatgttcagtgatagaaaataattttactaggtttttatgttgattgtactcatgctgttccactccttttaattattaaaaagttatttttggctgggtgtggtggctcatacctgtaatcccagcactttgggaggccgaggcgggtggatcacctgaggtcaggagttcaagaccagtctggccaacatggcgaaaccccgtctcttctaaaaaatacaaaaattagccgggcgtggtaatgggcgcctgtaatcccagctactcgggaggctgaggcaggagaattgcttgaacccaggaggcggaagttgcagtgagccgagatcgtgccgttgcactcca

SEQ ID NO: 128219 - DNA, 187 bp, Homo sapiens
cagagagatcagtggctaaagcctctcagaattaggtgtggtgctcagagctggggatccagtgacttggtgctgatggtggggacagaggggtaagggggctttgtggaccaccctccatggggatggctatgatcatataagactgtggacctaagggaaaaatctgaggccaaagtaatataag

SEQ ID NO: 128220 - DNA, 285 bp, Homo sapiens
gaatgaggttaaaaaaaccagtagaggatgaaactagagaatacacatggccttgactccactgagaggcatagtgttttttgctgtgggacccatatagatgctagcagaatgtgtgtgttattgatttttttttttttttttgagatggagttttgctcttgctgcccaggctggagtgcaatggtgcaatctcggctcactgcaatctccacctcttgggttcaagtgattctcctgcctcagcctcccaagaatctgggattacaggtatgcgccaccatg

SEQ ID NO: 128221 - DNA, 260 bp, Homo sapiens
aattttattcaaagctgcctttgtgtgaggatctgatagcatagaggtagtagaaatagacattttttaaggggtaactcccaacaaaataaaagcgaagtaccagttgtggcagggatgacagtggttattggatcaccgagctgtattctttctatcagctctctccaagggactcagctttctaggagggggagatggaaatcttaaacaggtttgatagcttccctaccttttatctgcccagagagccggaattc

SEQ ID NO: 128222 - DNA, 452 bp, Homo sapiens
aacctcagctgggaagaaagagccccccacctggtcagttacccagaatcttccctcttgctaactttatctccttctgttcagcttcacaaaaccatgctcaattaggttccaaggtgtgcctcggctcccctcttgatcccattctttggttgtaaggttagcttcctggttctttttgtttgtgaggggaaggggagacagagtctcattctgtcacccagcctggagtgcattggtgggatctcagctcactgcaaacctctgcctcccaggttcaagtgattctcatgtctcagcctcctgagtacctggaattacaggcgcttgccaccacacctggctaatttttgtatttgtagtagagacaaggtttcactctattggcccggctgatcttgaactcctgacctcaaatgatccgcccactttggcctccccagatgctggaa

SEQ ID NO: 128223 - DNA, 273 bp, Homo sapiens
agaggttgaggttatggtgagccatcacatcactgactgcactccagtctgagcaagagagcaagaccctgtctcttaacaaaaaaaagaaaagaaagaaagaaagaaaaaagattcactgctttggtccacaaaggaaacatggctttggtccacattcagtatttctaatctgtatttcatacttatgcccataattaaaaattagtgaaatgaaaaaagacttcttacttgaaaataaggcaagccatttcttcatcgacttttttttag

SEQ ID NO: 128224 - DNA, 626 bp, Homo sapiens
caacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaaacctcgagggggggcccgaaccccatttgccctataggaggcgattacaacttactggcccacgtttaacaccttatacatggaaaacct

SEQ ID NO: 128225 - DNA, 161 bp, Homo sapiens
ctcaaagggcacactattgacctacttgccatccagcccctatggaaagcttgactcagcaggggcaaacctgagcaggagctccagctcattgcacagtagacacctgggtcacaaatctgggttagggctaagattttgcttgatgaccaaagagtcat

SEQ ID NO: 128226 - DNA, 660 bp, Homo sapiens
ggaattcatcatcatttccctatgcattctgccttcagcttcttccctccaggtaaattgcagacgtgatgctcagaattaaactgtcaggatgctgccattctgctgcatgctccggacagctggccgttagggagcactgcaggcttggaagaggtgacttgtctccctgtgtacagccctctgggtagagcagctgtcatctaaatacagatgctgatctccaaaagaagttccagtttggttacagaggtaatttcagcatttttcctttctctcaatatttgagtggtccatttttaggattgtttagaagagcttcaatggacctattttcctacctattttctatgggtattgtcttccccttcaggtaatatgatccttgaaggcagagaatgtttctacttttctttgctaatccctcagcatccaatttaataatctgcacactagacttgatgctatcaatccagttatgggtgcaaagtaatcttaggaagcagatacaaatccaatcctccttctgttagagggagataataatacctgctttttacctatcatacaaagatgtatgttcaaatcatttttttttaagttggaaaaacatactatgatttgtgtgtaagtgctttagactctctggcataaagacag

SEQ ID NO: 128227 - DNA, 464 bp, Homo sapiens
  misc_feature (33)..(33): n is a, c, g, or t
gctgcttgtttagtgactcatagaggatcccgnacgagcatccttacagtggcacagtctaccctccaggtctgcgttgcctccttgccaccaggtagcccctcacagcaactgtaggatataggcctgactcccagggtggtcatgaaggtcagatgagatgatggataggcaggagatgtataaagtctaaagtgatgaggctaatggtggctgagtgatttgcctaaggtcaccctgggggagatgggggccaagccaggacctcagtccaggtctcctggccaggacgtcgaccactagagccccagaccatcatgggtgcccctctgagaagttttacttttctccaactccctgacccacttgcagagctgcaagcaggcaggctggctcccagctgggataatcactggccgctggctgaggtgtaagatgctcgtgccttcctggtagacaggaag

SEQ ID NO: 128228 - DNA, 337 bp, Homo sapiens
tggcctaagcactctgggttgggccagggagaagtcttgatggagataggtcacgtggcagcagggttgtattttcttggggttttctcatttcctttatgggcaggcgggttccccacctctatcatgaactcagagctgtggccatggtaccgcgtgctgctcttgtgagtcactctcccgtgccgcctaattgcccagacctggggacccgcagccctgcccttccctctgttaagcttgacctgaccaacgtcacgtaactcccttcagagcctggccctgcaggaagggccgtgtgctgtgtggaggaagccccgagccagggttgactctc

SEQ ID NO: 128229 - DNA, 420 bp, Homo sapiens
actgcaacccctgcctcccaagttcaagcaattctcttgcctcagcctccggagtgtctgggattacaggcgtgaaccaccacacctggctgaactttgtatagcaatagttttttttaaaaaaaggtaacgtagcattctaaaacattttagcacaaagcaagcactcagataataactgccgaacaaatgaaagggaggagctccaagatgtgttacttttattgttttgtttttgacgtaagagtctcactctcacccaggctggagtgcagtggtgcaatcaccgctcactgcaacctctgcctcctgggtttaagctattctcctgcctcagcctcccaagtaactgagattataggcacacaccaccacgcctagctaattttttgtatttttagtagagacggggtttcacca

SEQ ID NO: 128230 - DNA, 463 bp, Homo sapiens
ctctgcacagggctgtattctgaagcaataactctgaagccatcacatttctgggcactgcaaccctcaaaagaggcacaggcaggcatgccaggggacaggggaagagtctcctgcacagggtggcaattctaaggaactaagctgtaagtggctcctaccatagggaataggcatcatccattgattgccctacagtgtggacaatcattgatgaaaacctgcggtaaagaagggaaaattatgcaacaccaataaggcagctaaattgctctcctctctgggccaagagcgcctgaaacctgctcaaatgggagagtccattcagttattcacttgtgcattcaataaaccattacagaatatctacattagaaggaagctgaatatccactgatcttggtaaattttttcttaccaacatttagtggacctttagactataactgttttttgtatagta

SEQ ID NO: 128231 - DNA, 182 bp, Homo sapiens
attgagcatgaggggcttgttagagaccagattgctagtggagtgggcagggagcatagcaggacatgagtcctagggaaatggtcacaaatagccctgaagcatcctcttacccattttcattccagaaaagctggcctggccaggctgcagaatcagaggtgcatatgggcacacagtgg

SEQ ID NO: 128232 - DNA, 597 bp, Homo sapiens
tgattagatcactcggtgtctgggagaggctatggggatcccttgcagagccagggctgtattgtcatagcagttgcctccctgctaatttatctcagggctcacactcttacatttttggtctaatcacttatatatcactcagcaataaaaaactgtgtcaaaaagattaaaattttagacattcctgcagttgctggaaaaaatggtgataatgtcataaaatatgcaatctttatttcttaaatgttcatgctatatgaaaacagttccatgtactcctccaatttctggtttacagacaatatattatattttaggtgttatttgtttaagatgagatacaggattaaagggaaactagataatgtattggcaaaaatttgagaactgttgttgatgctccagttgctattattttgcaaaaattcttttgtatttgtttatagtagttaatcataaagtatgattttggctgtttgttttccacctgatacatttatttatttattgtagaatatatttgttttaaaatttcagctttgattactgacagagaatatgaatgatggtattttaatgctttctgtcatttaa

SEQ ID NO: 128233 - DNA, 933 bp, Homo sapiens
  misc_feature (378)..(379): n is a, c, g, or t
  misc_feature (387)..(387): n is a, c, g, or t
  misc_feature (392)..(392): n is a, c, g, or t
  misc_feature (395)..(395): n is a, c, g, or t
ggcaacgtgtagaactcagaagggcaaactgtacctgatcctgtaaaagacaagctctggctgggcgcggtggctcatgcctgtaatcccagctactcgggaggccgaggtgggtggatcacgaggtcaggagtttgagaccagcctggccaacgtggtgaaaccccatcgctactaaaaatacaaaaaattagccaggtgtggtggcaggcgcctgtaatcccagctacttgggaggctgaggcaggagaattgcttgaacccaggaggtggagcttgcagtgagccgagaccacgccactgcaactccagcctgggcaacagaggagaaactccatctcaaaaaaaaaaaaaaaaaaaaaaaaaaaaaactttgtnnggcgggcntgggnccntgaagaaagttttaaacaccttggtttggggcgaggcgagcacccaaaatagggtaggggaaccgtggcacaacggtgtacccaaggaaaccggggcaagaaaagggggtgggtattcccacccataaaaaaaggccgcggggaacaccggagggttgtggaacaaccccagaagggggtggagagacaacggggacccacaacgaggagccccggggaggcgaattaaaattagcccggcgtgggtgaaaaaaagaacaaggaagacgagcaagaggaaagacgaaacaagagagagcaacgaggcaccagagaggacaagaacagaagaacagcaaaacagaacaatagaaagcagaagagaagacagcaaaaagaaacgaacacgaagcagagcacagaagagagaaacaaagcagaggaaaacaacaacagaaagaggaagcgaaaagaaagctagagaggaaacaatagcaaaacgaagggcagacaacaatacagaaaggaacaacagaacggaaagacgaaaaacgagaga

SEQ ID NO: 128234 - DNA, 412 bp, Homo sapiens
tgttgtgttaaaaccataatcatttctttttgctgtgcgcctatctttagcattccagtatctgaggtggtcacacggcctcagtggatcctctgctcactgtgatgagcctccagcctgtttcatgtggccggtgccattcgctttgtatttctgtcttctttatggcttatttcattccacggtagagatccaggagcagagaaagcctgaatatgaaaattctctctctgcgaattttaaagaatatgttcattcaggtgctagattctattttgaacaaaatcttaagaattctaactcatctaggctgggcgtggtggctcacgcctgtaatcccagcaccttgggaggctgaggcgggcagatcacccgaggtcaggagttcgagaccagcctggccaacatggtg

SEQ ID NO: 128235 - DNA, 319 bp, Homo sapiens
tgctgaagaaggtgagtgggaaagacaggctcgaggagggttgtctgaaaacatgggacaaaggaccacaggatcctctcacctgagcagcccatggggacctctggccaaggcctgcctgagctgtccaagaggaagtctgcacagcctgtcctgtgggtgcgtgtatgtgtgtgtgtgtgtgtgtgtgtgtgtgtgtgtgtggtgactgattagactcatttctaggcctctaggggttagaactaagagcaaaggatggagattatagagggagatttcaacactgaataaggagtgctctattcaagccagaaca

SEQ ID NO: 128236 - DNA, 381 bp, Homo sapiens
ataatagttaaaaccagtcaattacctttcacacacacaaaaacatgttaaatgtgcccatttggtatgttaaaactgagtgctaggctttttgctgaatgagttgtatttcaaagcatagtgcttcagttaattttatatatgattatccttcataaaataagtctaaacaggatgaattgtttttcccactgattgtgttaatctgtgattagttcttggctatgaatgatatatctttttaaactttgtcctttttagattgctactagctttcagtggatgctatttgtgatatttatttctgaagaaaagaatggacactcttttgctcttcagggggactgatagtggaaataaaatttgatttgttatctgggc

SEQ ID NO: 128237 - DNA, 252 bp, Homo sapiens
gacatatgcagtccgtagcaggtatcatgttttaaaagccctcgtctcttagataaacactgaaaaattcacaaatgagacagacatctagaatttgcttcagaagagttcaggagtaggaaagtggatggcaagggtagagacaaaaccagattggccacaagttggtaactaactgttcaattgctgaagctgggattcattatactagtatcacttttttgctttttttttttttttttttttgagaca

SEQ ID NO: 128238 - DNA, 257 bp, Homo sapiens
tctcaccatgagggggaaaagtcaacttgaagcaggacagggtcattgacaatttcctgtgattccacagctgccttgtacactatggtagctcctagccacttgttgtttagattttgtgatttagaaatgaattaaggccgggcatggtggcacacctgtaatcccagcattttgggaagccaagacccgaccggagcgcaacaccgggccggggcgcaacacccggccgagcgcaacaccgggccgagcgcaac

SEQ ID NO: 128239 - DNA, 294 bp, Homo sapiens
cttttttaaactaccagttacacacacacacacacacacacacacacacacacacacacagaaattccaccatgattggtcagaataggtgaggttttgctgcaataacaaacaactcccaaatcttggtaacttcaaacatcagaagttgtttttctcactcatgcttcatctgcagggaggtgtggggtgctctgtttcccatcaaacttgccctaagactaaggttaatgggggttgcaatacctcgagtatcaccaagcagggaacagagggagaagaatgttagagagt

SEQ ID NO: 128240 - DNA, 502 bp, Homo sapiens
catggatgtgcaagtatggcatgtgtatacatgtatcatgcatgtacatgtgcatatgtataccatgatgacttgtgtgggtgcatcatgtgcatgctcacacatactggtctctgtgtgcatgtgtgtgcattttgcagggtgtgtgcatgtgcattgtgggtgcatatgcaagcacgtttgcaacccctccatctaagaggaaatctttgctccacatccatttgtccaaccagcatatatggagcacctactgggtgccccgctaggaattaaagaaatggctgatcaagacatgagtgattgctgagcctcagaatgttgtcccacccaaggactggcacagaggctgcaggtgtgatgtggagagaagcatgcggggaaaatgtgaagtggcatacatgatagagtcctgaatcctgacaaaggaaaggcccagctagatctgagagccaatggctgctgcagggtgcacatcaggaatccccacatccccctcaag

SEQ ID NO: 128241 - DNA, 680 bp, Homo sapiens
ggggaggccaatgcctggggcagccagcccagaggcagcaaagaccaaatatgatgggggaagagggagtgccctgctgtcacagcagtttggcagagggtggtgtgagtagctgagacgctggaaacagagggtagaaccagcgagtgaagggctttcactactggatattgcagtgtcgacagggggaaatgattgttttttgagccccagaatcatatgatcaaacctatagtctgtcgtgctcactagaacatgagcttcccaaggcaaggagttcgtctagtattccctgtgtactcccagcactgagcccagcatcagtcacttagtaggtgccacgttgatatttaatagatgtgtttcatagatatgtacagccacaatatatacaatgtttatggatatatataatatatatgttatgtagtaaacattttaaaactttgataagaatacacactaatggtcaagggagtggttactttggggaagagaggaaataggattgagatagaatacaaaagggatttcagctatgtctgattttttttcttataaagaagaactgggaccaggcgcagtggctcacacctgtaatcccagcattttgggaggccaaggcaggtggatcatgaggtcaggagatcgagaccatcttggctaacacagtgaaaccc

SEQ ID NO: 128242 - DNA, 345 bp, Homo sapiens
gtagttgggattacaggcatgcgacaccacacccagctaatttttgcatttttaatagagatgaggtttcaccgtgttggtcaggctggtctggaactcctgacctcacatgatccacctgttccagcctcccaaagtgctgggattacaggcgtgagcccccgcgcccagccaggagctttctaaacaaaataaataagtaaaatattcagcatgtcacatggttaaatgagctctcaagaacaataaagcagggaaaggggatatagtgtgtgtgtgtgtgtgcgtgcgtgcgtgcgtgtgtgtgtgtgtctaggaggtagatttaatttggtggtcaggaag

SEQ ID NO: 128243 - DNA, 245 bp, Homo sapiens
gaaaattagggaacatatgccccagttgaagagggcagttttgctttgatggccagcccattgtaaccttacagaaatatgggtgcagtgtggccaaattttctgatttttccaagagaagctagaaatctaagtaatgtaaaagatgtcctaattaaacattaagaaattgatgtattcttttaaaacctcgggccaaggtaaagaaagcacacctgcaagccaaaaggctacagcctcttact

SEQ ID NO: 128244 - DNA, 131 bp, Homo sapiens
acaaacctaactccaaggctaagtcctcaaagaggaaagcaagtggaggacttaagttacttaaagtgcgggatacagctgcgggcagtagcacatgcctggggtccccactacttgggaggctgaggtgg

SEQ ID NO: 128245 - DNA, 495 bp, Homo sapiens
taggatatgtgcatttagtagcttgatttagtacataccattaagacattagctttaaatatttgaagagcaggattgactttgaggtcagtttgctgtttcattgttactaatgataaatggtttctaagcaccattccaaacctttaagaaattgttacagcccaatatttgaggattgttagatccttactgaaagctaaggatgggaatgcagctgtgcctcaggaaggacagtggaagtgggagctggaaacccctcagatacccaagtagcatatactctatctcctacctctgcttctttgtgtatctttttttgccccccaagaattccgaggacaatcaagctttgtgtatcttttaaaaacttttcctctctttgccaactggatcatgtgctcctcagttcacatgatggagtatttgttttactggtctagccacagggagacatctttccctgttattctcaattctaggatcctggagagg

SEQ ID NO: 128246 - DNA, 196 bp, Homo sapiens
ctgctggcttagaggagagtacgttgcccttggaggggaagggtggacagaaggagcagtaagcagagctatgtgttgtcagagctcgtttttcgtgtcccagtttgagcccacaaggagagggttgggtgtccgttgatgacaactatagtggcccagaggatttcccagagccctggggtttccttagcccctt

SEQ ID NO: 128247 - DNA, 204 bp, Homo sapiens
atagcccaggttatttggcccatctacagttgagacgagagcttggggagcatgacttcctaagggcacccagctggactgaggcacagttttgcagaactgtgttcacagatgataaagcacagacccaagattgggtggaggtgtggccttgggtcactgtggccagggttagtctggagctttctgagtaagagatgggag

SEQ ID NO: 128248 - DNA, 475 bp, Homo sapiens
gatgtggtgttgcaatgaacaaaagaaggaatggtattcttaactgagtcatgagattataatcataaccacaataataataatagtaacaaaataaacactgttctttatcgagcccttatgtgtacactctgcttactgtgtttagacagatatagaccgcaactttttacatgaattatctcattccgtccaacagtccattaaagttgatactatcattttcaaatgtagaaactgtatgcctagatgtgcctagaggttaagtacattgctggagattacaaaaccaagctaagtggtagactcttagagcccgtatcctactctagactacatgcttgtccaaatggtagggatgcagacaagatttataaggtttttggtaggcacttccagatttgggacacatggcattgaaagcttgttttctgacttgagaggtcaggatttgctgacagtattttgaggagta

SEQ ID NO: 128249 - DNA, 365 bp, Homo sapiens
  misc_feature (301)..(301): n is a, c, g, or t
  misc_feature (326)..(326): n is a, c, g, or t
ctataataaatggctccagggccagccaacctgcagggcatgggggtggtattcccaggctttgtctttcctgaccaggttttgctcttgctgagactccattggcaaagcttatttgagggcacgcctgcacctgcctgcagaaacacctcgaaacagctctggctgtttggaaggctggtcatttgcaagcagaagcatgggaagcattattaatgacatgtggtgtggaacaatggtcgtaccacagacctgtagcaccaagatcaaatcatccctgatggaaagcttggccaagacntggcccagtgcttccaggctggtgncacacagtgccacgatccccaaacaacagggccccaagc

SEQ ID NO: 128250 - DNA, 214 bp, Homo sapiens
agtttcaagccaaatgacattgatgtccggaaaccaggatgtgctgaagtagaaatttccagggatccctcagagttatttgctaaaatgtttattattcttcagaggggggtggaaatatttctttaagagtcttccttgaagaattttgaactccagctttggagtgatgggagcacagtgcagggaaggcgggatgtgaggtggtgtgctg

SEQ ID NO: 128251 - DNA, 481 bp, Homo sapiens
gccggtctctacctcttgggctcaagcaatcctcttgccgcagcttcctgaagtcctgggattacaggcgtgagccacagtgcccagtgatgaactactttgtatatctcattgcagtttttctttccctccctctcttccttccttttttccatacacccagcagctcatttgagagctgtggttggctcacatctcctggacaagtcctaaggatggcttgaaacataacttagggtcatatttgaagaactcttttgtcagaccagattagtttaccttcaagctccctctgctgctctcctatgctctatcccctgctcactccacccccaatatctgactcctgctgatctggtcctgggacatggttgctggctaggccagaaatgcttagggaattgagaagagactactccatggcccttctctgcctgtctgagggtgagacagggtttgaatctgtggaggcatactgtcg

SEQ ID NO: 128252 - DNA, 500 bp, Homo sapiens
gtttcatcctatttgagtcaataaaaacagtggtgaggggtggggagataaactctgatgttttagaaacaggttagtcttgtgggaatctgatcattttctcactggaataacctgtgaaagcttgactagtgcagacgaagttgtaaaaacatagcttaggtcttcctactctgaacaaacaaatacatctgaggcttttgaatggatgcttattagactttcaggacactttggtggtgctgcaaagcatggcagaaaactgatctttggggtggaaagaaaatggtatgacattggaattttaagatcatcatgtcctaggttttcccatgtagagacagcattcatctttcacatggaatagacttagaagtatagatccacacgaggtcaggagttcaagaccagcctgaccaacatggtgaaaccctgtctctactaaaaatacaaaaattagctgtgtgtggtggcacatgcctgtaatcccagctactcgg

SEQ ID NO: 128253 - DNA, 427 bp, Homo sapiens
atgtacaaaagactaacaggttacatccattctatacatgcagggatttcataaaagttaaacacttcttcaaacctgcacacacaaatccatactgtggcatccagagtttctttaagcctcacactgtatcagtacaaacatcctacagggaattaattcactgagcacagaacaaatgtgtaatgcaaagagattaccaagtcacctccaccaccttgatttatataagctcttctgttttagcaacacctggagaatccagtggtctgtgcttcagtggtctcaagagctcttcatggcagttctgtaagaaagttgctggctttaacgcagggctggtttcaatatagggcagctgttttctgctgtgagtcttctggaggaaaaagaatgggttcacggaaactgaaagtaactgaaaaat

SEQ ID NO: 128254 - DNA, 614 bp, Homo sapiens
aggcggaggcgggtgaatcacgaggtcaagagatcaagaccatcctggccaacatggtgaaaccccgtctctactaaaaatacaaaaattagctgggcaaggtggcgcatgtctgtaatcctagctactcaggaggctgaggcagaagaatcgcttgaacttgggaggcacaggttgcagtgagccgagatcgtgccactgcactccagcctggcaaaagagcgagacaccgtctcaaaaaaacaaagtagccgggcctggtggcatatgcctgtagtcccagctactcaggaggttgaggcaggagaatggcttgaaccagggaaacagaggttgcagtgagctgagatcgtgccactgcactccagcttgggcgacagagcgagaatccgtctgaaaaaaaaaaatgttttgaaaggaaggaaggaagtgtggttgctagaatttgtaggttccactaagccctttccatgtagatggggcctgcagggagttgggggctgagtgtgcacagcctgatggcctctctgctccctagatgcatttctgctctgcgtgcctttgcaattacatctatcattagctagagagaggatctgaactagacctcccca

SEQ ID NO: 128255 - DNA, 535 bp, Homo sapiens
tatatgaatcttaacattctaggttgcctaagccaatgaatgggtaccctggccaagcaaagctgttcttctgggatccctgggatacaaaacaaaactgctcatgcatagaagacaaaaagctgtaataccaagcctgtgttttttatgtgttagcataaaagacaaaaggatctggtgattaagctaaagtaggttaagaactccctcatatgaaaagacatctcacatactaaggcatattcacaacttaaatcatattacagtccttcgatctggccaagagaagccaggtactgaagtttaggtggcagccagaaagctggactgagtggtagagaggatcttggactgtgaggtggggatctggatgcagagtaagaaaaggaagaaaaggtacaagtgaaaggagtccacaaagtgagttagagatacattctaaaggtcctgagatttagaaaacagcatgatcaaatctttgccttcatacttttcattttatctagaaccctagtattatctgctaagcctatag

SEQ ID NO: 128256 - DNA, 835 bp, Homo sapiens
cacacacaagagatgatcctgcctcaggacctttgcattggctgttgccacagccagtacctctcttcctcagatatccacttgactggttctctcaactcctttaaataccacttgatcaatgagacccattctgatcactctacttaaaattgttcaccccagccctcctatattctgctttatttttcccacagaactttattactttaaaacataaaagttactttattatattaatgtttatactttctatttccaaacctgccacttcacctcagtataagatcttcaagagcagccatctttgttttgttcaccagtgtaacatcagtgcctaaaacactacctggcacatagttgaggcttcattggtatttgttgaatgaatgaatgagtggatgaatgaattaatgaataaatagaagaattaggacaagacaaatagagtgtcagtaaggagcaagtctaggaaaggagtgagactgtgtgagacagaataatggccccccaaatgtgtccacattctaatccctggaacctgtaaatacgttaccttacatggcaaaagggactttgcaaatatgattaagttaattaccttgatatgggaaggttatcctggattagccaatgggcctaatataatccaagagtccttttattcaaagaccgagaaggtgatgtgacaatggaagtagaggctaaagtgatgcactttgaagatggaggaagagaccacaaaccaaagaatgcaggcagcctctaacagctggaaagagaaaggaaactgattctcacctggagcctccagaaggaacacagctctatcaac

SEQ ID NO: 128257 - DNA, 383 bp, Homo sapiens
tccagaccaacctgggcaacatagtgagactgtctgttttttaaaaagaaaaaagtaaactgtttatctttgaactagataaggtttttctcatgctttaaagcatgtttaatgattctcagccagtctcttggattaattttgtccgtagaatgctagccgaaaccaaaagatttttcttaatgaattaccttttaattgttctttcattgttttgttccctttttttcaattggattaaaaaattattaagggcagagatcatccatctctttgtatggggtaaagtaaatggtagtttaaatgaaaaatgaaattccatcaaaatggaatcttttaatcaaatctaatttctacagctgttcccagcttgctcagatgct

SEQ ID NO: 128258 - DNA, 592 bp, Homo sapiens
gtgaattcaatatttgatgtgattttgggaagtaaaggggaatgtcagcatcctttcgataaaattgatattatcaatctgaagaatgtttcttagatcagttgtgtccataacttgggagcattagctgtgagaccttgaaacagattggccatattcttatttcacattgattatttaaatggacaattttaggttactggtctttattcacttgttattgaaaccacatgcacactgacaatcagtgaaaatcactttatttattttagagacagagtctcgactgggcgcagcggctcatgcctataatcccaacactttgggaggctgaggcgggtggatcacttgaggtcaggagttcgagaccagcctgaccaacatggtgaaacctgtctctactaaaaatacaaaaaattagccggacgtggtaccgggcgcctgtaatcccagctactcgggaggctgaggaaggagaatcacttgaacctgggaggcagaggttgcagtgagccgagatcataccactgcattccagcctgggtgacagagccagactttgtctcaaaaaaaaaaaaaaaaaaaaaaaaag

SEQ ID NO: 128259 - DNA, 507 bp, Homo sapiens
cagatcctcccatctcagcctccctagtagctggggctactggtgtgcgccaccatgcctggctaattttttaaatttttttgcagaggtggaggtctcgctatgttgcctaggctagtctcaagcgcctgggctcaagccatcttcttgcctcagcctctgaaagcgtggagattacaggcctgagctactgtgcccagcctccctgttacttctcggatgaaatcctgccctgttggtgacactttccaggctatggatggcagtgcctgtctacccctccagtccttcttcctatcatacctgccacacggctgctcacaaacagtccccacccctgccccactgccaggcctctatctagcctcttcctcattcaagcccagctggagggtcaggctccctcctccaggacggcttccttgggctgcaagacagcgctgcccaccacactgaactgactcacaatggctctctgccaccccagagcaaacccagggaggggcc

SEQ ID NO: 128260 - DNA, 295 bp, Homo sapiens
ttattttccttctttatagcttattttctttctttatgggcctcacatccatagtctaggcaagaagaaagagaaagaggaattgaaagggcagatggctctgttgttgcaagcccttgccttttttacttagcgaaggatgccctcaccatggccttctgcctatacctcattggccagaattggtcactctaccaactcagctgcagggaagggggaatggaatgatctttatggccacgtttctacctccaacaaaacagggttttggttctcaagaacaggtggaagataa

SEQ ID NO: 128261 - DNA, 480 bp, Homo sapiens
tggcagaagcgtctgtgcaggggagtgggtgggtgggcatgggagtgtctgaggagatgcagctacaaagccccacagagtgactcatgcctttcacaatgactttcctatctcagtaaagccctgtattctatgagaagttccaaattggtaatagcagcagcaatcattgcatcattgcttttctgactttttactctcagtttaacttgattatattatttaacctcagaggcaaaaaggcagaaggtcagatattgctgctcttgtttcacgttaaagatttagatagaggtttagagaaaggtgaaacctccttaagtcacacaatgagttggtggttgatctgagactcacctgagtttctttctcctagccctgtgttctttccattaagaaaggacttcttatcaggtgtggtggctcaggcctgtaaccccagcactttgggaggccaaggtggaagtattgcttgagttc

SEQ ID NO: 128262 - DNA, 272 bp, Homo sapiens
tcagtctttctagtgtgactttctctgtagagaacttcatcatcatcaagtttgtgtcatcagaaaaattaaatgaacaccggccccatctgaaagcaggtaacttttttgtacaaaacaagcccgtttccaggttaacagagcagctacaggttctgttaccactcagagtaacaaaaatatgatggaaatggtgcatgggagatctcctgacctcgtgatccgcctgtctcggcctcgcaaagtgctgggattacaggtgtgagccaccg

SEQ ID NO: 128263 - DNA, 426 bp, Homo sapiens
attccacccccaactaatattaacaagaatgacccatccagaattatacagttgtaagttcattgaaatctaggtcagtcataagtattttggggctgcaaagtacaatatcagaacctattcccaaagagcatacagtctagttgaagtggcaaagactgtgcagcagcagcagggaaatgtacatcagaaaggagcaagattggctgtaagtgacaaaaaactcaaaatagtagtgacggtataaacttatttctctcatgtaaaaatctaagaaggtagatcacggcttgtatggcacatgtcagtgtcaggaacctaagctgcttttattcttaggttggtgcaaaagtaattgtggtttttgccattaaaagtaatggcaaatttaatgccattaaaagtaatggcaaaaataaaagtaat

SEQ ID NO: 128264 - DNA, 247 bp, Homo sapiens
caaaaggtcattaattaataggtcatgctccaagactctgtctccaaagtcaacctcctcagggctgaacaacctttagaagccccaaatagactctccattttctttcacagatctgaagatgacttgtctcatgtctggggcagtgttggatttctagcctagagcagtacctctcaactagtgttttagggagagggtcttttagaaactactgttcaccttttcccatagaggttctgttatt

SEQ ID NO: 128265 - DNA, 379 bp, Homo sapiens
cttttggggtctttgctgcacatctttctccctgaggtctttataaagaaggcattgcagaatacagagaatatcctcaacaatatttcagtaatcacaatgaaatgttttatgaggttatttttatactgaacttcaggataagcctagagtaacggttgggagaaaaaaaagaaaaaaaaaatttcggggacagagagaaaaaaagaaaggaaaaaaaaaaaccttaggagagagagacctacataatggggcccaggtccccagaacactgctgatttaagagcacatttaagagaatttctggaaaaaaaatatttttttaacaagtagttactatatagaagtttataagcaaagaccccaaaatgaaaagcaa

SEQ ID NO: 128266 - DNA, 304 bp, Homo sapiens
cacagggctgctcggggtctggggtgccggcccccacctcagcagggacaccctgctccaccggccctgctgtttccatgcggcctccaaagcctccggcctccggggtcacccttcgggaggcgtcagcctcttccaagacaaaccctctcccctgtgtcacctcctccccacccccaagttcaaggtcactcctgcttccaggttagtcctgggccagaagggccttgctcgaggctcggtgacatctgctcctcccgctggacccagagggacccttcatgctctgcccaccacagacccc

SEQ ID NO: 128267 - DNA, 272 bp, Homo sapiens
aagttatgcaaaatacatattctgaaaataaaagaacaagaaataattaagccaagtttattgttatctgaatgtcaaattaaaagaaaaccaataaactggtcatttgaattacatgtaaatcgtttgtaagcccacatttgaaatttctatttcgtcattcacatgagtgggtagttcctccctgactcttaaacctacccttattctccattctctgatagagaagaagaagttagtgaggaagaactggatcacgtggcatccatcag

SEQ ID NO: 128268 - DNA, 717 bp, Homo sapiens
ctgaggtcgggagtttgagagtagcctggccaacatggtgaaacccatctctactaaaaatacaaaacttagctggtgtggtggcacatgtctgtgatcccagctactcgggaggctgagggatgagaatcacatgaacccaggaggcagaggttgcagtgagccaagattgtgtcactgcactccagactgggcaacacagtgagactccatctcagaaataataataatgatgaatttgcctagcataaccagctcttcaaaagtttggtcaaaagccggtaaatgcttagtattgtgtagacgttccacagtgtccctctcactctctttactttcggctgcatatttccacttgttatcaccatctctgtggaaagctccattcaggatcagcaatcttcttgattcagaggaccattcatgatgttaaggatctgctagtgatgacaccagtcacacagaacaatcatgaggaggaagaatatggggaagtctttaccatttcctcctgggctactgttagcttcttacctggtctccctgctgccattgtagccacctgactcccaactgactgttgtaagagtgacctctctaaaccgacatgcccctctccatggttttatcatttctgattcctttattcactcctgatgtcactgtcttgctttaggtcttcagggtcttctacctagattgctatggtcatctcta

SEQ ID NO: 128269 - DNA, 294 bp, Homo sapiens
ggggctggggagttgggggagcaggaagaaggaattgaggggcagcaactggccagctccaattgggctacggccagtctcaatgtggccggctcctctcttgggacctcaccactggaatcacaggagaagccatcttcctgccacaaacgaggcttccaaccccactttctaacctcagtcctgaggccgccttcagcactgaccatcctggaacaggcagagatcctggcctgggtcaacggggccgaaaacccagccccgagccccgagccccgccccacagccctgcgc

SEQ ID NO: 128270 - DNA, 344 bp, Homo sapiens
taggagaatgctgccctggaatggggcagacgtggagatggggcctaagagaagtgaatggagggagagtttaagaagtgtacctgggccgggcgtggtggctcacgcctgcaatcccagcactttggaaggccgaggtgggcagatcacctgaggttgggagtttgagaccagcctgaccaacatggagaaaccctgtctctactgaaaatacaaaattagccgggtgcagtggcgcacgcctgtaatcccagctactcgcgaggctgaggcaggagaatcgtttaaacctgggagacggaggttgcggtgaccaagatcgcaccattgtactccagcctggg

SEQ ID NO: 128271 - DNA, 551 bp, Homo sapiens
cagaggctgcaggcagacccagctctaccctctgtgggaaagggaagaattgccctctggtcccagatagactaactcccctgggctgccacacagacggccattctgggagacagcagtttgacctgtttgctcagctgctgtcctttccaccctgagagacttagggcttcagatgtggggagttccccccatttgccttataacgatccctcataactgcacagcgtttttgtgggatttcgtgggcatgatctcatccgagccttccaacagcccttgggaggcaggcagggcaggtgtgggaggcgactcggccccaggcgcacatgggtaggtaatcagtgggaaagtgtccctagctgcttcccttccttccccaggataagtgactgtcaccaaaaggcccccccgagatcagcaagcttggcctgtggccttttgctttttcacacccacagaaggggtgaagctggggctctttgcaggcaacagcagccgcacccgcccgagtcctgagctccacgtcagcagggcaaggggacggatgg

SEQ ID NO: 128272 - DNA, 653 bp, Homo sapiens
gagctaatgttcacattatagcaattaaggaagtagaagagagaaggggtagaaagtatttttaaagaaataatgattgaaaacgtcacaaatctggggagagatagtcacatcggggtaaaggagagtcaaagttctccagtcattttcaaaccaaagaccacactacaacatattatagtcaaactgtcaaaaatcacagagagactattgaaaacagcaagagaaaatcttcacatacaagggaaccctcaggaagttatctgcacatttctaagcagaaacttagtaggccaggaaagtgtgggatgatatattcaaagtgctgaaaataagaaagaaacctgccaaccaaaaaaccaaacccagcaaaactgtccttcagaaagggagagagaagacttttccagacatacaaaatctgagaaagttcatcatcactagatctgccttacaagaaatggtaaagggaattcttcaggctgaaaagaaaaagaatgctaattaggaacatgaaaacatatgaaagtgtaaaactcactggtaatagtcaattcagaatactctaataatggtggtgtataaatcacttgtttttattataattaaaagacaaagctattaaaataatagctacaataatttgtcatagg

SEQ ID NO: 128273 - DNA, 195 bp, Homo sapiens
cgaaagatcttgggtggaccttcagaatccttgtgcataatgaaattgacaagaagaaacaaacgtttgttgtctttgtccacataacagacatgataaggaacaaaatccaacaggtatcctaaattcagaggaatataacacaatagtgatctattcaaaactcaacaccaaggaacacatttccttatcttt

SEQ ID NO: 128274 - DNA, 363 bp, Homo sapiens
gatcacagaatcgaaaagatgtgtatgtgtttgtgtgtgtgtgcatatatatacaacatagctataccccagtatctgcaaatctgcaagggattagctccaggatccaccatggataccagagtcacagatgctcaggttccttatataaaatggaatattatttgcatataacctacacacatcctcctgtatactttaagtcatctctagattatttataatacccaataaaactatgcaataaatacccaataaatgctatgcaaatagttgttagactatattgttttttatttattattttttaattgttgttttgttatgagggggttggattttttgctttatattttctttttt

SEQ ID NO: 128275 - DNA, 629 bp, Homo sapiens
ctttgacaactgaattatatctccactgtagcatattaaggttaggttaaatctaattaactataatacctatcattgaaaaatttcagagtacatatcacctaaagattaataaaagaagaagtatatatatgtattttcatattttccatattgtagtacagatgtattttatttttaaaagcactcagtacagagccataaattattttagcattttaggggacatttttaaatgtttttaaaattctaaagctttgttcattttattagcaaaatgtagtctcatcccagttttgataaacctggatagatccatgttgatattaaaatgaaagccacagtctaatcaataaagtgattcatcagttgtgtagaacaaagtagtacttttgctttaagaggctttttgttgttgtttatctcctttagcggatattttcagataatacataactttgcttttatgtttattctaagaataataagtcatcatgccacatttgtgggtgcttttaattttaataataaagtaattatgcaaagctaactatgtaaacattaatttctgacatgattgtttagatctattctttatgaggttacatagggcaaatttaattattgat

SEQ ID NO: 128276 - DNA, 158 bp, Homo sapiens
gctggtctcgaacggctcaagcagtacgctcgcctccacctcccaaagtgctgggattacaggcataagccactgaacccagcagactgggtaatttatgaaaaacagaaatttaatttctgacagttctggaggctgggaagtataataccaaggca

SEQ ID NO: 128277 - DNA, 278 bp, Homo sapiens
ggatcctccgcttccctctagctcaggcctgagcacttgacaactggaccatgcagaggacctcagtggatccacctgcccccatctcccacagccacgcccctgcccagggttgccaggcattcagctcaatatctctctgagcacagccctcccctgctcaggagccatccatggctcctcattgccttaaaacgaagacttcattcctgaacccacccttgaaagcacctcaaattttggccccttctcaccttgacgatcttcacttttcaact

SEQ ID NO: 128278 - DNA, 197 bp, Homo sapiens
ctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgt

SEQ ID NO: 128279 - DNA, 269 bp, Homo sapiens
tcttccttccctcctttcctctgccttgggcttcctccataaaaacagagaaggggacacaggctgaataggacactgggatggagaaagctgtggtttcctttacctttccaccgatggtctttttggagaggaggaggcagaagacttggagtccacagagtctctcctgaaagaagaaaattggcaatgagactgctttgtagactagcatcagtactgacaggaaggtggggagaaagcatcctgggaaaaggccagctggcttg

SEQ ID NO: 128280 - DNA, 306 bp, Homo sapiens
caaggagctcacctgatcacacactgtgcttacttcatcaggttgcctaatgctcaagggttaaaggtgatcattcctatggaggtaacatttcccttccagatctaagacagtggatacaattaaggtttgtaactcaagcttgtaaccactttttggtgcctgaaaccatccaagtagatagtttggtttataagacattctgttgaatctggaaaacgtggtggattaagaaaccctctctgcatcacaaagcctggagtgtttgctactaattgtgcaactttagttctggttccttctagt

SEQ ID NO: 128281 - DNA, 696 bp, Homo sapiens
aaggtaattttcacagatgggtatttctggtggctatatattctaccaaatgtgccagggacagaagctaaaagaaatggaaacttaagaaccagggaaaatgaactgatattaaagaaaaggctgtcactaaaggaatttcagtggaatttttatatggaagatagttaactggtgagaagaagaaattatgaatttcacagatgagagtaatcagaaggaataatgctctttaaaatgacatgaccaatatttttaagagaatacagaattaactaaattatatattgattcaaaattttggtagattgacccagttttaagtacataaccattttaaaatttactgaatgtcaataattttatagtagcagttttattacattacataaaatgtcatattgactcactatattgtatagcttacattttttgcaatatggcatgattatcacaaaatgacccaaggtaagttaagacatttgatgacaatgtactttcttaatatacatgtgaatgtgttaaaatgtgtttataatctacattattttgttctgtgcagcaacatatttcctcataatgaagatgtcatctgtgtcttttaaaaatagtatataaaataactacgttcccgataatttaatcagttaaacttaatatggctttagttttaattcttgatttccataactttgc

SEQ ID NO: 128282 - DNA, 349 bp, Homo sapiens
cacacagattaaaattttgctccttcctttagatgtataatattattactggatactgccatatgtggatggaaaaatatacctccaaatcaaaaggcagaattccctctgagcgggtttagagtagaggaatagaaacacttgggttttacaacaatgagaggaggcagaggcaagcagggggtttggatcagaaagaactgtgtctgagcaagtttttccttggagaaaatgaaaacattgttctaagaatatttcaagaaggaaaatgtgtgttattcaacatggaactgattcagcctgtgttgaacaaacaaacttccatggctgatgatccggacactgggtg

SEQ ID NO: 128283 - DNA, 410 bp, Homo sapiens
acttacatgggctttagcttttagatttcttactgtaaaaaggaaatgagataattaagcaaatcatcactccataaacaagtgaattaactgtatacatcccatgtcttcttatacaagattaggtacaagagttccattctcctaaaacattccatttctattcagtcaagcagaatagcctattttttttattaacttatcttctatattgctccatcattctcagatcttagactgggcagtttcttcaactgactggcttgcatttcaagttatgtgtctagcttttcacagtaattttctaaaggttgtctgattttggtgaaaatctatcacattatgtacaagaatgtctacatatgctttaagtttttttaaaaaaatgaaatttattatcttgaaacaaa

SEQ ID NO: 128284 - DNA, 263 bp, Homo sapiens
aagaggcaggcctatattagcaatgcatttttaaactcctagaggcttttctgagttggaaaaggccaattaatttacttctagaactcagaaacctgctgattctgttgcaacctacccaatctgtcttcactgacatgcttccactgttttgttttgacatttccaccaccgaacaagcacatattaggctggtttatgatgtcttgacacagctactgggcatggctcccactcctgactggcatggcctggggccggcc

SEQ ID NO: 128285 - DNA, 155 bp, Homo sapiens
atgaaagggaaatcagagtttttattttttcttagtatgatgtgtcatttcatttagcattattggtatctactaattaactacaaatggcctgtatttttaaatacagaaattctcagattttgagttgtaagctttctttataggttcaaagc

SEQ ID NO: 128286 - DNA, 498 bp, Homo sapiens
aagatgtgtcagtgcttgttaagtaggctctcagttccaggtaagagcagtcatacacctagatgccatcaatgtgccaggcattttgctctgcagccggggtacaaggataagggagagtcctcatgttgctcctgagtaaaggaggatggcaagtgacttcatagtgaaagagtgcagtgtgaggatgactgtgacaaaggtctaatacccaacctgggagaagggtgcagggttcttagtaaacaactggtgaaggggaaatattagtggctagcaagcaaaaagaattgggggtacatttggcaacagtttagagggaagggtatttacagtggagagacatcataatcaaaggctagaggtgagagcacagcatggctgggctagtggagtatgggggacgctggggatgaggctggaggtcacagcagggaggactctgagtgccttgcaaaggagaatagttttatcctgaccgctctgcacttcagtgat

SEQ ID NO: 128287 - DNA, 237 bp, Homo sapiens
cacccacccaagcagacacacatcttcagacccggcgattgtgcataggtttatatccaacaggtacgcattgcttatcttccctagcaatgttctgcctgcctacctaacccgtgcctaggtatctctccttttcctgagacatccttctttcaggattaagctaataagaccaggctagcttgagaaatttgcatgtgttcttgtgttttcatccccaaaacaacagtgtactgt

SEQ ID NO: 128288 - DNA, 447 bp, Homo sapiens
ccaattaccccttaaaggccccacctgtcaatattgccacactggggattaagttttaacataagttttggagggtacaaattttcaaaccatagcattctacccctggcctcccgaaactcatatccttctcgcatacaaatatattcatttcaaccccatagccctaaagtcttaacttgttctagcaccaactcaaaagtccgtctacttttttgtgaaatcaaaacaaggcatctacttccaagacacacggtgggagagacatagggtacacattcccattccaaaatggagaaataggctagaagaaaggagtaacaggccccaagcaagtccaaaacccaagagcagacattaagtaataagactccagattagccatgtgcagtggctcatgcctgtaatacaagcactttgggagatggagctgggcagattgcttga

SEQ ID NO: 128289 - DNA, 351 bp, Homo sapiens
tcctgagtagctggggttacaggcgcacaccaccacacctggctaatttttgtatttttagtaaagacagggtttcaccatgttggctaggctggtcttgaactcctgacctcaagtgatccacccgtcttggcctcccaaagcgctcagattacaggcgtgagctactgtgcccagccagttattgatgtttattaactaatgcaagacaggggataccaaaccgtaacaggaatgtgtgatttgttcctatgccaccagtctggaactctctgtacttatcctcaaggagagtgagatatgtggttggtacttgggggacagagtaaagaattgatacaatccctgtcc

SEQ ID NO: 128290 - DNA, 383 bp, Homo sapiens
tgggagtgggtgacccgcagagatctttgcaggctggccccttaagggaggcagggtcaagagagcagaacttaaattccagtccaggaactgagactgaggaggtggagcatctttggaggatggccgaccagcaggcctgggaatggcagggtgcttttccccacgtccccaccactcccaggactcctttctggtccccacagctgatggagagcctgggaacattttttccaggtctcttcctacagccagaccatcttccaggaaagagctaaggaagtggaagaatggtggggtcaaagtacagatgattccctcttttatggagggactgagagctcaataacaccaaatgaggaggttagaaatgtttaggaaaa

SEQ ID NO: 128291 - DNA, 394 bp, Homo sapiens
ggaggaggcagacatttacagtaaacagtgtaatcacacgtcatcaaaggaagggacacacaaagggctgggtggggagcatctcctcctctttgggagaaactgacctggagacctaaggttgagctgaattttggagaatcagtcagagttggtcaagaggacaaactgggatgggtcaaggaaaatggagaagcttgagagctgtggcagctccgtgaaatggcaagtatggccagaggatggcatctccagggtgccggagatggccatggagaggcaccgaggccaggccatgccgggcctctgctgcctctgctgtcaccaaggtcaaccacaacctagtgcccaagccagtggcattttccagcctacttttactcatcccttcttt

SEQ ID NO: 128292 - DNA, 851 bp, Homo sapiens
caaataatgcttcaatgctgtttcttctttaaaaacaaagaattcagatatacacatggcaaaaagatcagagaaaaagtatcaattttggtcctcccaacttttgacagtgtttttattaaattccatttagtaagtgactatggcaaaggaagtttattctctactttttccttcaaagtagtagtgctatcatctacttacttccttaccattcattacaggctctaatctatcacaatgctagcaaaaaactagacacaaccatatgtccatcaatagggaaccggttgtataaatatggtacatccataatagtggaatatgtagccattaaaaagaattgagggagatctagatgaactgccctggaaaatggttcatgacatacgtgaaaaaagcaaattagtcaccagtatgtgtaacttttgtttttgttactaagcaaaaattgaaattatatgcatatgtatatagagatgtccatttaatcaatcaagtcaggaaggatacaaacaggctgtaagcagatgtggggaactttcacttctgacattatacaaaaaagtttaatagagattaaagatgactttttacctatttaatctttcaaattaaaaaaaaattcccactgcaacttctaggttctactacccaggcttctaagtaaaacttaagtgaattccgttaacagctatcacatacatgtacacatgctgctaaaaacctcgtataaagaatccaaaaacgttgcctcagattcaaatatttatcacaaatttcatgaataactctttgcaatttaagaaatagagagtgcctcgtgccgaatcctgcagcccgggggatcc

SEQ ID NO: 128293 - DNA, 662 bp, Homo sapiens
aaacacagagaaaaattgagaaaatttaaaaatagcctagtgagaagatattgataaacttgtaaccagaccaatttaagaaaaaaagtcaaaacacaaataccaatatttgaaaatgtaggagggcaaatcattacagattctatgaatactaaaatgataataaggaaaaattatttaaaaggggcatgtcagccaggcatggtggcttacccctgtaatcccagcactttggcaggccgaggtgggaggattgctagagctcaggcattcgagaccagcctgggcaacatgttgaaaccttgtctacacaaaaagtacaaaaattagctgggtgtggtgttgcacacttgtagtcccagtcacttgggaggctgaggcgagaggatcacttgagcccaggaggttgaggctgcagtgagccatgtttgtaccactgccctccagcctgggtgacaaagtaagaccctatgtaaaaaaaaaaaatgtatgccaacatttttcaataacttaaatgaaatggaaaaattccttgaaagacacgaactacaaaaactcagtgaacaagtaaataacctgaatagccctgtatcaagtaaattgaatttgtagttaaaagccttccaacagagaaaacttcaggtacctatagcttcatatga

SEQ ID NO: 128294 - DNA, 264 bp, Homo sapiens
ttccacagcaggtcttaggttagtcaaatagagtttactataattcaagtgcccccccaaaaaatactttagcaagagctacttatataaaaaatggtattgcccatgcaagtccaatgaaacaagtttcctgtttgaaatatcaaatttaattaccaaaatctccatttttttcctctgaacactaaaaggtttcatgtaatgaggttcaatttaaagaactctcttcactacatgatttcatctcacttaaaaaccatagcg

SEQ ID NO: 128295 - DNA, 441 bp, Homo sapiens
tcttaaagcatcacctaatgaggaaaggcttcccgacctccccaatcagatcaatactccctcttttatgctttctttgtgctatcatttataatacctgtgaagcattcactgctgtaatctgatgtttacttgtatgattatttaactaatacttgattttttaaaagatatgtcacagggtgatgctgactgacagtaagagacaaaggacgcaagttcctttaatgaaatttaacttagtaagagtttaaccaaggtcaggcatagtggctcacacctgtaatcccagcactttgggaggccaaggcaggtggatcacttgaggccaggagtgtgagaccagcctgaccaacacagcgaaaccccatctctactaaaagtgcaaaaattacccaggtgtagtggtaaatgcctgtaatcccagttactcaggaggca

SEQ ID NO: 128296 - DNA, 312 bp, Homo sapiens
ggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcag

SEQ ID NO: 128297 - DNA, 552 bp, Homo sapiens
gaccaaggcccgtactttccacagggatagagagaactgtgcaaataaacaccattggtcctctcggtggctaagatttgacaaccaaaattgccaaaccggtagttaagttagacctttatgatgggattttaatgtctggttaaaccccactcattcagttgtaattataaaggggaggtcagtctcaatgagagaaaatgttcaatgaagcgtagcatactcctggtatcagcagatgctaaaacagctaaacagaggcacgtggaagacgaaaggctctgtgcaggaaaggactccgccattcactcagccactgcagatggatacacggctgcttctgagagtggcatgcccaatcctgaacactgaaagtgtttgttccagccgggcgaggtggctcacgcctgtaatcccagccctgtttaaatatctagaaaagtatgtaccaaactctgaacagtggctactctggggaggagagaaagggaatgtcactgctggccataggagactttatcttttttttttttttttttttgagatggagtc

SEQ ID NO: 128298 - DNA, 726 bp, Homo sapiens
tgcaaataggataaatttcacgatccttttctaaagcgtgtctccaaatgttagtaggcagttctaaaaataattggtttcacttatggctttaaaagaaaatcctcaaaaaggaataacttatttcaggaatgtaatgtgggctctttaaaataagtaacacaccaatgttagtttctagtattgacaccacaagttttaagtggatcccaagatgtaattgctcttactgcttgtgcttaagttgttcgagccattgtctaaacacctatcattgtctaaatggcaattattttgccattgtaaaaaaacactatcagcttggccttatagtggggtcctaggatatctggaaagcatccaattgaattaatatagtgctgaaggaaagcctggatgcactttttgctgttgtctggtgtcttcagtcaaatcagatatctggaaagcatccaattgaattaatatagtgctgaaggaaagcctggatgcactttttgctgttgtctggtgtcttcagtcaaatcatcatgctttttattaacaaacaacttctttaaaaatgtatactatttctgattactgtttcagagttaaaggggaacagtacagcttgaggttgcacatcagggtagggtagttatgacattctttattatgttattttattttaaactaagttaacacattggtgcgtgtcctgaaactgacaactttgtcactttt

SEQ ID NO: 128299 - DNA, 334 bp, Homo sapiens
gtggcagtgagctgagatcgtcccactgcactccagcctgggcaacaaagtgagactccatctcaaaataaataaataaataaataaaaataaatacaccaatatgacctgtgtctgaagatcagttttgtatttttcctaaaagcctcactgttaaagctcccagggctgggcgtggtggctcacccctgtaatcccagcactttgggaggccgaggtgggtggatcatctgaggtcgggagtttgagaccagactgaccaacatggagaaaccccatctctaataaaaatgtaaaattagccgggagtggtggcgcgtgcctgtcatcccag

SEQ ID NO: 128300 - DNA, 276 bp, Homo sapiens
gactcccttactgctgatcatgtattagctgctgacagatgaaaattatatttacggctgattgtaaggtcagatttttgaccataaactttgaggaagagtaaggttctaaacatctgtacttcataaagtataaaatgtttggtacacagcctggccaacatggtgaaaccctgtctctactaaaaatataaaaaattagctgggtgtggtggcggatgcctataattccagctactcgggagggggaggtgggagaatcacttgaacccgaga

SEQ ID NO: 128301 - DNA, 516 bp, Homo sapiens
ttcttttccacagggtggtcaaagataccctgactccaatatttaggtacctggctattactttgtgtttcattaaaaaaattgtcatttttttgctgagtgcagtggatcccttgaggctgggagttccaggccagtctggtcaacaaagtgagaccccgtgtctatgaaaaataaaaagaaataaaaataaaaattgtcgtccttcatgctcactgagaccttttgactctggtaaaacttctcagtgagttgttaaatcagggcttctcgaactttaatgcacataccaaactcctggggaccctgttaaaatgaagattatgattcaatggatttgaaaatgggccaaactaatgtatttctaacaagctccccgatgatgccagtactgctggtccatggatcatactttgcttagtgaggatgccctgcagaagctggagggaccactggaagaactggtcaggcatccatcaagatgacctcactgactttccctgtggatatcaaata

SEQ ID NO: 128302 - DNA, 494 bp, Homo sapiens
ccaactcctccatactccacactagacaacccaggatccccaaaggacagaacagactacaggagaagcaaagacagtgctgggtatcaagttctcagaataggaatttaattttggaataagactatactaaaaatttctagtgtatagcttacttactcaattcttagaatgctaaagtgacatttttatttaattatatggcaaaggctttctcagaagcataattttagggacaaactccctgcttccatgtgaacagatggtgtctgccttccctaagtacttggtaaagcaggagtcatcagacatgctaatattggtccgagctgtgctactaaacagttacactgatcatggccagtcacagcaaaaccagccctcagctcctcaacttcaaaatgacttctgacggcccttctcattaacctggatgtttagagcttgctgactggtctaggtgaactgacagtgcccacaaatggcaagctaca

SEQ ID NO: 128303 - DNA, 350 bp, Homo sapiens
aggaaggcctctcaggaggggacatttgagctgatgccaaaaaagggggaaaaggagccagctgtgaagacttcgcagcggagatgaagagctggccccagcaacactaaggtcccaagcccagcaagacccagacttatttcaggaacagaaaaaggaggtccttgctgctggggcacaaggagtggtcggagctgagatgaagctggagacgaggtggacggggccttggcaggcagtgtgctggggaatttgcggtctcttctagattggagggggtttgggttgtttgttttgttttagcaaaagatgggatcttgctgtgttgcccaggctggtctcggaactcc

SEQ ID NO: 128304 - DNA, 364 bp, Homo sapiens
gctgctgggaggctgtccagatgagcccgatagaggctgatgtgggaatcgcatagacaaggggatgagactagacttgggttcaatcccagctccagcatcagaagctggaagagtgggggctactcctttgtaaaacgcagttggtgacaccgatctcccagggttgtttcgataatgaaaagaagcagtaagtattcagcaaatggtagctgctattatcctcaattctccccaagttctgccttgcaaacaggaagggcttctaggggagcctctggcctggcctgagggcaccttggagactgccccactccaaccagtccgtaggaattggcgaacagcccaggcctgcagggctcct

SEQ ID NO: 128305 - DNA, 400 bp, Homo sapiens
acatttttttctgtagcttaccttattttaagaatgcagtatgtaacatacaacatggatgtcgatgtgtttttaatcaaatgtttatgttataggtaaggcttatagtcaacatattgaagagacatctgcacccccatatttactgcagtactattcacaatagccaagatagggagtcaacccaggtgtccaacaacagatgaattggtaaagaaaatgtggtatatatacacaataaaatactactcagccataaaaaggacaaaatcctgtcatttgcaataacatggatggaatggaggacattgtgctaagtgaaataaaccagataacttgaacagaaagttaaacaccgcatattctcactcagacttaacccttactgtctctcttccat

SEQ ID NO: 128306 - DNA, 792 bp, Homo sapiens
acttaatctatatccatatattgtactccaccaatatttatcagtggacaataaagaagttttgaatgcatgaatgcaacttaagaggcaccacacttggttattttgcaatgccagaataacggtgggtattcacaaattgaatagataatccagattatgtttcctccaatttaagtttttctgggtttttttttcccccttcctagaatcaattttatcattttacctatgtacaataatatacttctggaaaatgctagaattttcaccatgtaacagaatttgagcatgacagtaatgtaaaaatattcagaagtctcgaactataggtttgagttttcaaagtaaatcaaaatacagctgttttcattttactagattgtggaaacctatggatgttattgtaaaatgcatatgcattacactgactttcttaaaatgttttgaattaataaagaattcaacaatgtatccttagaaagttactgtttcctcattggtatataacactataggaataaaaggtacacttctatgtgttacttaaattgcttatgcacttgggggaaaataaaattctggctagattctttacattgttctataaggttttaattattaaaatgtttcaccttttataaataataaaatatattgttgaaatgacttatgttctgagaactcaactgagagatataccatgttgagttcaagtgattctcaccatttccatggttaagataaattcaaagttaagttcagacttgggaaacaattgttctaatagag

SEQ ID NO: 128307 - DNA, 143 bp, Homo sapiens
agagggggctttgggtgttgctagaagtgtaggatctggacctatccttaactcagagcactctccctgggcctcctgtgtagctcccctcacaaggctgtcacagctggggtgctatcccactgtgtagtaagtaccaatgt

SEQ ID NO: 128308 - DNA, 774 bp, Homo sapiens
gtaggaagagtcaaggatgacacgcaagttttctgcctgagtttctgtgaagggcgccatgaactgaggtgctaagcctgcaggaggagcaagtttgaaccgggggtggagtttgagacttttctttcagacatatgactgattcgacttctaagaagtcacatctggcaccatctctgcagagactgttgtctgcatgcaggagtgctggctctgatctggccacatcctgcctttttcattcaaccttgtaacagactttcatgtgattagtaaaacgaatgggctttaagtcacatatccttagtgcttggaaacagtatctctctctttttttgtttttttgagacggagtctcgctctgttgcccaggctggagtgcagtggcgcggtcttagctcactgcaagctccgccttccgggttcacgccattctcctgcctcagcctcccaagtagctgggactacaggcgcccaccaccatgcccggctaattttttgtatttttagtagagacagggtttcaccatgttagccaggatggtcttgatctcctgacctcgtgatccacctacctcggcctcccaaagtggggtgaggggggtgtggagagccccgggacccggccgaaaagtttttttaataattaaaaaaagcggggatcggggtaagctgaaaccagatttgggagtaaggggaatcaccggaggagttagaaagctggaatgtgaaccctttgtaataaaaaaaaaaaatttggggcaaataaaaatg

SEQ ID NO: 128309 - DNA, 502 bp, Homo sapiens
gattgacttctcttttctaactgaataccctttatttctttctcttgcctgattatcctggccagaacttccaacactctgttgaataggagtggtgagagagggtatccttgtcttgtgctggttttccatgggaatgcttccagtttttgcccattcagtgtgatattcgctgtgggtttgtcgtaaatagctcttattattttgagatacatactgtcaatttttgtttagacttatttctttgtggataagaccttgctgctgcggtctgtgaaccagacatttataataaatcagaaagcagctaccttcacatatatccaattattgagttctctcaaagagggatttttttctagtattttaaagctttgtttttcatagatcttatcttgttttctttcagaggtttcattccattcccctattgttaaattcttccagattgctatttttgaaatctgcctcagaagaaagctattatggagtctcatatttg

SEQ ID NO: 128310 - DNA, 578 bp, Homo sapiens
gttggctgatgacaacattcagctccacaggcaactttttttttaattttccataggaaaagaagaggggatgctatttctcagtgctcccattgggtcatgacaattaacagtcacagccgtggccatttattgataccatggataccagctactagtcagttattttgggtttttttcctttaaaaatacctgtctaataagaactcatacaggtgaccactataataaaaattcttccatttctttttagattcactatcattggaagtgctctatctttccctcatcctaagaagtgggaattagctagacttctataacaggtgaaagagaggtttgctttgacttagggaaagaaagagaaggtgagagccctaaggccgaatgctgggggcatgtttatttaaagaaaagagatgtctgctctcccgccttgcagccaggaactccaacgagccctgacccagtctaacttgaggggagggttagcaccctaaagaatatcttcacccaagggccaacagagaaatcaccctccgagtgtccaatcactgactgtctccaggcaactattg

SEQ ID NO: 128311 - DNA, 471 bp, Homo sapiens
cgagcagtggggggcacgccagataatcccagacactgatgggaggcacaggagatggatcaccttaggtcaggagttcgagaccagcctggccaacatgacaaaaccccatctctactaaaaatacacaaattagctgggcgtggtggtgcatgcctataatcccagctactcgggaggctgaggcaggagaatctcttgaacccaggaggtggaggttgcagtgagcctagatcgcgccactgcactccagcctgggcaacagagtgagactgcatctaataaaaacaacaacaaaaaaaaacttcaaactatagaatgattagctaaaaactgagtatggtagaaaaggagccaaaatcagaacaaactacaaagaaatgctttatgtttctttaaaagtaagaatggtaccatttttgaaaggtttaggtctctgcttctgtctattcacatgtctttttctttagg

SEQ ID NO: 128312 - DNA, 590 bp, Homo sapiens
tatttgttactctataaatggaaactaagatttttataggggatatatttaaaaggattttattattaactcacttaattttgtgagtgtcaaacaccaacttacgccagttaaaaaattaaggatgctttctcagagttatatgcttatctttctccttccccagatcattccgttgcctcttaagaagttttactttctcagtaaatgaggcctatcctccagaactctggaaatcactgttgtgtgactatttactgctatattagctaaacagaaactcaggaaggtgtaaaagagtagggatggttcagcactttgggaggccgaggcgggcagatcacaaggtcaagagattgagaccatcctggccaacgtggtgaaaccccgtctctactgaaaatacaaaaattagctgggcatggtggcgcacacctgtaatcccagctattcgggaggctgaggcaggagaactgcttgaacctgggaggcagtgagctgagaactagttgcagtgagccgagattgtgccactgcactccagcctggcgacagagcgagactctgtctcaaaaaaaaaaaaaaaaaat

SEQ ID NO: 128313 - DNA, 309 bp, Homo sapiens
ttcatatctgtacctctgcacaagcagctatctcttcctagaacattatccccatttacctgcacctggctaattcctattcatccttcaaaactacacgtgtaccacttcctccataaaatcttcttgtaccacaaacctcattacaggttcatgcctctaatcccagcactttgggaggccaagatgggcagatcacttgaggccaggagttcgagacacgcctggccaacatggtgaaaccccatctctactaaaaatacaaaaattagctaggcttggtggcacacgcctgtaatcccagctact

SEQ ID NO: 128314 - DNA, 694 bp, Homo sapiens
catttgtgggtacatacaataaactgttcttttctctttgagttttataaatcatgtttgatgattaaaacaaaaattataataccatctgatactcaattcaatgttattgaaaaatgggaaggacaagagatttaaatgggagtgaagtttcaaactagttaaatgttgataatgtagcctgtaacaagtcacatattaggttttagtactcagggaaaccacagtgaaaactatacaaagaagtacttcccaaaacactgtatatcaaaatgaaatcctaaaaaatgtttaggttacacacaggaaggcaagaaaagagaaacagaggaatgagaaccagaggaatcaaatagaaaacaagtaatgaaatggtatagtgaaatgctaacttatcaatagttaccttgaaggtaaatcatctaaacaccatcaaaagacagagataaacaaagtgcataatagaacataatctaactgtatgctgcctacaagaaactcacttcaaattctatgattagttaagttgaaagtaaaagggtggaaaaacatatatcatacaaatattaattttaaaaaaaacaggagtgcttatactagtatctgataaaagtggactttggaacaaagaaaatatctggaaacaagaaggaacattatataatgataaaagaatggatccacctggaagaca

SEQ ID NO: 128315 - DNA, 576 bp, Homo sapiens
aggagagaatgggatgatatatttaaaatactagaagaaaaaaagctgctagcctagaatactataccagcaaatctttgcttcagaaatgaaggagaaatagtctttcccagatcagcaaaagttgagggaactcattaccactggaccagacttacaagaaatgcttgagtatttctattggaaaaaaaagttttcatgataattgctaccataaaaaaacatgaagtataaatctcactgctggagataaatgcattatccaaattcataatgcttcattactgcaatggtgatatgtaatgtttcaaacctctagtatgaaggttaaaggccaaaacagctgggtgctgtggcatgtgcttgtagtcccagttatttaggaggctgaaatggaaggctcatttgagcccaggggtttgagtccaacctgggcaacataatgagaccccatttaaaaaataataataattaaaaaaatgcagctctgtgggatgccaaaaagtgaaaattgtaataatgattatagcaatgataagttgttaaggaataaacaatatataaagatgtatatta

SEQ ID NO: 128316 - DNA, 744 bp, Homo sapiens
caaagtgataagagttgagataagtcacaaatataacctcacaggagttcatattagtgtagcaaaagtgtgggtattattaagtaggttcttccgtacaccctactttttgttcaaggacatttctgtgggttctgatcaatggtatttagtggtatttaatatttgtatgccccacaaccgccctctagtaccctacatatttattactataaactaacctttgatctctgatactgttgaatagtttagttatatattcaaactgtgtggcaagacttgcagtggagaatataggaaatggggtttggcctgaggagaagggcgtaggaaaggcttggtgctgtgccttgttctttagattttacatccctttaattgctttcctcctatgaccattgctttgccatgactgtctaaaactgtggtatgatgtatgagttatgaggtgttcatttcagatgttatgcactgagctctaattaacttgacagaagccagattgatttttatgcagagacttttagtatagtagatttggagctagaagacctaggcttgaaccttggctgtttctcttattatttgtgtcacaaaatgtaggttttcttaatctgttttcttattagtaaagagggaatagtcattactgttgtaggttgttgtgaggttgttgcaataaggcttaaatgagatgccaagaaagcattttataaaattctaaagagctatttaaatgtccag

SEQ ID NO: 128317 - DNA, 352 bp, Homo sapiens
tcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaacct

SEQ ID NO: 128318 - DNA, 773 bp, Homo sapiens
ctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctatacattgcttaagttaaacaaaggg

SEQ ID NO: 128319 - DNA, 352 bp, Homo sapiens
ttcacaagccaagctggaggcctagttaagacgacggctcagaggtgcctgagaagagcttagtcagggagaatcttggcccagctgcactgtctactccatgattgcaccatgcctttcatgatggcaccatcttctccatgagctgcaccatcatctccatgactgcactatgccttccatgatggcattatcttctccatgagctactccgtcatctccatgactgccccatgctttccatgatggcaccatcctctctgtgagctgcaccatctcctccatgagctgcactgtctctttcatgaactgtcttggtgagatcctagacaaggcatgatcatcactcagt

SEQ ID NO: 128320 - DNA, 160 bp, Homo sapiens
tcctagaattggaatgtccccattgtgctcccagggataatatcactttataaaatctaatatcagcacttaagatatttttcagacgctgcactcaatggatcagctgacaccacccaaaccagtaatctaacccaaccagttctgccatcacacccag

SEQ ID NO: 128321 - DNA, 336 bp, Homo sapiens
gctggggctcatcggcaggagaatagaggcctcctatccatgacagatgtggaagtagaattctgatgagtttttgttttgtttcatcttaataacgagaaactgtggggctagaaagctagagaaatatgttttatcttgtatcagtaccaactaaaagaaagccaattctgggggtggtgggagggtgtcaccagtggagaaaagggctaatttaggctaattctaggataatactcccagtagggtgttaagacaatactgcaggcccatgtctgatgatccagtcagaaagggagctcagaccaggatgcttggttgccagtaatagagact

SEQ ID NO: 128322 - DNA, 536 bp, Homo sapiens
ctgggtccagagcccaagcatattagtctgttctcacactgttataaagaaatacctgagactaggcaatttataaagaaaagggatttaattggctcacagttctgcagactgtacaggaagcatggtgccagcatctgcttggcttctggagagtcctcaggaagcctacagacatggtggaaggcaaagggcaagcagacacctcacatggccagagcaggaggaagaaggagggggaaatgccatacactgttaaacaaccagacctcatgagaactcactcactatacagtaccaaatgctaaaccatgagaaaccagccctgtgatccaatcaccacccaccaggccccacctccaatattggggattacaattgagcatgagatttgggtggggacatagatccaaaccatatcaccaagtcctctggatttccttccaatgttcctattctgtggccagagtaaatggctcaagtgaaaattcaactaggctctaatccaaggaccttgggttggtcacttacctacc

SEQ ID NO: 128323 - DNA, 128 bp, Homo sapiens
gctactacaatacggatttttaatttcacctttctgcgtctagtaatttttgcatattttagtaactgtggcattctattacatacaacagatggttacaggcattgtcttcatagagagcaaaataa

SEQ ID NO: 128324 - DNA, 321 bp, Homo sapiens
caacaaaaaggatataacaaattggtaatgcttgcttcttgggagggaatggctagaagataatgaaaggaaggaatacttttcaatgtatatactgttttgtacctcttgaattttgtaccaagtgttcatattatctaatcaaatagaattaatatatcaaatatatatgcaaacaaactaaaatctcactgtaactataccaacctttctactgataccttttaaatgatagcacagcaggttgccatcatttaggtagggtatgtggctaatctatttgtgacaaaagcagaaattcactatcctagctgcccaaca

SEQ ID NO: 128325 - DNA, 280 bp, Homo sapiens
gtatgacatgagttgcttgagattggaggatctggctctgggggggctccgtcagtcctgagcatgcagagggattgggtagctccacatatcagtaagacacacgcagcctgtgccgcagccaacaggttgcgtggctccaatagagcttgtccaacaagtatcttctaatattgataaaaatgatcgataacatgttttgatcatataattttgtttgataatcttgctagtgtgtattgataatgacatagctagcattttaattagttttatttac

SEQ ID NO: 128326 - DNA, 336 bp, Homo sapiens
gcgccacctgccccacgcctgcctagggcacacgaagcaagttggcgttcggcagccctgaagcggtaccccagcgcgagcagatttctaaaacaaacacaacagagatttttatcaaaggcaaagctgcaaaacccactggggctgagcgctgagctggtccggacacctgggtccggttcctggaccaggacagtcaacctctgcattctgaccttgggcaagtctctgtctttccctccgcctcagtttccctgcccagagcagggcaacagtgggaagcccgattgttcctgaaatacttccaccaaatgcttcactcctgggaattcccgt

SEQ ID NO: 128327 - DNA, 658 bp, Homo sapiens
agttcgagaccagcttagccaacatgattaaaccccgtctccactaaaaatacaaaaattagatgggtatggtggtgggcacctgtggtgccagctacttgggaggctgaggcaccagaattgcttgaacccgggaggcagaagttgcagtgagccgagattgtgccactgcactcctgcctgggcaatagagagagactccatctcaaaaaaataataacaataaaaaataaaaatttaaaaaatacagtaaatggaaaggtcttttttattgcttccgttttccaaataaaactgaagctcaggaagatttagatactttcccaagtttatactgttggctacacagccttacaacttggggcattatattgcagactgctatacaatgtttaacacttgttctcatagttattcttgattctccagctagttttaagttgcttagagcaaaaacaatgtttttcatatctttatcctctctacatttggaacacaattaatggatttgagtatatcaaaatgaaatgaaagattcctgttcaactgagggcaccatagacaaaatgatagaaggagatataaatgtctaaaactgacatgtaactcataacacacacacatacacacaccctgcaaatcaatcagaaaaagaaaa

SEQ ID NO: 128328 - DNA, 234 bp, Homo sapiens
cttgtcttgttggaggcagcagaggaggcccacacaggaaactcaagcaaattttcagtttctcaggtaacttcctagtgacctagatgagtcaatagatgtctttgtgtctcatttgagttctgcaaaatgggctaataatattctagacaagcttgcatctaaattaccaagttcctgttggaagtctttacatgcatcagaaagaggtaccataaaacacatcacaaatct

SEQ ID NO: 128329 - DNA, 661 bp, Homo sapiens
gtagccccatactggacgctgcccaagtgtgcatacctagagggacagatgagaggaccgtggtgcagtcacaggatggaacacagcacggtgatgagtaatgcactgtgcacagtgacatcagtgactgtcatgtcattacattacatggagcgaaggaagccaggcacaaggggagacacactgtgtgatgctgtttccatgaagtccaggaacaggcaacgctaattgtcttagctccctattgctgccataacagaggacgacaatctcagtggcttaagcaacagaagagaattctcttactgaaagccacctgtctaaaatgcagcagcaggtcctgcttttcctgcaggttacagggggaagtctgtttcctcatcttttcagcttttaggagctgccttgccccactccgacctctccatcgtcaagtgtcctctcactaggactgtcccctgcctctctcttataagggtccctgagattacacttcatgctcacccaggcaacccaggatcatctctgcatctcgaactccttaacttcatcatacctgcaaagtctgtaaaagctctggaggttagggcgtgggcatctcaggggagccattgtcttcctgccccaggaacagatggtgatgcggtttaacttggggggt

SEQ ID NO: 128330 - DNA, 316 bp, Homo sapiens
ccaaatacatttagatagattcttccaaatacagaggaaaaatataaaaagaaaaaatacataatacgaaggatcaatccaagaggtccatttccttgattttcagttcttttcactttcttttttcagtggttttttccccacagtttctagtcatctagttatttttaatggatgcattgttctcatgacatgaatttctttgaggataacacttataacttttaaatatttatgtcccattcccggaaatagctctgcttctttcaggtcagttgtttattttcatcctttctgtctgttgtgcttttacttc

SEQ ID NO: 128331 - DNA, 454 bp, Homo sapiens
aaggtgctaggaacatatcactattgtgtcatcaagcagaaatctgtgactgagtatgagatctcatatagtcggattgcctatgttctatgacttagcaaagtgacgctctatttgcaaccgtttatgattgacaccacccggagaggttaaggatgacagcaacaacaaaggcccaaggaaagatacaatctgaagaatatggtagacaatgaatccttaaatctctatcaatggttctgtaattttatctaaatttggaaatatttgttaagagctgataaaatttcatggtacatttttggtatatgattagatgcagtgcttatacgcatccaatgtttacgtatagatgcctgattgaagaacatcttcggaggactattgtcattttgcaaggcaattttaatggtgttgaattaatcagagctagattttcactgttgtatcagaa

SEQ ID NO: 128332 - DNA, 341 bp, Homo sapiens
gacctcccctgctccagcttatcaggagtagataacataacaaacataacaaaatggagaagaaaatggctctgtaaggctttagtaggcttcatggggctcccttttctgttctagtaagtactcatgtctttgtactttaaataaatgtggaaagacaagtgagccaaacattagtaatcctattaaaaaatagggttattgcaagactatgcaatcatgtttatttttatcttccctcttaccccatttcttaaccaagaccttattaggtgtgccctttcattagccaacttcgtgacagtctcagcctatcatctgaaaacatgctcttaacgtat

SEQ ID NO: 128333 - DNA, 399 bp, Homo sapiens
ctgagggcgctctagagtatacactctccctactgtatactaacaacccaaatccaactacagatataacggttatacaccatgactagttaagctatttgccaggcatgcaaggttaaaccgttcaacatccgaaactcaaacaatgtaagacaacatatgaaaagaataaaggacaaaaaccacatgatcaccttaacagatgcagaaagaacatttggtaatcttcaccacctttcctgattgaaaaaaaaaaaaaattcaataaactagggaacatcctcaacctgattaatggtatctacaaaaaaaaaaaacaaaaaaaaaaaaacccagagctaacatcacacttaatggtaaaagactgaaatcttccccctccctacctcagatcacaaa

SEQ ID NO: 128334 - DNA, 166 bp, Homo sapiens
gaccacaggcagagccatcccccaggacctcatgcccttttacctccttgaatcccccatctccaaacaaccactcacctgtctgctgtcactatagatgagcttgaatgttctagagtttacataaatgaaacaatagagtatgtgctccttttttgatctggtt

SEQ ID NO: 128335 - DNA, 376 bp, Homo sapiens
tgagtagctgggattacaggcacccaccaccacgcccagctgttttttgtatttttagtagagacggggtttcaccatgttggccagcctggtctcgaactcctggcctctggtgatccacccgcctctgcttcccaaagtgctgggattacaggcgcgagccactgtgcacggccatgaatggtttttaggggattcaatgggcttggacagcatctgttagccctggtgaccacctgcccaagtgtgttggcagacacaggtctttcttcctacgatgacctcagtgcatggaaactcagggaggggactggccgtcactgttcctttctccagcagctatgggctttaggcagattcgggggcttcagggagc

SEQ ID NO: 128336 - DNA, 384 bp, Homo sapiens
aaggtaccatatttctcttaggtcaatatgcattttaaaattctttaaaatgtaaaacttacaatattacacaaagtgtgtaaaagaaggagaaagacctattatcttaccttacagtgtcacttcaatgtttcacttttggtagtttttttccatttatgttacaacaattattgtcttcctttttaattacaaagtaatgcacgctcaatgcagaaaatatggaagcacagaaacagacaaaaattatccttagtctcactccacaaggataatataccaggtactgctcttaggcatcgaatggtcaacccaatactggtcaagcttcaaggcaggaggggacggagtatcagtgactctggattactctgccttagcaaa

SEQ ID NO: 128337 - DNA, 442 bp, Homo sapiens
ccatcctcctttactgctaggccttgtcagcctccttgactgattcctctccatttctataccacaaagtgttgcagtctttagggaagactccttggacttctaatttttaaaccatcttacttcagtctcatggctttaaatgctatctgtacactaatgactctcaaatgtaaagtctgatgttaagtcagacattctccacttggatatttaagacattttaaacttagtatatccgaaatcattctcctcatgtctgttattcacaacaaataaacagctgctcctttcctcagtcattaaatggcaatttggcagtttaggccagaaaccttgaagtcatttgcacagcttgggttctctggaaagcagagtgagataaagattagcaagctatacttttattaaagagtgctcttagcataaacaactccagaaa

SEQ ID NO: 128338 - DNA, 535 bp, Homo sapiens
acaggggggaatagagatcatgaggaaaggtatacaaaatatactggttccaccttcatattatttataacgaattaataaaaatattatcaaacaacttaaccatataacacagtacatatgaggtacatgagtatatagagtttggttacatagagaagtaagtgtggtttggatttaattatatgcaaaatttcaagtgaaaaagatgtgaagtcattttgaaaagaaaggaaataaggttaattttcaaaaaggtaaaaattttgaaatcagaattggttattgagttttatttggattgatatgtaaaaatggaagagcacaggtgagtgcaaacagaacatctttaatgtgacacagaagacaagagaagtaaatacaattccaatatgtaaaacagatgcctgtgactgggaggtggaaggaaaaggaaagtggactctcttgcatctgggcttttccaaggtaaataagcccatcgtggaaacacagaaacgtcatcacatgtacaacaatccctgtgaaatgagta

SEQ ID NO: 128339 - DNA, 391 bp, Homo sapiens
ttataaaactcagatttcccctatatgcagaaggcctctcctatttcattttagagtctaattaaattgggccacaacctatttttattgaaagagttgtttttactcactgtgtccattcattgatctactcctcacctcctccaaggagaaatgaaggcaatatgtaacccatggggctgctatttggattaaaggagatgtaagtctcagtaggtcacagaattcttattgaattcatttgtttagtaaaaatttattgagcaactgtacgtggaaggtgctatgccagatgctctaacttaactagataaaatttagcctcttccttcctgcctcttccagtccaatgggacaaagaaggagaacaaaacacacataattaagaagc

SEQ ID NO: 128340 - DNA, 372 bp, Homo sapiens
ttagaggctgcagtgagctaggatcgcgccactgcactccagcctgcctgacagagttagaccccatctcctaaaacacacaaacacgctttagataacagtaactcatttagttccttgcaaatggacgccaaatgggtgaggaaactgaggcattaagagaataagaaacttttccaaggtcccacagctggagtgtggcagaggtgggatttgaacccagccactgtgcggccagaatcccgcttggaatcacgaccccacactgcctcttggtaaagtgtagctgatgatctaagggacctggaatcatccatgactcttttccagtcctgctcttacggaatctctgcacaccactaactcggcttc

SEQ ID NO: 128341 - DNA, 693 bp, Homo sapiens
ggaggctgaggtgagaggattacttgagcccaggagtttgaggctgcagtgagctacaactgcaccactgtaatccagccttgatgacagagcaagactgtctgaaagaaaaaaaaaaatacaaatttttaaagaaaaaaaataacactcaagccctgtttggcacatgaaacctgaaaaacaaaaatagaagatactacataattcattcatcttttgcctctgaattcagagacaggatctgtatcaaccagcaaattggtatcctcctcctgcctgcattcttataataaccataagaagtaagtacgtaatataaaacaagtgggcaggaagtgtgtatgtgtacttggcttaagtggagaaggtagccataatcaggggacacagaagctattaatgtattcattgccttcagatttggcatgggcagatccaaaaattaattattttttgtttcctttagtaaacaatgcacagttctgtggatttttacttttggaccaatcagcattacttacaagtacttactagtaatgttattacttactaataagtgaattacaaaggaccactaaaatttgtttccacaaatgaaaatcagtgttttattagagtttgcttaggattctacttataagatgcctggtccctgtacaaggtttgtaattttgcaagaatgcacaaaagtgt

SEQ ID NO: 128342 - DNA, 151 bp, Homo sapiens
ttaatataaactccatgagggctaggactacttaatcttttcaacaaatatttagtgaatgcctccaaagtactagggagtgttttagataatggggatacaagacaggcaaatgctcatctacaaggagctcccattctgtgttctagtg

SEQ ID NO: 128343 - DNA, 823 bp, Homo sapiens
tgggcaacaggcaatatagaactgtgatctcagataaaccaaaacaaattgaacgctaaaatcaccgcagctttctacctggcaatttccagacagctgcacacacaaaaaaatgggaatcaatatatagtctgccattcttactgattccagaactctttaaaggattacaacaaaatctgtcacttaacaatatagtatcacatattcagcatccaattaaaatgagtggacatgagaagaagcaggaaaatgagaccataaccagtagaaacagagaagctgaagtatcagtagtataagcagactaggaattttaaaacacttcttataaatgttataaatgtgctcaaatattttaaaaataacatataatgagataaatggacagtatcaagaagaatcaaatggaacctccacatatgaaaaatatagtatctgaaattaaatgcagatttaaccctgagaagaaaaaaaaaaaaatcagtgaactagaagatacagccatagacataattcagaatgaaggaccaagatttaaaaacaaacttaaaaaattattagagtcttaggacccatgggacacatcaagcaatctaacatatgtgtaattggagtttcagagccaagagaggaagggaaaaagaaaaaagttagaaaaaaatagttgttgaaaatatgtgaaacatttttgttatggactaaatgtttatgtgccacctcttccaattcatacactgaagccctaacccccagtgtaactgtatttggagatagggcgtttatggaagcaattaagtttaaatgaggtcacaagggtggg

SEQ ID NO: 128344 - DNA, 380 bp, Homo sapiens
aatcctcctggctcagcctagctaggaccataggcacacaacaccatgcccagctaatgttttaaaattttttgtagagatggagtcttcctatgttgcttggtctgttgaacgcctagcctcaagtgatccttctgcttcagggattacaggcataagccaccatgcctggtcttgaaataaatcttaactgaactgtaatattcaaaccaggggttctcaaacgaggaaagggaaacatcatatactattagaagccaagtggacatattaaaatgggccagggtgaaaacaaagaagtattttgttcgaatgttttcatttacttttagtcatcatatttactttattttacaattaaaatgttattaaatgacaag

SEQ ID NO: 128345 - DNA, 915 bp, Homo sapiens
cttgcccagtgtcctggaagaatcaggtcacacgcaagcttgaggataaatgcaagattttattgagtggtggaggtggcagtgagatggatggggagctggaagaaggggatggaatgggaaggtgatcttcctctggagttgggccacccagcagctggactcctttctgactgcccccagccaaacttctcttggcattcagatgttcctcctcttctctttttctctgccacgttgttccaccatccatcatctggtctgctggcttgctggtctgtccctggagcctgggattcatggcttatatgggtgcaggacaggaggcatggcgggccaaaaggcaacttttggggcataaaaacaggaatgcctattctcatttagggccccaggatccaggcttgaggctggggcctttgcatggagatcatcctcttctatccagtatttcactgtgtcctgtccatatcattttttagtaatggaaccctcactctgaattttagcagagcacatagcccaaggtagagactaaatttcccaccctacccctacagcaaggtatgggcctgtaaattcgttctagccaatgggatatgagcaaaagtgatttgtgcaatttcaaagtcacttcttttttaaagcaaagtgttcctctttgcccacacatcctgaaacagcatgtttgacccattgctggaaaccacaaaggaaagatggacagagtcaacccctcagcctgggtttccggactcagcacgcacagctacctttctaccctggactactcacctacctctggactgttgtgtgataaatcacttttatcatatttaagctattttgtcttgggatctctgggttccagtactttaggtactaccccaactaatatactgatcttactagact

SEQ ID NO: 128346 - DNA, 438 bp, Homo sapiens
gtctagaggatcccgggatgagcatccttacatgcaatttacaacaataatttaggaaaacaaattctgaacggacttactagtatcttaagaacccaaaagttctctgaaatggcattactatcaaaatttcaccttttaaatttacatatacggtcacatccacagggtcaaggagagaacacatatatgagggtggtcctgtggattataatggagctgaaaaaatcctatcacctggtgatgccttgataactctgaccctgagtagacctaggctaatgtgcgtgttggtgtcctagtttttgtgttttttttttttttttttttttttgagacagagtcttgctctgtcacccaggctggagtgcattggcgctatctcggctcactgcaagctctgccacccgggttcacgccattctcctgcctcaacct

SEQ ID NO: 128347 - DNA, 303 bp, Homo sapiens
tgttgggattacaggtgtgagccaccgcgcccgaccctttgcttgcattttcactggcttgcaggatgagcttgtgagtgggcagccttattctttggcagaacagccattccctgttgtgcgtgagagagagggcagatacacgtagatagggaagtcaaggcagaatgtgtttccttttgatctgcagctcagtgacgttggccggcttcactgagttgtgttcttgtctctgtacctgcctggggacctgggaagggcccctctgctggtacttccattgtggggggaacatgcatccca

SEQ ID NO: 128348 - DNA, 266 bp, Homo sapiens
aactccacccttccccctactccttataccctggcaagcagcgatctatctatactactatacttttgtctttttgagaatgtcatataaatagaatcatatagtatttagccttttagactgataatttgcctatttttttctttgggttgtttgtttcttactcctgagttttgagagttctttatgttctgggtatctttttttctttttttttttttttttttttttatttttttttttggacaaaaaaaaaaaggggacac

SEQ ID NO: 128349 - DNA, 772 bp, Homo sapiens
gtaatactcatcatcatgaaatctaatttgtctgatattattatagccacttatacttactgtatacctgattattttttccatacctttatcttcaatttatctgtatatttgaattcaaagttcatctcttgagcctgaaagtaataagcaccttgaacccggatctttatatctaaatatgattctccagtaaaatttatcagggttctctggacaagtggctgattgattgtagagcagggataagaagagtatatgctgaacctgaatcatttttgtggtgccaaaaagtaaggaagtacacaaaaaaattgagaagatatcagaaatgcacaaaaactaacctgaagtgactctcaatgaccatatctgggacaatttgagtaaaaaaataagtaacaataatggattatatcttataagataatataaaacaaatatcaatgagtctatgatgatataaattagaatgtataaatgggaggaaggggaaaattctttgcttaagcagaataataattaattaatataaaaagaataatggaaatggtagaaatagaaagtcaacatttggcaagcaccacagtaataattgttgcaggcaagaatcatcaatggatgctaaagtttgtgagaaaaagtttgatgagaaatgggctatttacataacctcaaaggcttttcccacaagatactgttaattacaaaggggaaaatattgagaaacatggaagacagcaccttaaccaaatgattgaagttaatacca

SEQ ID NO: 128350 - DNA, 788 bp, Homo sapiens
gtcttgctctgttacccaggctggagtgcagtggcgcagtctcagctgactgcaagctctgcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtccggtataaccatgtggcacatacccctgtacatgtttgccaagactgctatatggtagagcttggaattctttggagctttatcaggtaattgcaagtcccccacctccaacaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaa

SEQ ID NO: 128351 - DNA, 533 bp, Homo sapiens
taacagcttaaggaagacaaagaagtttttctgtctcatataaaaatccaagagatagtccaggactgattataggagctctgccccaaaaaattctcagcatctttatagctcattattccaccatcccgaatactgggcccccattctcagagtctaaggtggaagctagagctccagcaaaatatctgtatttcaggaattagggtggaaaagggatgaagaagctggagaaagggcagtgagtatcacctgtctttaaggaaaactgcaggaaactcttatgtgacactttgcatcagtcatgtgaccatactggttgccatggagcctgtctttattctggaaaacaatgtgtccatctaaaaacagagtttcaggcctgacatggtggctcatgcctgtaatccccagcattctgggaggcccaggagggcagatcacttgaggccaggagttcgataatagcctggtcaacatggcaaaacccagtctctaataaaaatacaaaaattatccaggcatggtggcac

SEQ ID NO: 128352 - DNA, 675 bp, Homo sapiens
catggtgtcacgcgcctgtaatcccagttacttgggaggctgaggcagtagaatcatttgaacccgggaggtggtggttgcagtgagccaagattgtgccactgcacttcagcctgggcgacagagtgagactgtctcaaaaaacaaaaccaaaccaaaccttaatgacttaggaaggtggctttagtggccgcatgaagcacaccctgattgccgaggaacaagagtgcaaagctaagaaactgaggcattttgaagaagttgaagacacttggctttcttatctgacccccaagaagaattctatcagccggggcagctgaaatatcctaaattaattctccaagaagccagcagtgtatctggggagctccataaagaggctcaagaggccgggcgcagtggctcacgcctgtaatcccagcactttgggaggccgaggcaggaggatcacgaggtcaggagatcgagaccatcctggctaacacggtgaaaccacatctctactaaaaatatttttaaaaattagccgggcgtagtggtggatgcctgtagtcccagctactcgggaggctgaggcaggagaatggcgtgaacctgggaggcagagcttgcagtgagctaagatcgagccactgcactctagcctgggagacaaagtgagactccgtctca

SEQ ID NO: 128353 - DNA, 437 bp, Homo sapiens
ctaccgtcacactctcaaagacagctgtcctcattgagtcaatggtagaggcatggggtgggcacagctgctctaggctcatgtgtgtctgcacgctaggcctcctctttggcattgctcttctcgctgagttctggtttgttgctctgtggagactgtgaaggtcctagcgctcagcagaaaacacagtgcccttcccccagagggtgctccattaatgggagagttgactccattcactgctgggcagaaggtggatagaaagccagtgccaagctgagttcaggctgtcaaagagaggagatgaagaagttagttcccagtctccactatcgttccgcttagaaggacactgtgaccttgaggaccaaaaatgtaaatgtcataagtcagccgtagacgttacaggagaagcctactacgcaacacctccagag

SEQ ID NO: 128354 - DNA, 610 bp, Homo sapiens
gtccgtatcctctgctttttcccttttacatcctcgacatcctgaccctcatcctcggcatggctgcaggaaagaggcagtcccttgcggggttgatgggagcagccatcaatgtggtccctttgaggggcaagctggcaacatctatgacatttacataggtgcagctgtgtgacccagtccttctttgtctaagaacttattcttcagatacacccatatgtgactaccaagatgtacatctcagtgtgttggtgtggcattaatagtaagaggaaaccctggaaaaaacctaagtatccatgagtcggggattggaagtaacctgtttccacaaggtggggactggaagtaaactaagtgtctatgagtggggaattggaagtaacctgagtgtccatgagtaggggattggaagtaacctaagtgactgaatagataagactcatccatacaaaatattctgcaaccataaagaggcagaaggatgctcttgatgtactgataaaaaggagcagacaataaattctatgaaaatggcacactgtcagcctaggcaacatggcaaaaccttctctctactaaaaaaaaaaaaaaaaaaaaaaaaaac

SEQ ID NO: 128355 - DNA, 387 bp, Homo sapiens
tatccttatcttagtccttttgtgttgctacaacaaaatacctaagcctggataatttataaacagcttaaatttactgctcatggttatggaggctgggaagtccaagattaaggtgctgacagtttcagtgtctggtgagggcctggtctctacttccaaaatggtaccttaaatgctgcttcttctggagtggacgaacaccatgtcctcgcatgggaggagggacagaaaggcaaaagggcctcaccagttctctctagtacttttacaagggcactaatccattcaccagggcacagctctcgtaacttgatcacttcccaaaaggccccacctcttaaaactatcacattgggtcttaacttctaacatgaattttgggca

SEQ ID NO: 128356 - DNA, 542 bp, Homo sapiens
  misc_feature (473)..(473): n is a, c, g, or t
agatgggaatatagtaggccctaacattaaggggtggtggtaagaattcattagaatgaatgtgtaaatgcccagtgcctggcatgtgctgaccaaaatgggagctctttatgtgaaaatgggagtgattcccatgccaacaaggcctggccagattcaagggtcctcccattaaatgtaggaagggaaaaaacttgtttgtgctgggtttgatggcgtcttctttcatacagagagttccaaattgctgacttttgaggccacagtctctttagaagcaaggaggaaggcaccgagtcagttgttttgtttcctgcatggttaattggttgtaaaatgctacctttagttactgcttctgattaaattaagtgccctgggaaatccagctgtgaacaggtgggtatgggaggttttccctgtgtctctattcactgtctgtggacagcctcatgctggtaaatatgcactgncttcacttttgcttctgggaccagatgcttttcccaacttctcccttcacccaagcggtcagctggcaa

SEQ ID NO: 128357 - DNA, 278 bp, Homo sapiens
ggatacatccccaaaactatcaaaagtgaaagaatgaacaaatcacggtgtctttatacaatggaatactactcagtaataaaaaagtcactgatctacacaattacatatgggtactaggcttaatatcttggagatgaaataatctgtacaacaaacccccatgatacaagtttacctgtgtaacaaacctgcacatgtacccctgaacttaaaagttaaaaaaaatagatccaactatatatggtcaactgactttctacaagttacccagataa

SEQ ID NO: 128358 - DNA, 184 bp, Homo sapiens
ttctcagactgggaacagttttctttggcttaactaggagaccagggatcttgctggagttccagatttgagctctctgcccttcctgactaagcagccccacagtgtcctcacttgacacatgctgttttatggggcgccacgtcttcttcgttccttctctctcctctgatccacttttttc

SEQ ID NO: 128359 - DNA, 497 bp, Homo sapiens
tctcactatgttgcccaggctgacgttgaactcctgggctcaagcaattctgcaccttgaccttccagaatgttgggatgacaagtgtgagccactgtgcatggcttgacctttcttaccactttttaaggtcactgatattcttgttagtattcctagtatagaactatttcactctccatatttcttcttccttgtttatttccccatggttatgaacgttctgtatcagccctcagaatcaatgttcctgaactgcagcaatataagatggtgatatggtgctgaggcttagcagagggattatatattgaaatcattttaaaatcagatatcttacattagaagaagggtgcaagaataaaggttttgtcacaacttgtcataaatgtgaatatggattttcacttgcttttggataacaagtgattttctggagaagttgtctacaatgtggttacctttatcagtatgtttcttctctcccaggattgtgt

SEQ ID NO: 128360 - DNA, 442 bp, Homo sapiens
gctggctcggggacctttccctgctgtctgctgcatcatgtgtctccctgggtcctcacttggtgtttgctttggccacttcctgttgaaagctttcctgttgtgtctggtgatctttggccatctgttcactcctgcgtgtgaggcaccacaaggatgagaggctctgtgcgaggcagggccagagggcgtgggctgtgctgtgtcagtgggcagggcctgtgcccttctctttgggatggttcagtcctgtctcctgcggatggttgtgaagatctcaggaaggccagggtctccctgccctgtgggaatattccctttcccctgtggtctagctgacacctgccctgcctctgctctgaggtgacctggatgggactggtctctatacccacttccccagcctggaggggactgggagcagagtgggccccccccccac

SEQ ID NO: 128361 - DNA, 302 bp, Homo sapiens
aaacagtgtgtgccaaggtatcgagtcacaaagtttgtgctgggagctttgtggtattaaatgtggccagagcttagtgtgagaaggaggagttgatcaatataaaaggcaacaggttaggccaattcaggtaaggttttatatagcaaactaaaatcctcaaactttgccgcataggcagcaggagggcagcattcagatttttaagcttgttgctaatacatacagacctgaattttagatcatgctgttatcattgttgagacacacagagggctgcataagaatatgggcaaggagtt

SEQ ID NO: 128362 - DNA, 480 bp, Homo sapiens
ttcctctagatatccataggatgcgctccctcacccgcacagaccttttcctggcagcccgcacaccctgcaacctcttcttgaaaggcctgggtctgacctgagggagagagtttctcttgggcagagggaggggtcacggccccgtccctcctatccacctggcgctttccaccttcctgagagcagaggccactgtaaaagggaccgtgtgctgggggttttctgggtgctggacttgtgggcacacaccccatccactcctgcctggtccacacactggctgctgtttcacagacaaagatctggcggccagaggggctccaggtttgagaagggccctcaaaggagcagccccttcctattgctgcagcgtcttccacacgtggagaggggttcaggcccacgctgctctgggcctgcagggccaccccctggaggccgcgggagtgcgggaggggacgccgggcctgcaggggt

SEQ ID NO: 128363 - DNA, 451 bp, Homo sapiens
ttcggagttctgccactgcttgtctgagtaattttatttaagatttgtagcctccctgagcttcaatactctctcctgtaaaatgggaatagtaaaatgggctactgtgaggataaataaggtaatgacttcaaaacatctagtaaaattgttagctcatcgtaggtacgcaataactatagctactccactaaagttcctaattggaggaattcccaatcccttctgctccctagtccattcacttcaaatctattttttccccaaggtttggtcattcggtgtccctggaactctaactcagatacccaaggcactcaaaaaatattcgcacacaccccgcattcactcttgggaggattttgagatgccaaggctggttaccaaggaaaacgtttaggagtcttccctggtgttcagcagcaacgtttcagtgttggttaaaagacag

SEQ ID NO: 128364 - DNA, 454 bp, Homo sapiens
agatgatctacggaccttagctcagtgatctctggaccaggtatagtcatttacctatgcctacatcttagcagaattcaggcccctctcataatcctaaccttgtggactttcattagttttacaaaggtggtttagttttgagaagggctattatcatccttgctttaaggttaaactctaaactaaatttctcccaaagttagcttggcccatactcaggaatgaccaaggacagcctggagcttagaagcaagacagaatcaacaatgttggatttctctcactgtcataatttttgcaaaggcagctttagaagcattagatttcatttaagcctcaatatcaccccattttagatgaacctgtggctgagtgaggtcaacattttctcagagtaatacaaggataaataatgggccaggtacagcagctcatgcctgtaatcctagca

SEQ ID NO: 128365 - DNA, 236 bp, Homo sapiens
ctctgtggagcgacttacttaccaggcatctactgatcttaagcttccgtgtttggccttgtgagggatatgacgatatgtaaataatgtaaggccttcagcgactaacaggggttgagctcagttcatacagataacaagctggcaagtcgtgtgccacaagtgatacctgggagcttatcacaaaggttctgaagctgtgggaaaaaaaccaaaattattccctgagaaatgaa

SEQ ID NO: 128366 - DNA, 282 bp, Homo sapiens
tcccaggttcaagtgattctcctgcctcagcctctcaagtagctgggactacaggcacataccatcacacctggataatttttgtatttttaacagagatggggtttcaccatgttggcaggctggtttcaaactcctgactttgtgatctgcccaccttggcctcccaaagtgctgagattacaggcatgagccactgcgcctagcctcaaagtttctatttttttagaagaaatttccatttgtgaagagtcatgtaaaaagtcccaacatgatttttac

SEQ ID NO: 128367 - DNA, 411 bp, Homo sapiens
caagcacccagcagactcaccaaaggcttttatcccaatgaccaggaaaggaagacgggcaccccttttgctgagggactcccatgggtgttattaaacttgggcattacaaaacctcttccaggtagggacctttggccccacttctcagctgggaagacagagattcaaggagataaaagaactgctgagtatctcacctttactctgcaatgcagatgggattgaaaacctggtgggcccagggtcagccagggtctgtctgactcttggcctggctggggccgcctctctaagcacatagcctgtgcgtcagcacacgcagggccccactcttgtaagctgctgcttctgaaatcgattcatgctaccctcaaaggcagagcaaatatataacttagggagatttct

SEQ ID NO: 128368 - DNA, 502 bp, Homo sapiens
agtcctcactttgcacactcaggagggacctcgaacaacttcacctctggggaccactggttgaggtgcagcacgtggtccccagggactgagcctgttccagctgtagtcacccgccctgctgcccaccctccaccccatctgcagtcactgttgactgaaggacttacatgctccaggcacagaagtaagcactaaactcagaggggccatggtcactcaggttgtaaggagcagagctgggattcacactcagccgtgtttggcttcaaagcctgtgtcctttccttcacacctcactgccattaactgggagccctactttctgcattttccaactgtcagctttctgcatggcaaggctctggtgagaccctgttactgttcctctctgtgactagggccaggactggaatgtccagtgaatgctgaggatggtagtggtggtggtggtggtggtgatggtggtgatggtggtggtggtggtggtggtgatggtagt

SEQ ID NO: 128369 - DNA, 431 bp, Homo sapiens
cgtagtagccaaagaactgtgcttgttagatctgaagtcatccggactaatgctcaaatgcgaggtaactgagcacgaattgttgattgtggtccttacatgctccaggcacagaagtaagcactaaactcagaggggccatggtcactcaggttgtaaggagcagagctgggattcacactcagccgtgtttggcttcaaagcctgtgtcctttccttcacacctcactgccattaactgggagccctactttctgcattttccaactgtcagctttctgcatggcaaggctctggtgagaccctgttactgttcctctctgtgactagggccaggactggaatgtccagtgaatgctgaggatggtagtggtggtggtggtggtggtgatggtggtgatggtggtggtggtggtggtggtgatggtagt

SEQ ID NO: 128370 - DNA, 831 bp, Homo sapiens
ctcatccacgttacttgaagaactccctggtttaccacccacagctgcgagcacaggtttggcgctacctgacatacatcttcatgcatgcagggatagaacacctgggactcaatgtggtgctgcagctgctggtgggggtgcccctggagatggtgcatggagccacccgaattgggcttgtctacgtggccggtgttgtggcagggtccttggcagtgtctgtggctgacatgaccgctccagtcgtgggctcttctggaggggtgtatgctctcgtctctgcccatctggccaacattgtcatgaactggtcaggcatgaagtgccagttcaagctgctgcggatggctgtggcccttatctgtatgagcatggagtttgggcgggccgtgtggctccgcttccacccgtcggcctatcccccgtgccctcacccaagctttgtggcgcacttgggtggcgtggccgtgggcatcaccctgggcgtggtggtcctgaggaactacgagcagaggctccaggaccagtcactgtggtggatttttgtggccatgtacaccgtcttcgtgctgttcgctgtcttctggaacatctttgcctacaccctgctggacttaaagctgccgcctcccccctgagggctggaggcccaaggtcggggaggggagggaaaagcagcacccacagggagcgcctgcgaggtttcttctcatcatcagctcagctaggccgggcagacaaggacagaagactctgggccactgtaatgtttgtgtttagatttggacacacagtggagacccttttctgaaaggcatctggcggagg

SEQ ID NO: 128371 - DNA, 280 bp, Homo sapiens
cactacaggagatcataactggtagggacgtagaaggtcagagacagtaagagagctgaggaaagctagcgtaagagcagacccccctgagggctggaggcccaaggtcggggaggggagggaaaagcagcacccacagggagcgcctgcgaggtttcttctcatcatcagctcagctaggccgggcagacaaggacagaagactctgggccactgtaatgtttgtgtttagatttggacacacagtggagacccttttctgaaaggcatctggcggagg

SEQ ID NO: 128372 - DNA, 626 bp, Homo sapiens
actaatatttgctcttttagaaattaaatgacaatttcaaatatatttattaatttaaactgtgttgtaaatagaattttttatgaagaataaatatgtcctaaaaccaaagaaactagaccagtggcattgttttatatttttgcaaatcaccttgatttctggcttacttggagaagacagctggattttttgtctgccttcagtctgttatgatgttttggttgagatatgtgaagagaatccagcttcatgtagatatatggttggaaaaggaaagagtgagtattcttctttggtattacatcaaaattcaacaagtggcagttttttgttttttgttttttaagttactgacaatgtgaaagcatattgtattccaaaaatgtctctaggacctacaggaagtctatggaagatacatttaaagaagagactaacggttgggagacgtgatagctgtctccaggtatttaagaaacttggatttcagtaaataggatttaaaaacctgttaattttaataaataggagggagaatagatccattctcctgctttagaaggcagaccaacgggtgaaaattaggaagacattgaggtcagtctaattttttaccagaatgt

SEQ ID NO: 128373 - DNA, 695 bp, Homo sapiens
aaagtatatgaagagaggttctaggttcatgaaatgttagagttggaaaaatgggcctttggggttcttcttattctacctcctcattttaaagaaatgcaagtgggaaatggatgctcagagctgacttgcctgagaggtgaaagggctagtggagaagccagagcccctgattcctagtctagtgcttttccctcccggtgtgatcacctctttgtttctccccctcttctgggcctggtcccggaatgggggttgggagtccagcagggtgtcgtggttcatatttttgggaacaaattcaagttacttctgtgattgtagttttgagtctaatagtgaaattacaaaggcagtgagtcattaagtccaattcttctgaaagaaaactgttcttaaaatgggtgcagagccctcagggctgctctgcctatggagcagccattctttattcctttactttcttaataaacttgctttcactttaaaaaatcggtgtagttgtgtttaggctgtgcctgcttaacttttaaatctctgtgctgtgtatctttgccattcaaaaatgccacctggcctggtacggtggctcacacctgtaatcccagcactttgggaggctgaggtgggacaattgctcaagaccagttcaagactagcctgggcagcatagtgagagtccacatctctacaga

SEQ ID NO: 128374 - DNA, 259 bp, Homo sapiens
aggaaacaagcctgttatgccttcaccaaggcagggcagagctggataagggtgaacagaaagggacaaattattgatgagagttctgtgagtagaaactcctttctcttctttagaatttctgcctccagtttgttaatgccacttccaaaatacactgctctgagctgaagataatactgcatgcagatagagtgccatgaaggcattggtttgcagtgatctataaaggactaatgtgccaggctctgtgttaagt

SEQ ID NO: 128375 - DNA, 437 bp, Homo sapiens
ttcagtccagcactgcaagggtgatcctggtttcctcccttctatgtttgtaactcccttctccacatggaggagccgggcactggttctcctctgtgtttctgacgggagtaatccctctgtgaatgaccatcctcctgtcactgctgctctgctcccagcaggtggatgcccattcccacacttgcctggcagtgtgcctggcacagacttcctcctcacctcacttgatctgcaattaggacaggctcgggacttaaattgaataaaaaggcatccctgtctgggggatgccctttgtgccctgcttggccccttataccacttacacccttatacctctgtgccagccccaaaatccttcatcatctcacttggggcctcacatcttgttctgtacttccctctactgccacctggacaccctcctcactgct

SEQ ID NO: 128376 - DNA, 297 bp, Homo sapiens
ctcaaatacattatcctaagtgaaagaacacagtctcaaaaggtcacatactgtgtggttccatttacgtaactttctggaaaaggcaaaattagagggatacagaacagatcagtggttgccaaggattaggggtggagggagcatttgactacaaaggagtggcagcaaaaaagaatgcagggggagggtggaagttatctacatcttgactatggaggtacttagaagatagaatgcatttgtcaaaactcagacctgtacatcaaaacgagtaaattttgctactcaggaggc

SEQ ID NO: 128377 - DNA, 643 bp, Homo sapiens
ctgcctgtgctgctcggacatcctctaaatccatctatccagtgggttagtccagtatgaagaaagcagggcacgccgaggctgcggccggttttcccattcagggtgaaccctctccctccaccccgacaggcttcagccaggggcttcaccaaggccagtgcatcccactaggcagatcatccttcaaaaaggcagaccggggctggtctggggctgccctgtccctccctggagggagacggcacatggaatgggcacataagagtcacctgcagggtccccactccccaccccaggaatggggttctgagtaggaagtgatgtgggaatactcagccctcagccccatgtaagggtcctccttccctgtgactcagccggaagcctggagctctctggggtgagacaggaatagggctcagcaccatccccaccctggttagtccccaccccaggccagccagctagctgcagcagcgctgtgactcagaaccccaccccacctttctctctactgtggctccgggcacggcagcaagacgctgacctggccctaacatcccaccctctacaggccccagcaggatcaggccagaaaacaccagcttccctgtggagtcggtggggaaggggcctccaa

SEQ ID NO: 128378 - DNA, 286 bp, Homo sapiens
aaaaggtgaggatcccggcagagatcttacatgatgtgtttcgagggagttaatggtggctcttaggttacgtgtatgcaggggatggaacatctttatgaataagagtgttcctttctttccatttcacatatattggcttccagtaagcccggagtacaaagacaagagatcaatagaatatggattcaaggttctgtgtggattcagggcaaaggtctggcaagtatgattctccgttgtttttttttttttttttttttccggggggggggtagggttgccc

SEQ ID NO: 128379 - DNA, 130 bp, Homo sapiens
ttcagctttagtttagagaactaaacgtaacagacttgatggtcaggggaaataaacaaaaggaagaaaacagacatggaaggtatcactccggggccctgggctgatgcctccattaatattactgcat

SEQ ID NO: 128380 - DNA, 340 bp, Homo sapiens
gaaagtttaccagtttgtgttgggccacattcaaggccgtcctgggcctcatggattggacaaggtttttctagatcatgtgcaatgggaaggaaaatgaggcatattttagaaactaaagatgtagacaactggaatgtgacatacaagagaaagaaggtcaagaatgtttgagggctgtcaagctcattggaagacattacagtggaatgacatgggcatttgtgttttttaaagtcagtggctgcattgtatagaattacttgggatgcaagcagggaaccatttagaagattattacagacagcggtgttggtatggagcagaatgatagcagagg

SEQ ID NO: 128381 - DNA, 469 bp, Homo sapiens
gggcacacagggcctgctggggggcacggcaggggtctccagtggggcaggcctctgagagtagaggctcctccccggcggaggctggggagcccttggcctcccatctggcacatgtcagggtccacagggaaccaggcatacaggccagggagggagagccaactgcagtggtgggcacgctgtgaggacagtggactccggcctctgatgggcagctggctgggatctgtggcagcccacctgcccaccagctgtgtgaccagagcaagtctcccaaactctccaaatctgtcccatgaggccaaagtgcccgccttgcagggtccttggcagatgagatgacctaacgtggcaaagtggttagaccagcgtgggcccctttggaggtcccataggagcaagacgccagccctcagaggccacgctgtcatggtaggataagacgccagccctcagaggccacact

SEQ ID NO: 128382 - DNA, 140 bp, Homo sapiens
ttaacatattcagtttccaaattagtctaaatgactagctgataacgttatctgaatccatatgtggaaattttcttttgagtaaatcagaattcctatgtgaaagttaaaaaataaataaataaagatgggctttggac

SEQ ID NO: 128383 - DNA, 405 bp, Homo sapiens
ttctcttattgactaataaaaagaatcaattaatctggggcttaagaagaagaaaagcaactctctagagcaggggggtcaacaaactgtggcccccaagcaaaatctggtctgtcacgtgtttttttgtaaataaagttttattggaacatagccatagccatttgtttatgtactatttatggctgctttaattttgagtgattgcaacagaaataggtcttttgcatatggttcataaagcctataatgtttattatctggccctttatttaaaaagtttgctggccagacgcggtggctcatgtctgtaatcccagcattttgggaggccaaggtgggtggattgcctgaggtcaggagttcgagaccactctacgcaacatggtgaaacccctctctact

SEQ ID NO: 128384 - DNA, 954 bp, Homo sapiens
ctcacaccatgcaggatgatctaaaaagcttcaagtataatgtttagatgaaacttactatgaaactgagtcactgttacatgctgcacattgtgcaagcccccgggtctgtatagtagaaagaaaaacagtccttgttagtcacggagctttcattctaacgtcagagctgttcagcagtgaatcagtgaatgatcacaaaatgctgagtgccaaggaggtatgagggtagcgcctggggagagatcctgtgaacggtacctagacaggaacgatcaagcatctgaaggaaaggcccacgggactggagtgcagcaagcacctggtggcgtatgaggtcagagagccaggagggccaacaccatagaggtcttacatgctgtgacagggatttttaaaatttaattttattcaaagaaaaatggaaagccaaatcgaccttttttgaatataatgcatactaattttagaacactgtttgttgaaaaggtgaaggatttaaaatgaggttttttttttttttttgagatggagtgtcactctgtggcccaggctggagtgcagcaatgtgacctcggctcactgcaacctccgcctcacagggttcaagcaattctcacgtctcagcctcccaagtagctgggactacaggcatgcaccaccacgcctggctaatttttgtacttttagtagagacacggtttcactgtgttcgccaggctagtctcaaactcctgacctcgtgatccgcccacctcagcctcccaaagtgctgggattacaggcataagccaccgcgcccagcctaaaattaggtttcgaatcaaccaagggattattacattgtttgatcccattgaaaattggtacttagggttaactgtaagcagttgagaaagaaaaagattcgatattttcgccatacagccccacagctctcttttctttggtcac

SEQ ID NO: 128385 - DNA, 758 bp, Homo sapiens
agccttcaaatacacccaacctgagcactattattttttcaattctgtgatgactcaatgtgtttagttttatatatatatgatatacttacatatgaaatatatacacatttatatataaatgaataaataagattagtttgcatttttattatactatgtatttaacatttataaaatgaattggtaaactttttaaattctcctgggaaatgaatatcatgtgattattattccctggaaaatctccttgggctttatgcctttttccgtatcaatctgataaattaattcattaatcttatggttattggtctctttagtttttatttctagttgagacaaataaattatcttttcctagaaaactgtctatttttctaaattcaagtttttgaccatttttcttttatagtttcctgtttattagtagctttaattccttttgttgttgtttttacattttatatttctctctttctttctctgttccttccttactctgtcccttactctctccctctcttcctccctctctttttcaactaagattagttgtaaatgtgtctattttattgtttttttaactcaagaactaatgctgatattcatttcctttattttgtactttcttatatctattgttttcaaatatatgtatatttttaataatacagttttcatgagtgtcttttacttttctttttatgctgttttggatgaaaactttatttgttgattcccatcttggcatgtca

SEQ ID NO: 128386 - DNA, 131 bp, Homo sapiens
gtgtttctttctaacatccactttaaggcactcaaagctttatgtttataaatctaagggttttgtttgtttttgagacacagtctggctctgtcactcatgttggagtggagtggcacgtactcggctca

SEQ ID NO: 128387 - DNA, 846 bp, Homo sapiens
gcaatcctttaaaactacagactatctttgttgtattccagtaagtagtcaaaactgacttcttttgaagatgagaaatatccataagccaatctatcccatgtaactccctatgagagatgtgatattatggaaggacctagggcaacaaacatactttagcctcaatttacccagctgtttaaatgtttgcctctgaagttgttatagaagttgacaatattacagaaaggttgtgggactgggactctccaaagaaatccccaaagtagttatttttcactctgatttacttttagacagatatcaatgtcaaaatgtcttcatatagtaatgtttcactggcttgcctgatgataagattctcatggagttctataaaaagatatgcccaagtatctgtatttatagcatgtttggaaaataccgcatcaaaccagcgtgatttaattaattaaagaagaatatattttaagagtaattttagaatttcaggtagttttgctttgtaaaatactttgggcagaatcttgaatattggagaaaaatgattgctttgcttataccaccagtattgtttgatgtttatttctataattctctttttgaaagcatgtattacatatccaccagaaaaagttatggagcaaaggaactcctgcacattgctgatgggaatgtaaattaacacaatcattttggaaaactaagtagcagtatccactaaagctgagcaaacacatacccttgacccagcaattccgctcctactgcacacccaatggaaatgcataagtacgttcaccaaaagacacgtactgagctattcttagtcattattcataa

SEQ ID NO: 128388 - DNA, 314 bp, Homo sapiens
accaattcttgattaaaccagcagtgccctttccataacctccgtttcacaggcaaagaaggagctccagatccaactcgcaaagattgctgtgtcccttgtgaagcatgtggtgtcaacataaatcacttaataatgggaatgctagagtgggacctggtgacgcccaaagatcaaaagcacagtcagggctgaccaagcagccccatctcagcccactcctcccagagcgcatggttgagtggccctgacgtgggctggggggagctagcagcctagtctctccctggaaaacaatggagtcagcagtcaca

SEQ ID NO: 128389 - DNA, 490 bp, Homo sapiens
tacccatgtgcccccgagttccccagttcccaaacacatgcagtgccctgcacaggattccctccacaaaatgcagtgaagtgtaagtggatatgtaattaacaggagtccacatataacaccgccaataccacactccctgggtggtctcaagcagcaggtaaatttctcagctaagcaatcaacgatactgaaatcaaaaacgtcaattctgttgagggtgcttaggcagtcagatcaataatatcaaaacaacactatcacaggtaacttattctaatatttaaggttttgctttgtagacgacatccaggcagacatatctgggttaaaatgctgtctcaaagcaaatgttccagggcagcagctttaggcctagtgactctccctttcacatctcctaagctgtggtcaccctacccaggtgttacagtaccacacagaattctgtggcttcacagaaatactcatcgaataggccccagcacta

SEQ ID NO: 128390 - DNA, 499 bp, Homo sapiens
ctggcctccttccctctgcctacatctgctttctcccaacccctctgccctctcctgcctctgtgtcctccctgtgcgatgccttgcctcccactccagtaacgttcttgctaaggcccaaagctccccaacacccttaccttttccgcacttccctctggcagagccagctacccgcttcctcccagctggtacggaggccaccacacctcctagatgaagccacaaaccaggacacattggccccaccggaaagtcatcctcaagggctccaaacgagcctacagcactgccaggcaatgtttccaggcccctctggtcacccacaccctcaacagtgggccacactcccctcacctcccgctctctggtcagacgacattgaggaaatgaaatccccagaagggaatgccctcatctctccaggacctctctgcatccccacgcaccgtgtttcctctccttcctgcccgcccttccctccaggttctcacctcca

SEQ ID NO: 128391 - DNA, 660 bp, Homo sapiens
gagaaataaagtgaggtttcattaatatgagagatcaacagtagttcagttataagttatcactgcagagggagagcagcaggttcagctcctcaagttggaaataaaaaagatgaatgggaggaggaaatgaagttagtgatctaccgcctgggcactttgtcaagggtgcgtgaggagagaggggaaagccctttctaaacacagattatacaccaaaggcaattaataattgtttaatccttctggagagccatttgttgtggtgatattcacatgactgtctttaacaccatgacaccaggagggtcttacttcgccagccaccaagctgggggcatcatgctgggtaattgtctgcaggtgcatttaactgaaacctttctctaagattctggagttcacagcacacaaagaaaataggcatagcatcattccagtctgtctactttctgtgactgaggtgatttttttctggagctaaatctgtcttttccacttgttctactctcattcactcactggctaattcaacagatacctacttggctcttactacctatcaatcactattcaaggcactcagtaacagcagtgaaccagagtttccaccctcagggaacttacagcagaagagcaggcaggtgatgagaaatgccc

SEQ ID NO: 128392 - DNA, 568 bp, Homo sapiens
atcctcagccccttccattaacttccccctcaccttcttgctgtaactgaaacttagctcccccttagacagatcattctggtgatttcaatattcatacgaattgtccttccaatttcttggtttctcagttccatgttgtcctgtcattcacttgttatatctggctatacctgggatcctcacttctgtagacacaccccagaccagctgtcctcaaagtgtggcccagtggcttctggggggtctctaaatactttcagaaggtctgtgagaccaaaactattctcataatcatataaaaacattatttgccttttggacttttattctgttatgagtgcatactagtttttcagaggccactaaaggaatttgtacttgtatattcttgcattttaaacttttctgttttaatttctaatatggtaaatattgagaggcatgaccaaaaacttttgggagtcctcagtaacttttaacaatgtaaagcagtcctgagaccaaaatgtcggagagctgctgccctagactttaccattaccaataactacaaccctgtcaagta

SEQ ID NO: 128393 - DNA, 312 bp, Homo sapiens
cacttcttgtataacactactctatttacatcaacaatatgtagttgcctatagttctccaaatttaccaagtgatttcagacctctaggcccatatatgaggattttttgttttcctagaaatgtgttttaacagctagtaagccttcatttatcttttccaaaactcagctcagggaacaatgccaccataaaattctcagcctcccccaaatccctatagaattatttttcttgagttgtatctatttcttggttttatataaatatttatcagctgggcacagtggctcacgcctgtaatcccagcac

SEQ ID NO: 128394 - DNA, 284 bp, Homo sapiens
  misc_feature (214)..(214): n is a, c, g, or t
gctgccttatcccattctgctacatctattgtaaggaatgaataaaaaataaacaacttgatggagtgataaagccaaaagtaaatattaaaaacggcgaatagagttgtggctacccacacaaaaggagaaagtaaaatgcccccttggcatcacaggttttgaagaccctttggtcctccgtgacaatgattacctatgtacaaggactggnatggaaatgctaccaaacatcttcaaagtgaaaagcttaaataagtcaggtattcattcaacacactagc

SEQ ID NO: 128395 - DNA, 875 bp, Homo sapiens
atagaatgacttatgttttttgggtatatacccagtaatgggattgctgggtcaagtggtatttctggttctagatctttgaggaatcaccacactgtcttccacaatggttgaactaatttacattcccaccaacagtgtaaaagtgttcctatttctccacagcctcaccagcagatatgcaaagcatatgaacagacagttctcaaaagaagacatttatgcggccaacaaatatatgaaaaaagtcatcactgatcattagaggaatgcacatcaaaaccaaaatgagttactatctcatgccagtcagaacgatgattattaaaaagtcaagaaacagtagatcctgctgtgttgaaatttctaagagagaattgatattttatctcttacaaaattcagaactaatttaggagtagatgtataattcaggcacacctttattagtaatacaaagattgaagagtattactttatatgtgtgaacaatatagcttaccgatcattcacctcagaagaaaagatttacctacccagttactgactatcctggacaattccagccctcctgccccattcttcatggagcagaacccactcccctaaacttataccttatagctgaatagaatatgccttcactgaaagcagacaggttaaaatgatgaaaataataaataataactatgacagtgatggtgatgatgttgaggagaagggtgcactagaagaggaggaagagagagagattaaaagaaaggaagggactgagcacctttttctcaaaccctccatttacaaacatatccatatagatgtcactttctctcacttggaaaggagttggaaggagagtggaaagattccaagaa

SEQ ID NO: 128396 - DNA, 701 bp, Homo sapiens
caactccaaaatttaattggtgacttaggattgaatgtattatggaatcttgtttttctaattgtaccatatcattaatcagctaagaactgaaatatttggctaggcatggcggctcattcttgtagttccagcactgtgggagactgaggcgggtggatcacttgaggtaaagggtttgagaccagtgggccaaaatggtgaaacctgcctctactaaaaatacaaaagaaaattagtgtggtgtggtggtgcatgcctgtagtcccagctactcaggagccttaaccaggagaatcgtttgaacctgggaggtggagattggagtgagtcgagattgtaccaccactacactccagcttaggtgacagagtgagactctatctcaaaaaaaaaaaaaaaaaaaaaaaacaaaacaacatttggggggggccccgggccccgaaaaaaagtttttaaaaccccatgcgtctgggggcggccgcccccccaagagttagtccaaaactggccaaagctcggccccaaaggaaacatctggccaggcactgtcgctgtgttcccacccaaataaaaaaagccgcggggacccgaggcttcgggaacaatcccaaggaggttcgagggccagcggtctcaccacggctccagggatccgaaaatacgcgcgcggggtgggaacgcaaacaacagcgccagca

SEQ ID NO: 128397 - DNA, 577 bp, Homo sapiens
ctttttatggttggcatgtagttttctcctctatttctgtatgtatttccttaatatgtagtttcagaagtggaatttattagagataaactaaactcattaaatttagagtttcttattgtctttcatgagaacatttttccttttcattcataaatgatattgaaacactatattcttactttcatattcctgtttatatttttgtttttcatgttaaacattttacattctaatagtaacctcatcgacctgttaaaaggcaatataagatttagattattaaatagcatgtaatatatgtgatcagtaatcttcaatgagcttgttcttcatttaattgcaacgttatgtctgattttttttgttgcaaagctttcagaatcttgacttgtggtaatcttcttttaaaaaagcttttaacagaattaataagtcatcacgttatgataaatgattaaggaaatgatgcctctaatacattgaattattaaaactatcattttgaaaaattatattggtacaaactagtgtctactgctattactcatacatttcagaattcatacatggatat

SEQ ID NO: 128398 - DNA, 405 bp, Homo sapiens
cactgcaagtataattttatcacctataaaatcagaacttccccaagatacattttaaatggttatacttaaaatgttataacttcaatagttcagtagtttgctttgctttcccattttttttcatatattacataaaagggagattaagccttcagtatgcaattatcacaactatgtattttttggacttctacagcaatattctaagaataaatgcccaaatcccacaggtctttcagaaaggcaagatgaaggacaggcatggtggctcacacctataattccatcactttgagaagctgaggtgagagaatcagttgagcccaggaattccagatcagcctggtcaacataatgagacctcatctctactaaaaataaatattagaaaaaaaaattaac

SEQ ID NO: 128399 - DNA, 501 bp, Homo sapiens
tactctaatgattatttcttttgttgtgcagaagctttttagtttaattagatcccatttatttatttttatttttgttcatttgcttttgggatcttagtcataaattctttgcctaggccaatgtctaggacagtttttcctaggttttcttctagaatttttatgatttcaggtcttaaagtctttaatccatcttaggttaaattttgaatagggtaagagatagggatccagtttcattcttctgcatgtgactagccagttttcccagcatcatttattgaatagggtgtcctttccctaatttatgtttttgaatgctttgatgagtgaccttttttttttaagagcacagatcagttattttataaatatctctccgtttgggtttgtgtgatgttttatcatgattggattcacattatttatttttgacaggaatattatggaagttatgttgtgtcctcactggtatatcataccaggagatacacactg

SEQ ID NO: 128400 - DNA, 430 bp, Homo sapiens
tgcagagaagggaatctcactatgttacccatgctggtctcaaactcctgcctcagttgatcctcctccatccgcctcccaaagtggttaaattaagccaacctgcctggcctttatgaggattctttatgcatgttttacccattggttgcattgtcatttgaaattgttaacctaattgtcagactaatttgtggcagctgccctaaaccagagctgagggattgcctgctgtgctttcctcctgagcaaggggaagttgagccggagccaggtagtggcaatcaataatagtggtactgttgacctctagctttgtggtaaaagatattaactttattaactccagacaaaaaatatttgccctttgacaaatatttgttcattgctataaagtaaattgccatttaattatttcataaaaaaaaaa

SEQ ID NO: 128401 - DNA, 143 bp, Homo sapiens
tgttcatgttttctgcagtagaaatttataaacccttatttatttgccagacatgatccctttagagaaatctagtatctaaaacctgaatttttaaaacaaaatttaaaatttttgtttcataaaaacaaaaatgtgattac

SEQ ID NO: 128402 - DNA, 122 bp, Homo sapiens
gtaagacacctctggggacgctgagtatgggaatcaaaggccagatctctggggtggcagcggaagcccaaagcaccaaagcaagcatgctggaaacccacagcctcctccacttagcagag

SEQ ID NO: 128403 - DNA, 913 bp, Homo sapiens
gtttcttgatctaaaatgctatgttatccaatgtgcttattaccttattacatttaaagttaagattctctgttatttctttgcagtgcagattacttaggacaaagacatatagacaattataagtttatcccatttactattcattgggaaatatcaaaataataaatttagtttagaaaaacatatctcctctgggtatatatccaaagaaaataaaatgagtatctcgaagagatatctgctcatgctcattgcagcattactcataatagccaagatacaaaaataatacgtgcccattgatggataaatggataaagaaaatatggggtacacacacacacacacacacacacacacacacacacacacacacacggtagaatattatttggccataaaaaaaaggaaatcctgccatctgtgactatgggaataaacctggaagatattatgctgagtgtaataagccaaatacagaaaggcaaatactatatgatctcacttagatgtggaatcaaaaaagtcaaattcatagaaacagagaatagaacagtgtttgccagggtccaggagatgaagaaaatggggagataacagttataggttgaaaactttcagttataagatgaatacgttctggatgtcttatgtacagcgtggtgactatagttagtaatactgtattctatgcttgaaatttgctaagagaacaaatttcctcaccacacacacaaatacacatacaaaatagttaactatgtgtggtgattgatgtgttcattaatttgattatggtaatcatttcacaatgtacatgtgtggcatattaagtcaacaaattattataacacctgaaatatatacaacatttatttgttaatcacaccccaataaagctgggcaaaaa

SEQ ID NO: 128404 - DNA, 450 bp, Homo sapiens
gagaggagaagaatctcaggaatgccaaggaggcatcatttaggaaacttgagaaaaactatccctggttgaaagagaactactactgtagtgtagcagaaagcattcatttcaagaagcaaggggatgtcagcagtgtcctatgccctgtagtgagggaagggtgagaataagactgagaaagaaagaaaaaactgacttggatggtttgagagtcatcaatggtaaaatcattacaccaccaattatgtttcaatattgcaatttgaccagaagtaagatcccaatcagaattgcaatctgcagattggaaagagatgaggtgagaaagaggagctagtcagtgcaggctgctaatttaacaattctaaaaggaaggaaaagaaaggtagggtgcacattgagagggcattgtgtgggaaagactgagggtccttcttacagaaaggg

SEQ ID NO: 128405 - DNA, 779 bp, Homo sapiens
gtacatttaaacaattctcaaattgcaatgaaatatgataccatattaaggtaggaaaatttagtaaataaaagaatgaatttttttttcttacaaatcattgcattttgctctactgaacttggtcaaattacatttgcttccatttccaaatgatttctttgaggatagagaaatcttagcttttgtggatacaacagtaaaaggttgaatcatttttcaatcattgcttttaattgagccctctgagcctcatgacgcagctaaataatgtttcctttaatgacatctcaacatatttcatgactttttcatctctttcagtattttaacaaactcattttagttgctgagagttggtccccctcattttaaacgtcattaccttgtctgatttaacatgctttcattccttccccaaaattcatttaccatcttggaatggagtgaaagagacatgagcttctaccatgcactttttttttctcttttactaactttatcctctgaagttggggcagtgctcaaggtcaattccatggaaattaatttgctgaaatcagttcaccaaaaaacaattattctaatggtcagattgccaaatggttgattggatgaaaaacctatttgtttcttttaactatacataaattctatagcaatttcatattgcatgctatttctgtgggttttaagttttttatgagggttattttaatgacttttcattttatcttcttttacagcattttatactttcctgccacatatggttgtgt

SEQ ID NO: 128406 - DNA, 568 bp, Homo sapiens
cgcattggctcacacttgtaatcccaccactttgggaggctgagggggcagatcatgaggtgaggagtttgagatcagcctcaccaacatagtgaaaccccaaatctactaaaaacacaaaaattagctggctgtggtggcgcgtgtctgtaatcccagctgctcaggaggctgaggcaggagaatcacttgaaccccggaggcagaggttgcagtgagccaagattgcaccactgcactccagtctgggcaacagagtaaaactccatctcaaaaataaaaaaagtcattcatgatgaagcctccctgtttacttccatctattctgtagtggtccacagtacactggtaaatttcttttaagttttattcaaaaagtacatgtactgtttgaatcctgaaccaggggcagggccatctatctgcccatgaacacaacttccttggggccaggccagaagagaaatgttttgttagaaagaaggtcaaaaaaaaaaaaaaaaggagaaaaagcccacacacaaaaaagttacagaagctacactacccatacagagaaagatgcagt

SEQ ID NO: 128407 - DNA, 400 bp, Homo sapiens
cctggtcagtctcgtggttgggttggggtattcctggtcagtctcgtggttgggttggggtattcctggtcagtctcgtggttgggttggagtattcctggtcagtctcgcggccgggttggggtattcctggtcagtctcgtggttgggttggggtattcctggtcagtctcgtggttgggttggggtattcctggtcagtctcgtggttgggttggggtactcctgagtcagcttaatgtcccttgactgcttcctcccacacccatatttaagcctcagtcaccctgctgcaggggctgtcacagcagcaactctggcaaagccttccacacagctctttgtctcccctgccagctgctgggggatcctgactgccaggctttgaaaggctcacctg

SEQ ID NO: 128408 - DNA, 260 bp, Homo sapiens
ttgtagtgagccgagatcatgccattgcactgcagcctgggcgacaagagcgaaactccgtctccaaaaaaaaaaatcttactactcctctcaactcctgctattatctttgttattttcagcaaccatgtagatgaatccatccaataatatcctggcatagttgttgacctcattatcatttctagtccacttagctctctgccttgtcatacctctgaaatgttccttcactaaaatcgtaactctaggtaacctcc

SEQ ID NO: 128409 - DNA, 196 bp, Homo sapiens
atcctgaaaattccagctcttgcagacactatgtggagtacagatgagccatccatcaagccctgcccaaattgcaaaatagtgggcaaataaacaactgctgttgatttaagccattaattagaaaggtgaattgttatgtaccctagaaaaccaaaacacttcatttctctccctcctttcaccccatcctacc

SEQ ID NO: 128410 - DNA, 712 bp, Homo sapiens
tgcctttcactttcactcacattagaattctctcccaccctttttgggggaggatctattaataattatctttcaatatttagttcaacaaacctggaagcatcacattacctgacttcaaagtatactacagggctacaataaccaaaacagcgtggtactggtacagaaacaggcacatagaccaatggaacagataagagagaccagaaataaggccacacatctgcaaacatctcatcttcaacaaagctgacaaaaacaaacaatggggaaaagactccctattcaattaaaatggttctgggataactggctagccatatgcagaagattgaaactgtacctctttcttatactgtttacaaaaatcaacccaatatggatgaaagacttaaatgtaaaacccaaaattataaaaaccctgaaagacaacccaggcaatacaatcctggacataggatgggcaaagatttcatgaaaaaggcaccaaacgcaattgcaacaaaagcaaaaattgattaagtggcatctaattaaacttaagagtttctgcacagcaaaagaaactatcaacagagtaaacagcctgcagaatggtggaaaatatttgcaaactatgcatctggcaaaggtctaatatccagcatctataaggaacttaaatttacaggagagaaacaaccctattaaaaagtgggcaaaggacatg

SEQ ID NO: 128411 - DNA, 686 bp, Homo sapiens
gtcactcccaagactgagttaggtgcattcctatatcgagatactctattgtaatttctgttttcctgtagatatttccatagtcatagacctgtttcctgtagacagaaattctgccttactcgtgattcgagcttcagctctttgcatagcgtctagcccatggtagacactcagtaatcactgactgagttaaaaaagaaagaaagaatgaaataaatgacttaatggtattaatcatacaaacaacagctttaaacaacagtgaacctcttgaacatccaattttttttttttacttcttgagtgcaatactgacactagagaagcctaaaaggtaagggaatatacccctcttatttcacacaggatggtatgaacaataatagctaaaatgattgggtgcttagtgcagacaccatgaatgaagacatcttatttaatatgcacaaaatccttgatacaagtataattaacatcatcattttatggacaaaaaccctgagttttagagttttctaatctgttcaacatttcacagctagtgagcaatgaagtttggtttgtgaccaatctgacacccaaaccactacgtaattgtctccaagccccaacctctacagccaactcagggtctgaactacgactgcagttctaaacgttgtcccatacctctagcacattct

SEQ ID NO: 128412 - DNA, 463 bp, Homo sapiens
acaccccccaacacacactcacacctgacttatacaaaggcctccaagccaacagaggtgcccttagccacagaagcccaggagccactaaaggaatgaggaccatcaaggcatggcaactcctggccaaagatagcagctggagccccttctaagaggagacgaaatcaggggcatggcacccccgatgagaaaaagaataaaagaggtttggggagggggtctggggagacacagggtagcagccaaacgttttctaagacagtgagcagtcaggagggtgaggcagaatgatcaagccctccaaacccagggggcgggcccaccatgccaggctctttggagggaggaagggcaacatgagatggaaggaggggttccctgaaagctggcctgggagcggtcgacacagacagcccactcagcaccaactgcacacacagcactcctagctgtgggtcca

SEQ ID NO: 128413 - DNA, 511 bp, Homo sapiens
tacaccattttcagaagatgtgtctccatacgcgcctgtggtagtgtcaaagagctcctcaggcaacagtgctacacatagattgctcaatgcccaacagaaaataccactgtcagaacatgaaggttaatttgtctggagcacagaacatttttggagataatcctggaaagataaccagcctcaatatggaaaaccacagaaatattccactccattcctggcagatgaattccaaactgtatgcagagacttaattaccccataactataaactatgtttaacaaatttgtaggggtattttagccccagaaactttgtgatctgtttgtagatatttattcatcactcataatttcctcctaattttcctgcaccttgtgcagcatttagaaggttaaattttgtttctgttagaatccaaggcccctcatgtaaattattagtggctatcagcttgtcttttgaaaactgttgctaaactacagatcagccctgtgataaatgtga

SEQ ID NO: 128414 - DNA, 290 bp, Homo sapiens
atggcacatgacatacatatagtatgattccatttatatgaagtatctacagtagtcaacctacacagaaaacagaacagcagttaccaggaggtaggggagggaacaaagcgaagttgctcaatgggtacagggtttcagttccctaagatgcaaagaggtcttacaaatatgtttcttagtgtaagttcacttaacactactgaactgtacacttaaaaatggttaacatgggccagcacagtggctcacatctgttatcctagaaccttgggaggccgagtcaggca

SEQ ID NO: 128415 - DNA, 2294 bp, Homo sapiens
ttcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccatgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccgctttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctg

SEQ ID NO: 128416 - DNA, 629 bp, Homo sapiens
ggtttcactgggatcattataaaatatttgctttggttgatgcagtgaatgcaactctttatttgggaaaaaaaaatttagtaaaatataaaagaaaattcgatatttaaaattccttgtgctgtgaaaatttatctacttgagtcagctaaagatagtaaaattacatttaggttaatatcattccgctctctaaactacttcctaagactattccggtgagagtacttcagatgataaggggcaaaatttcctaggaaaacttatttaggtggaaatatcctaaagaaactcaattaaaactgaaatcggtcagagaactaaaaagttttatctttaaatacacactacatcctacaatttcttccattgtgccctattttgagaatttatcttacaaaacattatttctattatagcaagaataagagcatggtgaaaatattattgattattgccaatgaaaaacactggtttttgaggattctgttccaagtagccttcatgatcttcctgaaaaacctgttcttcatgctgggatttgcagaatatatagaatgatcttctgtgggtgtcagaaggaggaaatgcctaaggaaaagaattctgtaaaatttatttggattacc

SEQ ID NO: 128417 - DNA, 545 bp, Homo sapiens
tgacgcaaaccatccattgagaggggggctgagctgcgatggagacccagggtctcacttcctactcccatgctttttcaactacaccctatagacaccttagacaccagcttaaaacctggaaaggttacatttagtatgtttatgttcttacccatcatccacattccattaagacaccttagtatccagagaactgtgataaatgctgtaggggtccaagatataatctctgtcttcaaggtgcttgtatcctgtgattcaatgacattttgttacagtcattcaagagaagttaggaaaggtttaatgatggagaagggatgcaataggcttttagcataagcaggctttgtaataatagaaaagagctggtgggctggccagacatgtagtgataatagggtaaataaattgaagtgggaagatgttgaggagatgcaagaaagatgtgagtctggttggggcttcatgaaggtagatgccacagttttttcttcagactgtagacactgaagactcgggctgatttagaatgaaagaat

SEQ ID NO: 128418 - DNA, 641 bp, Homo sapiens
tgacgcaaaccatccattgagaggggggctgagctgcgatggagacccagggtctcacttcctactcccatgctttttcaactacaccctatagacaccttagacaccagcttaaaacctggaaaggttacatttagtatgtttatgttcttacccatcatccacattccattaagacaccttagtatccagagaactgtgataaatgctgtaggggtccaagatataatctctgtcttcaaggtgcttgtatcctgtgattcaatgacattttgttacagtcattcaagagaaggcaagagggcagatgactaatttccctgtaaaccacatagcctataaggcttccatgagctctgagaaagggcaggatcactgtggtttggagaagttaggaaaggtttaatgatggagaagggatgcaataggcttttagcataagcaggctttgtaataatagaaaagagctggtgggctggccagacatgtagtgataatagggtaaataaattgaagtgggaagatgttgaggagatgcaagaaagatgtgagtctggttggggcttcatgaaggtagatgccacagttttttcttcagactgtagacactgaagactcgggctgatttagaatgaaagaat

SEQ ID NO: 128419 - DNA, 232 bp, Homo sapiens
ttttaggctagcttattcacacaggggagctacaaaatacccaaacatttcctcacgtcattctgtaggttaacatatttatttgcagagaaattctaagttgtgattgtgacttttttttttttcccgctctgtcacccaggctggagtgcaatggcatgtctcttgggtcactacaacctccacctcccgggttcaagcgattctcctgcctcagcctcctgagtagctg

SEQ ID NO: 128420 - DNA, 368 bp, Homo sapiens
ttggtcaaagaaaaagagtcattagtttctgaagggcactaataggccaagtaaaggaacttggattttatcctaagggtaatacggtaggaagccactggtgtccaaatgtcactaccccctctctaatgataacacccgtttcttcctcttttgacttttatcttttactttttttttttttttgagatggagtcttgctctattgcccaggctggagtgcagtggctcaatctcggctcactgcaacctccacctcctgggttcaagtgattctcctgcctcagcctcctgagtagctgggattataggcgtgtgccaccactcccagctaatttttgtatttttagtagagatgtggtttcacc

SEQ ID NO: 128421 - DNA, 170 bp, Homo sapiens
atccgcccacctcagcttcccaaagtgctgggattacaggcgtgagccaccgcgccttgccaatatgtattatttatatgctttgttgaaataattttaacaaaatatatgtttttgttgttgttttcaagtctttcctttctgagtaggactgtgctatgtgtccaggg

SEQ ID NO: 128422 - DNA, 126 bp, Homo sapiens
caaagtgctgggattacaggcgtgagccaccgcgcccggccaaaaaaaccacaattttaataagcttgtttgtgtggctgctgtcagacagttatgaccagggaagggaggacacaggaagctcta

SEQ ID NO: 128423 - DNA, 604 bp, Homo sapiens
cacttcaggatgtgattcaggttcaggtttactctattcaggccctgggctgaaagagaaggtcctacctgggctatgcccttgtagtggcagagggcactaaagcaagagaactggcagcactgggaaatgcattgaaaagctcatcaagtctgtttgcattgtgttgaccaagcaagtcatgtggctaaacccagtcattggtcagcaaagctactcttcctatagggaactattgtaagtcacatccaaaggttttgggaacaaataattctgaataataatacccaaggtactacaatgtactacaaatatttcagctttctgtaagtagccaaaatatcttaatataaaacaaaataacctcttaattttaaaaaaataagtataatattgaatacactggtttaggttcagaatttttagaaagatcctcactgtaagattttcccaaataatcacctaattccatgggaaataaaaaataggataaactaatagaaatatttctgaaacaagagtcatgaggaatccataatcaactgtgctaccttttgactatttaactttgcatctcaacttcctcatctgtaaactaagaaag

SEQ ID NO: 128424 - DNA, 574 bp, Homo sapiens
tacaaaagtgcatatttgtgggctgggtgtgtatataaggggtgtgtgttggtatgtttgtgtatacatgagtatgtattgcatgtgtgtagtcggatttgtgtgtctgtgtttatgtattctatatacacacaccacacacacactgcagcttgatggcttaagccactggaggtgtgagatagagaagagaacattttttttttcatgattagaacatttaaatgcctaatgaaataggtcattttagaggaagctctttggaagatatgagcacactgtaatttgtcgcctttttcactgatgtttactttccccttgccactcctctctgaaccttagtctggaagcccttccctcggcttgtcctcaggctttgatcttggctctggctaggcccgcctgctgtctattaatggttattaatggattatggattggcctgtccaccactttggcccatcaggctggtcgtatgaaaagcgacgtcgtattttgtttctggtagtttcgttgctcttagatacctgctccctttcctgagctcatttcttcaaggcttcttcattcttct

SEQ ID NO: 128425 - DNA, 459 bp, Homo sapiens
gagtgaagtggcacaatctccgctcactgcaacctctgccccccaggttcaagcgattctcctgcctcagcttcccaagtagctgggattacaggcctgcgccaccatgcatggctaatttttgtatttttagtagagacggggtttcgccatcttggccaggctggtctcgaactcctgacctcaggtgatccacctgcctctgcctcccaaagtgctaggattacaggcattaccgcacccggcctatcctggaactctctattatgctccagatgcatagactcagctgcctatttgacacttccatttgttccccaaactgttctgttttgtaagttttcaggtaactacactataaccaacccaatttttttttttttttgagacagggtcttgctctgttgcccaggctgtagtgcagtggcaccatcatggctcactgaagccttgacttcc

SEQ ID NO: 128426 - DNA, 894 bp, Homo sapiens
  misc_feature (477)..(477): n is a, c, g, or t
ttatggggggtggggggaaggccagtcatattatcaatgcccttgtggataagaaaactaacatccagagaaattaagccacttagtaaaaatcacataattaaaccagtggcatagctagtaataattttcaattaataatccaggatactctcctaattaattttgcttccactcctcttaagataatggcttctgagataagaccccagttgctgggccaggcacagtggctcatgcctgcaatcccagcactttgggaggctgaggcaggcagatcacctgaggtcaaagggtttcagaccaacctggccaacacggaaacccccgtctccactaaaaataaaaataaaaaatcagcccggcgtggtggcccgcgcctgaataccagctactcaggaggctgaggcagaagaatggcccgaacctgggaggtagaggttgcagtgagccgagatcgcgccattgaactccagnctggatgacaagactgaaactccatctcagaaaaaaaaaaggaaaaaatcaatttgtggggggcttgggcctgggaaaaagttttttagacacatcgtggggggcgcgggccggaggtacgtggcactgggcatagcggttgccagaagaaccggctcagacactaggcgtcgggattctcaccataaaaagccgcgggaccgaggttggaacaccgaggggctcgcggccttcggcatcacacggagtcaggacgctaacacaccgcgtcgcgcaggtgacacgacaggaagcccaagaacacgcaaccaacaacaacaagacacccagagcacgacacgaacacatgaccaggacaccacgcaagaagacccgacacgaaaccacaaccaacacatcaacgaagagacaccacga

SEQ ID NO: 128427 - DNA, 499 bp, Homo sapiens
ctgctccgcctctctctgaattccaaggccccatcagatcagaatgaaatgagaacaagccccagagtaccattcctatcaactcctgtcttctccacaccaaagaaaggtagagcattttggaagcttctacatgaagtggccccagcagggtggacaggatctagctagatggttagtaactgaaatcaccatgctcctctgctgtccgcctccttggggtcacaaagtactctcccctccacaacagcattaatcttcccacctgcatgggaggaaggcagggcacactcagatcactatccccattttacagggaggaagcaggaacccagtaggggaagcaacttgcacagtgacaggacaggtaaggggtggagcctgggctggcagctctgccagttgacagggctgctccaagcttttaattgtgggggtggggttgctgggttgagtttcatcaagggcagctgctctcaaagccagcactgggctgagc

SEQ ID NO: 128428 - DNA, 513 bp, Homo sapiens
ccacttcatcctcctgagtggctggtactacaggtgcatgccattatgccatgctaatttttgtattttttgaagagacggggttttgccatgttgcccaggctggtctcgaactccttggctcaagtgatctgccagccttggcctcccaaagtcctgggatcacgggtgtgagccaccgcacccaggtaaaacttgtacaattagtttctaagttcttatttgtgtatttgcttgtttgttttttgtttcctgttgtctgtcaccagactataagccctgtgcgggcagtgaccatatctagcttgttcactgttgttatactctagtacttatcccatggtaggcactcaagaaatacttacacatcccactaactctgggaagttgttgattatctggtgtcgtggtggcaaaaccacctgaaagtaatcaaaggaagccacttggttacatttgaacttgttgttattgttctgagctttttggtttctgctgaggatatccttttcc

SEQ ID NO: 128429 - DNA, 727 bp, Homo sapiens
gaacacacaaaaccaaaaattttaaaaacccacaggaagtcaaaaatttttttaaaaaagacaaatcctcaattgtggttacagactgaaactcttttctttcgtgtgtgtgtgtgtgtgtgtgtgtgtgtgtgtctgtgtgtgtatgtgtattttatatatatatatatatttttttaaagcaggcataatattggtaagaatttggaaagactactgttaactcaatttacctaatgacatttgtaagttagtatgcaagaacatctggattattcaccaagatagactatattctgggccataaaataaacctcaccaaatctgaaagaacagaaggcacatgaaatatgatctcaaattgctagggatttaaattagaagttaatatccaataggtatctagaaaattcctaaatacttgggaattaaacatgtttctaaataacctgcatgtcaaaaagaaagtttcaaggaatttaaaaataatttgaactacatcaaagtgtaaataaactatatcagaatttgtgtaatgaacaaagccatgcttagaggaaaatttatacaactaaattcttatgctggaaaagaagaaagatcttaaatcaatgatctaagcttccctcttaagaaacaagaggaaaagcaagttttacccaaggcaagcagaaggaaagaaataataaagatggcaacaaagacaaaaaaaaaaaaagaaaataaa

SEQ ID NO: 128430 - DNA, 186 bp, Homo sapiens
agtgggaaatggagttacggtttccccagcggtggagtagggtaatgagtcaggagggctggtgggtgctcagtgcttcatagcatcaggcacacaggtggtcccagggattcgagaagccagaaggggtggctgggagtgttgccatgtggttagcacagacgggccgtggcccagggagaggat

SEQ ID NO: 128431 - DNA, 386 bp, Homo sapiens
ggtaagattatgcctgcctgccctcctcgctccctttgttccccgtgggaaacttaaacctaaattattgactgtctagcctttcagaaagaaaattctggccaggtgcggtggctcttgcctgtaaccccagcactttgggaggtggaggcgggcagattgcttgagcccaggagttcgagaccagcctgggcaatgtggccaaaccccatctctactaaaaatacaaaaattagccaggcatgatggtgtgcccctgtagtcccagctgcttgggaggagagggtgggaggatcacctgagcctctgcgggttgaaggtgcaatgagctgagatgatgccactgcactccagtctgggcaacagagtgagatcttgtatcacca

SEQ ID NO: 128432 - DNA, 766 bp, Homo sapiens
ggataacatttcctggtcccctttagaagaataatacaagattcagtgtcagtgtatggaagccaatcaatccccaattctgtcctggagaacacagggaaggcttcagagagaaggaaatttgagctgagaagtgaaaaattaacatgtattaggtatacatttgggataagggtatttaagttgaaacagtagcatatgcaagagaatagagacataatggtatggccttgtttactactggatgtaaagtgtgtgcatggtagattcttggaggcatgatgatgggtgggacaaattagcagggggctataccatgaagagtcttgattgtcatgctcatcactaatttggatatttatttatttatttggccatagcagttggaggattttgaacaggagatttatgtgatcatctgatagtttggtcaggggcatccagactagagtgactccatcttgattaaaggccagataaagccaaacctcctgggttacattcccaaggggttggacactgttggtcacaagatgtttagggttgagggaacaagttaatgatgctaactaacgaaaagatgcttatgaaacttatgaaatgtttcagtacttgaagatcaaaaagcattcttagtttaagaataggttttgctttcatacaaaattagctgggcgtggtgacgcgtgcctgtaatcccggctactcaggaaggctgaggcaggagaatcgcttgaacccgggaggcagaggttgccgtgagcca

SEQ ID NO: 128433 - DNA, 172 bp, Homo sapiens
ctcacgatccgcccgtttcagcctcccaaagtgctgggattacaggtgtgagccaccgtgcctggcctaaaggcttcgttttaatgtccatgagccttaggcctgtatggaacagagttagaaatgcaaatctctatataaagcagggagccttgaaggttcatactcaaga

SEQ ID NO: 128434 - DNA, 328 bp, Homo sapiens
aacaattacttcttggttttaatggctctccatttggttacaatttctctggattggctctgggttggtcgaggtcccttttaaaatgtggccccagggctgcacaccacctttggatgctccctgaggctgcaggagcacaggccgtagttcctgtgactggacctcatgtttcctatgcagaggtctcaagagaatgctggtgtggctggctgttgcatcactctcatctctcatctccaatctgtggccaaccgaaatcctcagacattgttcacaatgactgctatgaaaccacatcactctcaccctgtactcaggcagctga

SEQ ID NO: 128435 - DNA, 463 bp, Homo sapiens
cagggctggggctgagcgggtaggagcaccccaacagcacccgccacacccctccaccttgcctgaggacagccgtggaggctcctttcaccagtcggggagaccaggccagggtgggatgcagccgatgggaacaatgtcccgggggagactgcgccaggcactggttccaagcccagcctaccctgaagcccgttcagctctctgagttcacatgtatgctgaggtaacagcacacctcctgggggggttccaggagtcaagggtcaaggctaaagccagggtggcctggtcctaataaagctaactggcctgagccaacatgttctacagcttcatagggtgtgttgaaccaaatggaattgctgctatttacccattttgaaccataaaaatggtaatttctttttcttttttgagacagagtcttgctctgtagactggagtgcagtggttcgatctc

SEQ ID NO: 128436 - DNA, 217 bp, Homo sapiens
cattttagaaatacttttgcggaaaatagctaaattaagaaggttcctcattaatgatactagtcattttattgttttactgataaagtgatacccctgaagcaattgaaatatgtaaggctgaggaaacttgcaataaaagccccagtatgctgtactttgaatctttttttgtgtgttttctcctattgtctgttatgttaggcattatgcctac

SEQ ID NO: 128437 - DNA, 482 bp, Homo sapiens
tgagtttataggagtctaccaggtgagttgagggggttagcatgggcatcaccacctctgcattcctaagtctttgatggtggtactcatcactgcattttctcctgggatgcagttttgcttcggatttactattttgaccagggttgtgttgccagggaggaagagcagtttcaggagcttgtgtttggccctttctgccatattggctcttacttcacaggtcatagaaccaatgtgagggtatgcttagctgactgttaagcatacctatgccaattttgcatttctcaagtggaggaagttatctcaagaatggattcatggacctgttaagcccagtatgaaacggtgctctaacctgaggccatggtagcatttggggtccccacatatcagtgccagctcagaccttgtagccacagcccttgaaaggtctgagtattttcctttcccagttactctggtaaatagccacagat

SEQ ID NO: 128438 - DNA, 331 bp, Homo sapiens
attgttcccatccttatgtacatgtgttttcaatgtttagctccgactttcaaacgagatcatgcagctaggtatctaagggaacatctaatatcaacggcaatactgcttaaaaactgttcaagattcatcagtgacacaaggatttatttattatcattttctataacactgatggtcttctatttctctctacatagtacattgaaatgcatttcacattatattacttagtctaaactactattttccccattattttatattactaccagtttactttatattgccaaggttctcataaagaaagtggaattgcataaggttcact

SEQ ID NO: 128439 - DNA, 541 bp, Homo sapiens
taaaccagagccctgctccgcccctctctggggtggagccgcaagctccaggttaattcctgagtttccagaaacactgaggccagcttcccttagacttgctctctagccagtgccgctgatgatgattgggggctgaacattcctagggtggggccctaggcctagggcctggcagggctgagtgtcagagggagttacaccttgaggggtggccaggcatggtggaccccatctccaattaggggacatcctttgtatcagtagaactgatgactctcaagccagggctctgaggttgggcttgagagcttgactcagtagagtgagtaggaatcttggaaacctggaatgcactacaaagtatggaatgcagtagatagatagtaggattaggacacaggatttggaatctgattgtcctgggttcaagtctcacactagccactaacagctgtgtgatcttggggaagttacttggcctctctgtgcctcattcccttacctttaaaatgggatattgttacctatttcacagagt

SEQ ID NO: 128440 - DNA, 721 bp, Homo sapiens
actggagtgggaataagaatgagagaagaaaagatggaggcagttacttatagacaactagctcaaatgtttttctacggaggggaacaaagaaacaagatggtagcttataggaaatgggatcagaagtatttcatgtttttctggctttgggtcatattaataaaaagttaaagactgaaaaccacaaaaccacctagtatacatgatttcaatccttaattttcaaaattaaaaaaaaattcttttcgtgcaaggccattgatatataaatattcaatagtggtacccctttaaaaagttattgtaagaaatgttaggacaacctagagatgtgagactttgttgttacctgcgtgtacagctcatttaacctctctctgttgcaggacagagaggggagaattgctggagcagtgtagcaaaaaacttgtgtgaccttgtgtaggcaaaaagagagggtatattataccagtaggaggggataggctttagagaggcacataggaagctcctctatggttaagaggtgggaaggcaaagtaagtgagtgtggatgctgccaaggagatagatctggtgttggctggttgtggatgtcttcttttcctgaacaaggagataaaccattatccccattttcctcaaaagaagaaagaagctcagagaggttacacagccagtaaggggcacagcagaactaaaattcagagtttctgag

SEQ ID NO: 128441 - DNA, 309 bp, Homo sapiens
agagtggcttaaattagatattttaggtgcttccaaaatttcaaatttctcaggaagcttgtgaagttctaaatttacctggatatctagaatgagtttgcgatttggtggcaagattatggaagaggatgtatgctggtttggaaacgggttaagaggaagaactgtgtgaattacttcactctgacagtgggatttaaggagaatagaagtgatggtcactgtttgttccacaatacataatgctcattgaatatacccaaaatgagccttttggaaaaagccctcagaaggagaaagagaaacact

SEQ ID NO: 128442 - DNA, 200 bp, Homo sapiens
tgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatc

SEQ ID NO: 128443 - DNA, 210 bp, Homo sapiens
aaaaagaaacactcttggcagttgtattctttattcttccatctactgtctgtctcccctttaagagtaatgatattggacacttgttaagcacctccccatgccaagcaccatgctgaatgctttattcacacaataaaggtgaataaatgcatggagaagtcactcagggctgggcgtggtggctcacacctgtaattccaacaattt

SEQ ID NO: 128444 - DNA, 844 bp, Homo sapiens
gcctaataaaaaggagcgtctatacaggagcttaaatgggatgtaccttgtagcattctgaggacaggcctgatttctgagaagggaaagtggtaaaagtattgtccagtcctttttaagctggtggctgagcttggtgaggtgtgtttttaaaagacctttagtccgttctacttttcttgaagaaggaggaccgtaagggatataaaggtttcactgaatactaagagcctgaaaaactgcttggctgatttgactaataaaggctggtctgttatcagactgtatagaggtgggaaggctaaactgaggaattgtgtctgacagaagggaagaaatgactgtggtggccttctcagaccctgtaggaaaggcctttactttattcagtgaaagtgtctatttagactaagaggtattttagtttcctgaatcagggcatgttgagtaaaggtaatttgccagtcctgggtggggcaaatcctccagcctgatgtgtagggaagggagggggcctgaataatccctgaggagtagtagaatagcagatggaacactgagaagttatttccttgaggatagatttccacgatggaaaggaaatgagaggttctgagaggtgggctagtggcttgtactatagcataacctgcctttgctggtgtgtggcgattaggcctggtggaacttccatcaataaatcaagcgtgatcagggtgaggaacaggaaagaaggaaatatggggtgaatatcaggtggatcagagagatacagtcatggaggtcaggtgtggtatcaggaataatgtgggaggccagattgaagtccaggccaggaacaatg

SEQ ID NO: 128445 - DNA, 635 bp, Homo sapiens
tctctggactcaggcgatgaatcaccaaatagagcactcagtattgatgaattataaaatacgctaaataaaaatctttcttgagatttgccttgaataagcaaggcgcagtggctcatgcctgtaatctcagcactttgggaggctgagggggtggatcacctgaggtcaggagttcaagaccagcccagccaacgtggtgaaaccccgtatctattaaaatacaaaattacccaggcacgatggtgcacggctgtaatcccagctagtcgggaggctgaggtaggagaattgcttgaacccgaaggcagaggttacagtgagccgagatcacaccactgcactccagcccaggtgacaagagtgaaactctatctaaaaaaaatattaggttaagaataaaagatgagaggaatttattaatatacactggctcttgtcacatataccttcttaaagtcagttttttgttaatgcaacgttagattttcttcatatatctttatcaataccacagcatgatgatggccttggttttgacacagggatcttgcctaaatgccagcgtttagccagatggtgaactacaaaattgatcttcctggggttccacatggcactgctgctctacagcc

SEQ ID NO: 128446 - DNA, 509 bp, Homo sapiens
taaggatctactactgtatgcccagtggtgtgctatatgcaatgggtaacatgcattgaatactgtaagtgatcttttctcttaagttactaataaactccttgtaaaggtaaagctaacacacaggaagcaagtagagaagtgcatggtactgattatcaaagctcagagaagttgctatttattgagcacctattatatctcaggtacgttaaatatttaagtgcagtgcctcattgagttgtttgacaatgatatgagggtcatactattgttatccccattttgcaaaaaggaaatggaacctcaggctaagtaagttgtgtccaaagtcacaaagccagtaagcagtagagtagcaagctgggccctgctccatgtgactgcaaaggtttcattctctcaagtacaatgacttaacaaatagagccaaatgggctgaaatagctaggggaagcttcctggaggaggtggaaactgatctaagtcttgaagagaaggtaggatac

SEQ ID NO: 128447 - DNA, 552 bp, Homo sapiens
gcccttagaaactctgcccgagccgttgccctcggggtaaagtcagctctgagcctgacgcctatccgcctccacagcctcatggaggcctctcaaccccttcccagcaccccctggttggttggttggtcggttggttggttgagtggctttattgagatactgtataatccatatccatttatcagtgtccaacttagtggctttagtacgttgacagagttgtgcagccatcaccacagtcaattttagaacattttcatcacgctaaaaagaaactcctaggccgggcatggtggctcacgcctgtaatcccagcaccttgggagaccgaggtgggcggatctcaaggtcgagagattcataccatcctggccaacatggcgaaaccccgtctctactaaaaatacaaaagttagctgggtgtggtggcacgcgcctgtagtcccagctacttgggaggctgaggcaggagaatagcttgaacccgggaggcagaggttgcgatgagctgagatcacgccactgcactccagcctgatgacagagtga

SEQ ID NO: 128448 - DNA, 632 bp, Homo sapiens
ggagccttgatgccaaatgaccacagacgaacatttccagccctggactatgtactgtcaaattggagagagaaataaatgtctctcttgtttaaccagtttatttggattttctgttatttgtaagcaaaccttgccatttatgttgaagatggcattgtctgtctttgttaatgaggggtgtctctttaaaacctacgaggtgttttcacaggtgactttgtaagttcattgtaaattattccacatgtatcactggatccccgtcatcttacatcttttctttcttcttcttttcacctagtgaaatagtgtgtcttttggagtcaggtacacctgttttatttttaacaagtttattgaggcgtaattacagaacataaaattcactgcttttaaatttacaattcagcagtttttagtgaatttactggtttacaaacattaccgtgattcagttttagaacatgtcaacccatttacgttatcccttgtgcctgtttgcagtaaatccccacctcagcctcagaagaccaccaatctaatttccttctctatatatttaacttttgggacatttcttataaatagaatcgtgatgtggtcttttgtattaccttgttttagtgagc

SEQ ID NO: 128449 - DNA, 677 bp, Homo sapiens
ccattgtaagctaaggttgagaataagttttagatagccacatgcatgggggcacattcaaaggatcctatgatcttaattggtaatatccattttttgataattatctttataatttctcttacagtaataagaccaaattgtacttgaagcccttttattttttcctatcagtatctgcttctcatgactactgaaaggatgaattgccaaactgtgccagtcatttgcatttttgaaggtgatacataacttatatgcaggctccttttataacactgggtattttgtaatcaaacattgtgtttgttagagaacctgatattttaagtccactttataaaaactgtaagtttaagtagtaataaacataagtaactacctttttgaacaattgtgtgttgaacagttaaatctcaaccttgactttttaaaaaatttacccaacaggtagagtcaacaaaaaattatagtccacatgtgtttaacaactctcttgttgaaacaataaaacaagccataggaaaggtgttttttatttttttaatcacttccttttctgctgagttaatggcacaatcattttggctaagagggaggggagagttgagtgacttattgtcgaactcttgggatgaacagatcatgtacaagaaaggatattcaataggatatag

SEQ ID NO: 128450 - DNA, 269 bp, Homo sapiens
atgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctgg

SEQ ID NO: 128451 - DNA, 199 bp, Homo sapiens
agaatgtgccaaataggttgacacagagtagaatattgctaattggacattaagccttagaatccagaaatccagcaggaacccccattctggagttagatttcattctgagtcatccacttcattgtaaagtggccattgagaagcacatcctgtttcccttcccttctgtctgagctgaaccacagagagcctcagt

SEQ ID NO: 128452 - DNA, 309 bp, Homo sapiens
ccttacccttacgtgtgatgcatctgtagcttcggtatgttgttgtgttcgttcatttgtgttgctatgaaggaatacttgagactgggtaatttagaaagaaaagaggttgaattgtctcatggttctacaggctgtacagaaagcatagtggcttctacttctggggaggcctcgggaaacttagaatcatgacagaaggtgaagtgaaagcaggcacctcttacgtggctgtagcaggaggaagagaggggaaggtgttacatacttttaaacaactagatcttagaaaaactatcacaagagtag

SEQ ID NO: 128453 - DNA, 166 bp, Homo sapiens
ctataattttttggccactgtattttggagctctttgttacattattttaccctgtaccctaacaacagcttcctacattagaatgtagagacaaaaaggtcagagattcctgtctgttttgctcatcagtccatccctaccaagtagaacagtgtctggcatgtg

SEQ ID NO: 128454 - DNA, 649 bp, Homo sapiens
caataacaaaaccatgttttcacttcttatattctgaccatgacctcatcatcacacacttcaattattgcatgtctagttatatagaactcttacattgcatagtgtagaattggccaactttttgccagaaattttttgaagtacagtaagtcttcaatgttatggataggtcttggaaactgtgactttaagtgaaacaacttataccaaagctatttttttcactcatcattatagtgaaacatttccttcaatgtttttttcaataacactgaaggaaacagtgttattcaaaaacctgctgtacgtggtttcacttaaagttatagtctcccagaatctatcattcagattaagtgaggatttactgtagttattccactatgtggaatggctctatgtcagttaaactaagtagagttattattttatgtatgtgctatatgaaaactgattgattatagttgtaatttctcattttcacatttggaccacttaaactagtacttatgtacaacatctttacagatgacatgaaatatggtacttttttctgtgaaaaaagtttgtgattctgtcaagtattacttcactgaaaaataatgttaattacaagctgttcatttttattgaagaatttaaaaat

SEQ ID NO: 128455 - DNA, 476 bp, Homo sapiens
tgctgcaacccttgatagtgaaaaggggagacaatttctgaaagcatcttaaggtcacggtacaagtaatgaaactgaggctcaggaggaacagcttgcctgagttcacccagcctctccttagcagagatgtggctggaaccctgaagccacttcccctctctaagtctcagtttctttatctgtgacatcaggataagcaagcaaacaaacaagcaaagcctgcacggtggctcacacctataatcccagcactttgggaggccaaggtgggcagatctcttgagcctaggagttcgagaccagcctgggcaacatagtgaaactctgtctctataaagaatgcaaaaattatccaggtgtggtggtgcctgcctgtagtcccagctacttaggaagtggaggctgcagtgaggtgagatcgcaccactgcactccagcctgggagacagagtgagaccctatctccaaaaaaa

SEQ ID NO: 128456 - DNA, 324 bp, Homo sapiens
gtcggtagcaacccggtcgggaaatcacgtgatgtgcccaaggtcatgccgttgtctgaaatgcttggcagctgcctgcacacagctgttgtgaatcccctcctgccccttcataccgtgccactgtcttggattgacccactgtgactgtgtgcactgtcttctataaggaaaccccagaaaacacccgtcatgaaagttcacaatggagagaggtcaccggtggggtctttgccttcttcactgtgactcttgcttccaaggtccaccttctcgttggccagcgctcatcaattaccattgcccctgcctgcctgttctcag

SEQ ID NO: 128457 - DNA, 386 bp, Homo sapiens
catggagaaacaaaagttacttgaaaatgctattctctaagtgaaaaagagaaatactgcaagtagctgtttttctttttgccacccagattaaaccagttttcatacattacaagagttcttggatgaattcatttattacaatgtattttgatgtggacatatgtcatgacttgacacttatttgcacatcatgtcattatgccatgaattgctcacttctgttgatggtgacaatgacagcagttacactcgtttctagcattatgttggttgctctgtgtataccatagctaatcctcccaataatcctgcgaagttgagatccatatcctcatttgtagaagaggaaactgatgctccgaggggttatgtgctttggccga

SEQ ID NO: 128458 - DNA, 791 bp, Homo sapiens
gacctcactgtaactcattataattacctccttaaagatcatatcttcaaatacagtcacattatgagatatgggaattaggacttcaacaaatagacttacaaaaggacacattactgcgtcagattttgtaaactatactaaagaaataaatataatttcttaggttataggagtatatattactttcttataacctgcttttcttacccaatatatatttgaacatttctgtgtatatttaaacacttacaatataaattttcatcgctatctagcattctatcacatagatacctaataatttatttagcagtcctaacttaaacttaattttttgaataagaaaaacattcatatggttcaaaatcaaaacaatataaaaagataaatacttccatcccacccctgttccatataagtaaccccttttattagtttcttgtgtattcttccaatgtttccttatgcaaataaaagcaaatgcaaatacatgctcttatttcccctactttcttacacaaagggaacacactatttacgctgtgctgcaccttactttttctaaaaagcaacatatttctgaagcttctccattatcagtacataaagagcttccccattctctcctatagccagaaaatatacaattgtgtagctgaaccatggtttacttaaccagtgtcttctatacaaggttgtctctaatttttcttctgttgcaaacagaggggcaaagaataaactcatacatgtcatttcctacaagtacagatgtattgctaagataa

SEQ ID NO: 128459 - DNA, 455 bp, Homo sapiens
ccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgc

SEQ ID NO: 128460 - DNA, 317 bp, Homo sapiens
tactagctgtgcgactttgggcaagtgacttttgcttggctgggcttcactttctgcactggtcaaatgcagaaagggtaatagacccttctggggttgtttggaggattaaagggagagcagtatgtccgtaataatcgcactgctggcacacagctagtgcttgaaactgtgagctgctgttaggttaggggcagcagtctggtctcctctgcagagatgggtctcagttaattgtgaacttaaacagtttggcactgaggctttggggtcattgccccagggccacccaagtaagcttgtctaattgagaggaa

SEQ ID NO: 128461 - DNA, 338 bp, Homo sapiens
cagaaatgttctttccctctgtgcccttctgtcgacttagcaccctgctaaattcaaaagcgaactctaaactccatctatatcatacattctttcgaggaattaactgttttctctcaaactgacattctgggctccacctctagcagttctatgtttgtaagcaccttcttcaatctctgtttccttccttaaaactgtggatagtcaccacagtaccaatttcccatgtgggtactgatgatgacttgggcatatatgtgtaagtaaattaggatagcgcctaaatgtttcagattaatctctaggcacactgaagtgattcccaaactaattta

SEQ ID NO: 128462 - DNA, 310 bp, Homo sapiens
tctttcctgcaaaagcccacagagcaaagcagatgaggcatcagggcccagatagcacaatgtacctggaaaatgtcacccctctccaaagtctgtgacataaacacagaataaacatccctcttctgtcctgctgctagactctccattccaagagaacaggatcagtatcttgtgctcatttgtttaatcaatatcaatcgccagtctattgtgcccaccaggtacactcccaaaggagtgcatgtgcccagtgcagaactgggtcttcatgagcacctgctatatgagcagactctttcttcctgtc

SEQ ID NO: 128463 - DNA, 273 bp, Homo sapiens
agggcagcaccacagagctccttccaaacgcacagccatggaggttattgtaaaacttcccgcacttggcattcagggtcacttgtgccttatgaggtttctatcatattcattggggttcagtgggagccctagatcctaccattcacttccagtggccctgactctgaatggtgtgaccttgagcaagttgcttcctagcagtgctgggtcttggctcctgatggaggaaacggaccagcccttctttaacatccccttgagtccacattt

SEQ ID NO: 128464 - DNA, 1870 bp, Homo sapiens
agcagataatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcatatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaa

SEQ ID NO: 128465 - DNA, 2160 bp, Homo sapiens
agcagataatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcatatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaaaaaaaaaaacgacagagaacaagcatcaaaaaacacaaaaatagagaacaaaaaaactgtgtgcgcgcacaaagacccagaaaaagaataagacaaactgtagacagacgcggagcacaaaaaaaggaaacacgggcgcagcagtaggacacagaaaacacgggagaagagacaaggaagggaacatcacccaaaaaaaaaccccggggaacaacacagcggtgcagaaaacaacaagggagaagaaggaagaaacagggcaaaacaagagatgcaaggcgagcgaaaaa

SEQ ID NO: 128466 - DNA, 704 bp, Homo sapiens
aagcttttttgttaaaaaccaagacacaagcacacaaattagcctaggcttacacagggtcaggatcatcaatatcactgtcttccacatccacatcttgccccactggaaggtcttcaggctccataacatgggtggagctgtcatttcctataataacaatgccttcttctggaatgcctcctgaaagatttgcctgaggctgttttacaattaacttttaaaaaaattcataggagtacattccgaaataacaataaagagtacaggatagtaaatacataagctagtaatatagttgtttattgccattatccccaatattatgtaccatacatattagtatgtactatacttttatatgactggcagcccagtaggtttgtttacaccagcatcactgcaaacaggtgaataacacattgcactgtaatgttatgatggctgtgatgtcactaggcaatagggatttttcggctcccttataatcttatgggaccatcaccatatatgtggtctgtcattgactgaaatgccattatgctaacacatattaaatatataaattaatttagtccttattcaaactcaggaaagtaagagtttggaataagctttatggcattacaaaagtatttatcctctttgtagaattcatcaaagcagcatagagatcttttatgaatatgcctaagtatgtggca

SEQ ID NO: 128467 - DNA, 352 bp, Homo sapiens
ctgggtggatagacagttgcttgtttgaaacattgatgaggataataataacacacttgtatggagaatccctggatgccaggcactgttgtaaacatcttacatgtaatcacttagttaatcttcataacaactcatatggaaggtacttctgttctccccagttttatatatggaaaaatgaggcccagatagagcttaggtaacttgcccagggtcacgcagctagtaagtggcagagccaggattctgattccagaagtcaggccccatgtccgtgtttataccatgtggctgagctgcctctcttcctggcgggtggcagacaggtgatggaggaagaccatttcct

SEQ ID NO: 128468 - DNA, 382 bp, Homo sapiens
cttccttgttcattagcctccttgctactcaaaaactaacatctcctgcctcagaacctttgtacatgcagtttccttcctttggacgctcttgcctcacatacgcttgtgcttgattcctcatttcactgaggtctctcatcaaacgccccctctgtacacaggccttatggtcagggactctgttttgagtctgctgtgtccctagagactagagcagagccctctctataataggaatgcaaaaccttgttgaatcataggattcatttattaatcaattacttcatgaaatttgtttttcttctgagtcaagatcttcccgtcacccaggttggaggacagtggcacaatcgtaactcaatacagtcttgatttctgg

SEQ ID NO: 128469 - DNA, 356 bp, Homo sapiens
attgttctgaataaattcactttttcctgcaataatgatataaggaatttatacacatctaactttttttaaatgttactttttatcacttttgttcgatttttactgattgttaatatacccttttaaatatctctattggcacagcaaagtaagcttttcagtttagtagctctctaacaaaatattttctaattctgtgctttaagtgaaataaaacggggatgaaagtggcaaaaccatattatcatgtccatgagcagccaaaaagaagtctttagtgaccagagaaaccttaacgtaaacagtaagaagcaagtaataggacagaaacaaacagattctttactcagaat

SEQ ID NO: 128470 - DNA, 654 bp, Homo sapiens
atatgaagaagtgtcattttgtttttcatttcaaaaatacaggccatgtgcagtggctcatgcctgtaatcccatcactttgggaggccatggcaggggtattgcttgagatcaggagttcaagaccagcgtgggcaatatggcgagacactgtctctacttaaaaaaaaaaaaaaaaagctgggtatggtgatttgtacctgtagtcccagctgctactcaggaggctgaggtgcaggaggtttacaccttcagtcacttcagtccatgaggttacagtgaaccacgataatgctgacagtaagatcttgtctctaaaaatccattttttaattaaaaaaatacacacaatcatatgtctgacaatggtttaatatgcagaatatataaagaacttctaaaacttgaacaacaggaaaacaacccaattttaaaatgggaaaagggcttgaatagaaattgctacaaagatatgaaaatggccattaaacataaggcaagatcgtcagtatctttacgcaaatgtaaatcaaaaccactgtgagattcaaacttactaatatgactataatttttttaaaaaatacaaaacctggaaaacatcaagtgttggagaggattggagaaattggaaccttcatacattgatgatgg

SEQ ID NO: 128471 - DNA, 693 bp, Homo sapiens
aaggtaaaggtaacaatttttaccttgataatataaaggtaaaaatgtagtagacagtatatggggacagaagaggaagtgtgtaggaagggcagagtgggaatattaatagcatcatcttttatagagagaacacactgatgtgattgaacaccaaataggggtatatgcatctgaaagtcacttttggtatgttgaccttgtatcctgcaactttgctaaactcatttattatatgaacttttatgtatatttcttggcattttctacatacagtggtgtctgtatagtttactatttacatgtgaatatggatagtttaatttcttcctttccaatttgcttgccttttatgtcttcttgaaatactgcgttggctaagacttgcagtaagaagttaaaagggaatgtttggagcacacgtatttgccaagtctctgatcttagtgtggctggggggaagcatttagtatttcattaagtatgatgttagctataggttttttgtagatattctttatcagtttaagaaaatttcctacgattactagattgttcagaattgttttaagatcatgagttgatatttcaattttgttaaatactttttctgtatccattaagataatcatgtgtttttcttagtcagtcattgtagcccattgtattgcttgattttctttattaaggtat

SEQ ID NO: 128472 - DNA, 387 bp, Homo sapiens
ttctgtttctttccccacctaacattttgtttactataaatgattgcagtcatcatcctaaagcatatgcaaaatctcccttcccctgactcacgtttgatgtacctgcctctggatatttttgaaataccttagggggagaaaaacagtagttttaagagctagtggacagtttccaggtcttaatgaatctgacaacctgcagcccagggccaagaggaatgaattctcttttccctgctctcttgatgaactcactgaccagccatgggcgggcaggtgggcaggcaaggacccctggccaccaggtgccagtgcatcagctgcatgaactcctggcaccagaactgccacctctacagacatgctcaaaagacaagtttggac

SEQ ID NO: 128473 - DNA, 549 bp, Homo sapiens
gcacacatgtgaacagctagcgccaatagctttggtcagcattaatatgctgggtgtagatcttctccctccaagactccatacattcagcgtcttaagaagcagacccagagttccagggcacagcctcagcagcccaaggccagctccaaggtcactggcctttcctgatttgaccttcacttgggatcaagtcttcctgaaccagaaacaagctgaatccgagaagcccaggcaggctgtgctgctagcatcctgtgtatttcgcttcatctctccccgttacagaccaggaattccaaattcctagcccaaggtcagagaggtctcactgatgcctgtgtagccacgtgaggatgggaagtctcatttgccagtaagcactacaggaagtgatggttgaacacgatgggactaataagaaggaaacgtagttagagtgatcttattcatttaaaaacaaaagcagcaacaatacagcagtcgaggaaaagaatcaattctatttaagcaaagcaatttaaagtaataaaaaatgtttccagcatt

SEQ ID NO: 128474 - DNA, 368 bp, Homo sapiens
tctgcgtcagcctcccgagtagctgggactacaggcgtgcgccaccacgcccagctaatttttgtacttttggtagagacggggtttcaccatattggccaggctggtctcgaactcctgacctcatgatccgcccgcctcggcttcccaaagtgctgaaatttacaggcgtgagagccactgtgcccggccgtgtttttggtttttaaaattatgactgataaattatttctgtaaatatctgaatggaatatcaacattttgattcattttttgaaggcaaattttaatctggtgatcaaatttcttaaagcatacttttaactccaaatttccactttaaagatagtaaagttcagaagattata

SEQ ID NO: 128475 - DNA, 419 bp, Homo sapiens
tgctcgcccctctctgcgtctcaaaagtgatctcttctcttcctctaaactcacctgaagctttcaccaagtatgctggccggttcttgcttccttttcctaactcctctgttgagcagagccatgggcggtgtgctgagaaacagcatcgggtccttggatgggttttctagggaaaatgcatgaccaatggcctaagcgtggctggacctagggtaggaaaagaatggaaggtagctgaggatggagctttgggaccctgtgtagcactgtggttaagatctcaggcatggttagcaacaaatggcatggggatcctcaacacctgtcgggtatctactatatgccagtctaggaatttcaacaatgaacaaatagacccattccttctcttcatggacttacaactttgtggggca

SEQ ID NO: 128476 - DNA, 653 bp, Homo sapiens
ccctcccccactttgtccaagagaccacagtgattgccctacacctgccccaacccatcctctctgcacatctgggtcagggcaagctttccaagacttacctggccagtcctcactgcccaccccctgcagtcctcttacctgatcatccctccatccctctccatcccatgtcccagcctgctcctgcccccgactcagctccttcctgccaggcttctgcatgtactattccttctgcctggactgccaccccctcagctcaagcctgctcccccgcaacggctctagggcagcatctccctccagatgccatgaccccgtagttgttgatcattgcccccactgggacataggctccaggggagcaaaggaagaggctgttcttggtcgcctctgtactgcccgagtccggcacagtggtcggctcatagccaatgaataaacattcccggaacaattctatgactctcaaattagcctgagcaccaaaaagaggagcagggtctgagttgtgggctgagctatcctggtgccaaggcaggccttccactgccacgtacacaccctgaaggcagagtcagcacgcccaaatcctgtggggcctgatggtgaccactcaagctcggacaaaccccaagtgtgatctcact

SEQ ID NO: 128477 - DNA, 481 bp, Homo sapiens
ggccagggctgaaaatggggactggggcattctactcactgacagctgcagccaggaggaaagcagagagggggaggaaaatgagacatttgtgtaagggatggactggggaaggaccaatgcagccccaggaatcaggggcccccagagggcagtgtttctaggagtgatggttaaccatggttattgaacaagagcattataaattcactttattacatttttggaattgatagtactctgtggaacagatgtgttctcttggaattgtccccagtcagagaggcgctgatggtcagcacgcagttttgatgaccaagggtgtgctccttctacctgactgaagctgcgggaagtgttgtagaaagagcctgctctgtctgctctcatattgattgtatgtaggcatttggggttttaaaactgatttcaatttggagcagtctttgcttcttgtttacaagatcgtttccaaaaatgg

SEQ ID NO: 128478 - DNA, 296 bp, Homo sapiens
caggacccaggcaggtaacctgggctggctcctggactcctttgtccaatcagaccacccacattttctgacatcagtgctgtccctggatgcactgggcacagctgtgagtgctttctcctgcagatctgggatagggctacaggaattcagaagaggaagctattactttgggagaaaaagggaaaaaattaaaaattaaggaagcttcatggaaaaggtgacatttaagctaagtcttaaaaagatgaggaaaatgtgtgtgtgtgtgtgtgtgtgtgtgtgcgcgcgcgcgt

SEQ ID NO: 128479 - DNA, 227 bp, Homo sapiens
acgtggccgcttctcaacacaaaaagccacaagtaactaaaaatatataacaggaatgtgcaccaaacaacacggaaacaggagatgcaagaaaacacagaaacatattaataataagccacagaagacaggccatgaggacacaaaataaggatatacagaagactaaacaacagaattaatgtatcatggaggtgtatacatatatgtatctccatatgtaaata

SEQ ID NO: 128480 - DNA, 155 bp, Homo sapiens
ggtcatgaactcttggcctcaagcgatcctcccactttggcttctcaaagtgctgaaattataggcatgagccactgcccccagacacaactaacttcttgaagctcttaactaacattaggcaccctcaaaaccattccttctcccagctgagc

SEQ ID NO: 128481 - DNA, 175 bp, Homo sapiens
tgatttggtgatccctttaagaaaccgcaggcggaggaatttctctgagagaaaataatcctactcacggggccccttggaggccattaaccccccgagtcccggcccccaccccgtccccgggcaggccctcccgcccacgcgcggacccgtgggatctcagaagctgcggccc

SEQ ID NO: 128482 - DNA, 529 bp, Homo sapiens
gagaaaacgtggcccagagatgagatgttacaaggagatatgactgctcccctcatatttaagagctcccaaggtagaaaaaggaacagacacccttgggtgatcaaagaaaacagaaatagggtcgaagaaaatcaaaactagagggagacagaggtaggttcaatacaatgaagaacacagaacaattattccagaagagtcactgtctcatgaggtagcaaggtctgcatctgtacaggtgagagcccacctatcattgagatgaagtcatctagaattcaagaaaaactttcagctcccttctaactgaaactccaggctcagttatctggtatagaaccctccagtaacccccaggtccctccaccttcttcctttgaggtcctgaccaagaaacacggtgccttgatcactctgtgacctggacacctgcatgttttccactctgggctcgaacccaagctggggtcttgaacattcccaggcactgataaagttgttgaggttattgcttgaagcacggaga

SEQ ID NO: 128483 - DNA, 676 bp, Homo sapiens
gtacagggctagatgtcagggtagtggttatgttggcaggtaaagaatgggtagtaactggaggggaagcaaaagagggcctcctgagctgtagtgatgatgcttatttctgatttaggttctgattacaaacgtgttcactttgtaaaggtttattgaactgtacacttaaaatttatatactttttatgtaatgatttttaaaagttttactttaaaaatatctgtacaagaagacaaccttgaaataaaacaattatggttcaaaacactttgcatttagatagtgttagactattaataattgccttgaaaattttgcaaagttgaataatctctgaactttgtgcttgagaataacaaagctttcctgcagagctaatgtttggattgcttatttttaatggcatttacaagggcttctctgaagtctcgacatagggttgtcatttttcccacttactgctttttcactgaggtttatagtgctttccttcgcgtccagaagaacgtgtttattagataattagagaaatcttgatactaaagttgcttttcagtataatcacttctgctggtaagtaaggttctactggtaaaagtaatgactacctacctccttggtattaaagggtagagagagaactttgaaaaatgctagtattaaaattaatta

SEQ ID NO: 128484 - DNA, 418 bp, Homo sapiens
ctagaagtctagttcgttctctcattgtgaaagcagttttcaaggcacaagataaatttttatagactcttgctatgttaatacaaaggaaaacacaactttggaaatgtttctaatgaattattctttctgaaggtggaaagttttcaaaatgacttttttaaagaggaaattatatattttttcctatagcgcatttataagataaatgaatatacctgaagggcttcttttttattgttgttttcctattaacatagcagcttttgttgtaaatattttcagcatgtttcacaacaaaaattctagaaaatttagttatttatatatggcttaacatacgattttccaaaagatacaatatgtaactttttgccaaatgtacactgttcacaaattaccaatttctcttgggtta

SEQ ID NO: 128485 - DNA, 395 bp, Homo sapiens
tccttgtctgctttaaatcatctcacgtcttcccatacatgatgtggcccctacctacttgtccaacttgttgcctttatatcctctccctcatcacaaggctctttccagccacagtggcctttctcttcctgaaacacaccacaatcacttctgctacagggcctttcatttgctcttccttttgcaaggaatgttcttttccaagactttgacacacatggtcccttctctttagatgttactccaatgtcaccttctctgagagtccttccttgaccaatgtgaaatagcccccctcataatcacttttacatgattctctattattacaatagtcacaactctattaatatctggatttatttatgtcttgtcgattttagaatttaaaa

SEQ ID NO: 128486 - DNA, 719 bp, Homo sapiens
actctcatgaacttttttaattgcctttccctggaccagctctagttctgctacagcagtcagtaacacacacagataagtgtacatcgccactagccctatcagtactttaacagtgagtcatatctttctcgactttctctgtgcctgtactaatttatatatactttttctccccctccacaatgggatcattctttatctgagtcatttgctatatctgtatatattgttttaaggggtgcatcttgtgttattttctgttctgcatttatatcccaaaactattgaaaataattttttttcttccagaaggaatgttcaaagtaatatttcttgttttgtaaagttaatgtctcttctttaacacagtggtcacaaagaaaatattttcattttgtctctgcttttaattatttctttaaacttaggttctaaggttctaagacagcctacatttatctcacaaattaattaggactatctttatgttccagtcatttgctcaaaatcctacactggttttgtctgggagcttgagacttgagaggactggtctagatctgcactatccaacttgatagccactagccacatgtgctattgagtgcttgaaatgtggctagtccgaattgagatgtgctgtaagtgtaaaatacacaccagattccaatgatgtagtgccaaaaaaagtaaaatattaataattgttttgtatt

SEQ ID NO: 128487 - DNA, 693 bp, Homo sapiens
catgcatggcttttcaaaacttaaatagacattcttcattatgggcctttatgtttgctttatttttttatccagtaagccctgaattcttaagatgaatttaaatttggtctaacagttaagtgacagagaattcatacagattcttgaacagtaaggtggtataatactctaaaaaaaggattatttttggtgtacagcaagatgcatgaggatggctccaacagaatagaagtgttcatgtaggaaaatcaagggactttaggacctgaggctgggacagactctccaggatgtggttggattttgggctaaacagtctttctgtggtcttgaggactgcctttatagtctgtgaaaccctatccttcaattgtggctttacagagtttaagaaaattttgttcgtatgcagatttctgcagtcttcctgttgccaggaagaacctacagttacacaggagtgtgtgtgtgtgtgtatgtatgtgtgtgtgtgtgtatgtgtgcagacacgtgtgtgtaaacacacaaagtagactgaacttaaacctgatttataggagtcaggaaacctgagtttctttgctttctccttgtgtaattttggttaagttgtgtaacttctttctttggagtttcttgtctgtaatctggaaattatttcccactcactccactgtgatgttttgagaa

SEQ ID NO: 128488 - DNA, 299 bp, Homo sapiens
agggtggtcatcctgctaagtcatctaagtaaatattcaccttcagaaatgtacacgctacacctcaacagaacaagcaagacagtgacagtgcctcccttggcccctttcccacctggaagtgaagacctaagggatggttaagcctgcatgcaggctgggcacggttgttcacgcctgtaatcacagcactttgggaggccaaggtgggtggatcaagaggtcagaagatcaagaccaccatggccaacacggtaaaaccccatctccaataaaaatacaaaaaaaattagccggtt

SEQ ID NO: 128489 - DNA, 263 bp, Homo sapiens
aggatctgggtggggacacagcaaaacaatatcatacgttgaacttcgttgtgtgtgtgtgtgtgtgtgtgtgtgtgtgtttgatgatcatgtgatatttttccttctgttaatatcatgtattacattgattgattttcttatgataaaccatccttcattcttgggctaaatcttacttgttcatggtgtatagctgggattataggcgcatgccaccacgtgtggctaattttttgtattttttagtagagatggggttt

SEQ ID NO: 128490 - DNA, 596 bp, Homo sapiens
acagtatcccattgtatagatgtacataatttatttaatcagttctgcattggcgaatattacagtttccaatttctgccagagcagtgtcataattgtatccatatgtcattttgtacttgcaagtttatatgtgggaaaattaatagatgtggtactactggccctgctaggggtttgtgcatagtttagatactacttttcatagaggttatagtaattgaccatctcaacagcaataatgaattggagtccctgtgtcccacagtttttcatacaacgtgtaaaacaaaactttataactttcccaactcattaggtgaaaaatactctctcagtgtagttttaattgtattcctcttcttatgactgagtttaagcctgctttagtccattgagaatcttttgtatagtactatttctataaattctattttgtaataacatttaaaatattagtagatattgccaattgtgatacacaaatggtaagcaataacatgaatattctctcattctcacctacactggatgttaaataattgactgagaaatgtatattcttgagtccttttctttagctaaaaataatagtc

SEQ ID NO: 128491 - DNA, 159 bp, Homo sapiens
agtgctttaaaaatcacttgaacaatacagtagagtagaaattatattatttttgcagacttggaaactgactctgttagaaagtgaaaaagtgagttttcaaatgatgctagtgtcatggttaagagcctgggtgtaagtcaaactgcctgaattcaa

SEQ ID NO: 128492 - DNA, 348 bp, Homo sapiens
atctcctgacctcatgatccgcctgcctcagcctcccaaagtgctgggattacaggtgtgagccaccacgcccggccaaatttttcaacaaatacatactcaagccaaaaaatggtgctttaacttatgacttaaaattgttgggactataactctagaaaaaatattgcagttgagtaccgaaagtattgataaatgaaatctgttttcaaagtgcaataattttgtagaggataaaatagaaattgttcacctaggagattaatacataaataatatttacagagcattgtcttgagaaatgcagtttgatgatgtttcagtttgagcaaaagatgaggctctaaa

SEQ ID NO: 128493 - DNA, 399 bp, Homo sapiens
ggaatagcaattcaatgtcataggagtgtggtgaaggccttagaggcaactccaggtcaaaggtggggaaccaaggactaagatcctgctcaaaggcccagagagaccgggaccagtgtcagagcctggagtcaggatggagtaagagtcagccttggtttggtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatacagggtcatggtagcctgtgtctctcaccccatgccttggaactggtgagttctggactaccctttcagacctt

SEQ ID NO: 128494 - DNA, 334 bp, Homo sapiens
tcagatgtgacccagttatcagaattagagttcacaaagatggacgtgggcttggaacaagcaaaatccccgtaatcagaattaaactccaaagggtgaggctagcacaatttaaggagctgttgctttaggccagatgtcataaactttctgcacaaggctagatagtaaatattttaggctttgtgggtcatacagtctctgttacaactacttagctctaccattgtagcagaaaagcagaaggcagccatagacaatatggaaatgaatgggcattactgtattctttatttacaagaacaggcagtctgtggttttctgacccctgttt

SEQ ID NO: 128495 - DNA, 462 bp, Homo sapiens
cgtgtggcttacacttgtaatcctaccactttgggaggcagagatgggaggatcccttgaggccaggagttcgagaagctatcagctttgtcagcccaaaagtggatatttttacttaaaaaacaaatgcagaagtgaaaagatgaagagcacttgtattggagtacactggcctgggtttgaattcagactccctcactaactagctagagtaaccttgggcaagttatttaaactaagccccagcttcctcatctgtaaacagaaataacagtgaacttttaagttgatgcaaagattaaatcagatgaaatacagactgcaagaggtataatgcctcctgtacattaagttaggtaactgaaaagattagggtaacctccccaaatgccaccttccaaatctgcaaaatgaggataattataccaatttaataggactgttgtgaggactatgaagata

SEQ ID NO: 128496 - DNA, 782 bp, Homo sapiens
ggggaggggatatattgaaacccaattttccatgacctggcgtcatgtgggatactgagagatcactgacacatggaacattctggtctgtagcatttagggaaaatatggatatttagcaaagatgtatctaagggacagcctaggtaacttatcagttcaatagtgaggtttctgatgtgcatgacatccaggggtgagatttctgctgttatatggtaggaaaaggaattgtatgctgttttctttactttaattgtttttagccaaagtagctgttatagctatatgctatggtaaaacactgcagcttttggttgttaggaaactgttgggttatctgggctcttctttttcccaagttctgaagatgaagagctgcctatcagaaggcacaaaaagaataaaacagtttgtggcttctgagacaaaaattgttatctatgacaataaataaatactcatgcatactgtattttttaaagttaaacaatatttattttcatttgtcttattagaaaaaaaaaaaaaaaaaaaaaaaattggcgggggacctgaaaaagcttccagacagtccggtgcggcggggccagtatgtaagggaaaatggccaaaggggtccgaaggacctgggcagcatgggggggtccaccaaaacacgcggcggccggggtcggacaccaggggtcttggctcggccttacaggccgacgacgccccgccgccgcccggtgaaaaaaaaaccccaaacagaaaccaaccaaaccacacaccaacacaag

SEQ ID NO: 128497 - DNA, 610 bp, Homo sapiens
cataaacagatatcccagttgctgcctcttgtctagtcatagtttctcctttcactctcaactgtcctggtttggaagataattgtatgtgttatgaaacaatgggaacattgaaaagagacatttacctctgcctggcagagatcagggaaggcttcctggaggaaggtgctttctgagctgaatcttgaagggtaactaggagttaggccaatcacagagggcataagcaggagctggtgacaacacatagcaggagagaaagagtcagagtgggtgagagggagtgtgtgtatttgcaacgtgtgggaattaggtatatctacaaattattggaacataaagtttgtagagtgtcactgtggatgggtagagaggcagagaccagattgtgagggttccatatgccaggccagtgagcacctactctgtgccagacattgtaggcattacttacattgtctctaatctgtccaacaactcgagaggaagacatcagtatccttcaaaagagaacctaggttcaggttgggttgtaattgccccagtttagaatgtaaaaatttgaatctaactctagatcctgttctttaccggtgggccagtggac

SEQ ID NO: 128498 - DNA, 237 bp, Homo sapiens
catgagatacaaatggtgaacacaggaattaactaggtaagtataactgatggaaagtaaacaaggggaagtgtgtcctgggcagagagtgggaacagcatatgtaaagcctgagatcaaagaaggccaagtgcagacaaaatgccatgggacacaacaagagatgtggctgaggaagtcagcaggggccaagtcatagggcacaggagggggccaggccagcagctgggcccatag

SEQ ID NO: 128499 - DNA, 591 bp, Homo sapiens
gggatgactgaggtatccagagccatctctgggccacagagtttgggcaaggagactgggatggtctgtgatggagccagaaccatgggacccagcatgtgggaccattgcctcctgggcctgcctttgtccaccctctcaacatgaaagaaaaggggccaaggcagggagaggcttcactgaaccagagggaaggatgtgccccagcttctccctcactatctaccccaatcccatcttgctctattccctaccctgcctggctggcatccctggagccagatgcttaccaccttccaggcagtgcccattctggcaggggaaaggcacttagaagttctgggctaggggaagccaggggccaaaggagcccagagtagtcacatgactcagacaaggagtcaaggagtgcttcctggaggaaggggtattgaagccaagacctgaagggctaggaatggtaaggcaggcaaaggggtatagggagaggaagtgtggcccagaggtgaggtcttgcaccacaagttcagagaaaagaaaggtccaggggaagggaggacaagatggaaggagtgagaggacagaggtgag

SEQ ID NO: 128500 - DNA, 197 bp, Homo sapiens
aaagtaaaataaaacaaaacccgactttcttttctgttagtctaatgtattttttcactggctagcttttgaatcaattttacaatgatcacgacaatgtcatctttatttaagctgaaaaatctttgttgggttcggagaaaaaaaaatctatcactcaaaggaaaaacaagaacaataacaaaaactagacatta

SEQ ID NO: 128501 - DNA, 449 bp, Homo sapiens
agatgaaaatgggggagggaggagtgtgaaggtcaggcgaagaatatgatgtatctttgtttttcctattaatcttcatttaaaatttgtgtgtcctggaaacccatgtctcttcctttccagttctagagttgtgttcctgtacgttacagcagggatcacactagtggcacactcaagtgttcttttgataaatgacatttactcttgatgtatatcaggatagcctccaaatttgggagcagagactataaatactagaaatagtcatcctttttaatcaaggaaggaaagcattttttggtatgggcagctgactggagattcttccgcatccattctccctgttaccaggtgatctcttgtattaataccttttaaaaagcccagttaccactgcacatctccctcagcatacttccccggattaggcccccttttctgcattt

SEQ ID NO: 128502 - DNA, 650 bp, Homo sapiens
cctagtgttgagatgacaggtgtgagtcaccatgcctggcccacctctggctattgtgactaatgctgccatggacctgggcatacacatatctgtttgttcatgtcagtttttgagccccccttattcagtttggtaaaatgtatccttcataaataagatgggcagggccacgtattatagtatttattaccatgctttcctccagagtagcatggaaataagaatgcagggaatgtgggaggagggtgttgttgaagacacctgaaggcagcacgtgcctctccttttcacctgcagctgctctcactgagctggcagtcatatgccattctttctttctttctttctttctttttgaggcggagtttcgctctgtcgcccaggctggagtgcaatggtgcaatctcagctcactgcaacctcaacctccgcctcccaggttcaagtgattctcctgcctcagcctcccaagtagctgggattacaggcacgcaccaccatgaccgtcatatgccattctatcatccaactggtctgtgctatgggtgactctttcctctgtgtcagggtgggtgtaaaagccccagggttgtggccctactatctggccatctctgctaaccacagccaccttccagagatgacat

SEQ ID NO: 128503 - DNA, 237 bp, Homo sapiens
tttggttaacggcctaaccagcatgtgtggttagacactttgcctgtttccttcattcactaaaattataacgtattttactgcaaatgtctctccatttaggcattgagtgtaattaccgttgagtctctgctgcttctagtgaattacctaattcttcttaattacttgctaaggagcctgacagccaaatggttttagtaatagtttaaggtaagaaaaaatgtaaacctggac

SEQ ID NO: 128504 - DNA, 177 bp, Homo sapiens
tctctcttggttctggaggctggaagtccaagacggtaacaggtgggaccctgtctgctctggcactcgggacgtggtgcgcaaacatcactgcaatccacccagctgtcctgcacaacgggattccagcaatggccaaaataaggctcacggaagagagcctgaggtcctccagca

SEQ ID NO: 128505 - DNA, 345 bp, Homo sapiens
gttctttacttattccatctcattttatcctcatgaaattcctgaaaaataggtattatcaacatttaacagatgtaaggaaactgagaaaggctaaataacttgtctagctttcagttgcttccctagctttccgatgctcccctagttttccgatgctcccctaactttctgatgctctcctgtttacctgaggagactcaggcgtggtttgcataagagttaataccatttctttttctttccctcatttcttcctattgtaggctttactgagaaaaatttgatgttacctgaggtcaggagttaccatcctggccaacgtggcgaaaccccatctctact

SEQ ID NO: 128506 - DNA, 192 bp, Homo sapiens
cacactaccgcagtccagcccaagtgacagattgaaactccgtctcaggaaaaaaaaaaaaaaaaaattagggcctttggtattttgctataccatcttgcttatgtaatttgtataattgtataggttggatttgtaaagtatatttagagtcttatcaagtggagtcatttgttatttttatttctttca

SEQ ID NO: 128507 - DNA, 874 bp, Homo sapiens
acattcccaccaagaacatatgggcgatccacttcatccgcattctcaacaacatttagttgtgtctctgtgttttattttaggcattctggtaggtatatagtgatagatatataacttactctggttttaatttttatttctttaattggtaatgttgttgagtatcttttcatgtactcattttgccatctgcatatcctgttaggtgaaatgttactttatatctaattggatttttaggtttttttttatttttgagttttgagagttctttatgtattctacatactagttctttgtcagatatgttgcttgcagctgtttcctcccaatatatagcttgtctttctttttttttcttttttaagacagtctcgctctgtcactcaggctggagtacagtggtgagatcacagttcactgcagcctcaacctccagggctcaagcaatcctcccacctcagcctcttagtagctgggactacaggtgcctgccaccacagccagctaattttttttttttattattagtggaaacgaggtccctatgttgcccaggctggtctcaaactcctggtctcaagcagttctcccgctttggcctcccaaaatgctgggattacaggtatgagtcaccatgcctagcctccaatgtatggcctgtcttttaatagagttttgtagagtacaagattttaatttttctgcagtttatcagtttttccttttatggattgtgcttttggtgtccaaaagtaagaactctgccgagcactagcttccgaaatttttctcatacttttaatttttttaaaaaaattctctagttttacatttaagtctgtgatccattttgagatttttttttttt

SEQ ID NO: 128508 - DNA, 765 bp, Homo sapiens
acattcccaccaagaacatatgggcgatccacttcatccgcattctcaacaacatttagttgtgtctctgtgttttattttaggcattctggtaggtatatagtgatagatatataacttactctggttttaatttttatttctttaattggtaatgttgttgagtatcttttcatgtactcattttgccatctgcatatcctgttaggtgaaatgttactttatatctaattggatttttaggtttttttttatttttgagttttgagagttctttatgtattctacatactagttctttgtcagatatgttgcttgcacctcaacctccagggctcaagcaatcctcccacctcagcctcttagtagctgggactacaggtgcctgccaccacagccagctaattttttttttttattattagtggaaacgaggtccctatgttgcccaggctggtctcaaactcctggtctcaagcagttctcccgctttggcctcccaaaatgctgggattacaggtatgagtcaccatgcctagcctccaatgtatggcctgtcttttaatagagttttgtagagtacaagattttaatttttctgcagtttatcagtttttccttttatggattgtgcttttggtgtccaaaagtaagaactctgccgagcactagcttccgaaatttttctcatacttttaatttttttaaaaaaattctctagttttacatttaagtctgtgatccattttgagatttttttttttt

SEQ ID NO: 128509 - DNA, 744 bp, Homo sapiens
gaggtgggactaccacctccagccctggaaactctgctctgaaactcagccacagaagatgcaaattacagtggatgttcagcagcaccatgctgtaggagtttcatcccacaggtcccctgggtacaaacccctagccagccttcccacactactgggatatccctttgggacttccccacctctaactcgagaagagcagtgctctaaccatttactagagccaaggggagcttgtttttaaggtaccacctagagccataaaggaggcctgcctatgtgacctagcattagagagcctctaagcttgggaataagatagctgactagagatgcctggtattcatctcctccccacccgccaccccagacaagaaggaaccaaagcaaaaaataaacagctcagtgttgactggagtgttgaaggaagagtgctggtatgcaaaagaggagtggaaatgcacctgtggtgattagaagtccaggagggcagtgtggaagcacttggcctctgaaaccccttgtccctcatcaagatcagaactgcctaatgtcaggagtcacttattgcagataaacaaaagatccccaccatccctgattgccactgcaaacacctaaagtccttacaacaggagaatcccaccgtcacccagtttggagagctgcagggcattcacacagcttcattgccctagattaggagcacaatatgtgcactccccatcccccaactatcccctg

SEQ ID NO: 128510 - DNA, 690 bp, Homo sapiens
aaattctcaacaaatggtctttgatggaggtccttggaaggcaggtatgctcaccactataccaccagcaccatcagatggaggtctttggaggattaagtttgatgcttgggattgagtggtagtgaactgtatagaacacctaaattttggacaaatttatttggaaactacatgatgacagagtgcttctgaagtcatgtgctgggttcacattagttcagtaaatgttgaataaacttgtactctaaccaatttataaagagccataaaacagcttagttaacaaaattaaacacaatagaaaacagtttatttttgtatccaacgaaactagttaaatatagcagagaagtagatgtcagtagacatttgaaatgtgtgttcagattagtagaataaacatatcagcaagatccctagaagccaaggaaagaagcaggaaacttgttaagtcacatatctttgataaaaagtaagcaccaagctaactgaatcactctctaatttctggatttaagtagattatttaataggatcagtaaatgacactattgtaggggaaatttttatcaaccttctttaaagttgagaacttaatagtaaaggcattcattgaagaattagatgaaatgatgttttctgatgatcagatttaacaaattagattttagagactctagagaaata

SEQ ID NO: 128511 - DNA, 222 bp, Homo sapiens
tcaggaagatgggtgcaatgattcctcccatacaaggttgtgagaaataaaggacatcgaggctgccacacagtgaattctcatccaaaagttattttatcttcctgttccaaggagattattttacaagaatgggcacaatctctgggctatatcttcacatgcttagtatacagaaatagaactaaaatcctttaagtctctttcttttgaatcctgagt

SEQ ID NO: 128512 - DNA, 212 bp, Homo sapiens
gggctccgtgagctcctaactctagggcatgagaaggagacgatgccctccaggttgtaaatggcgttgcacctgcacctcacatactggcctcattcatcctccgaagacacccccatcctgagacgcagagccgacgccgcttgtctccagtcggagggcccctgagaatagtggcgttgcggggaggtgctgcagaggtgggtcaggag

SEQ ID NO: 128513 - DNA, 215 bp, Homo sapiens
caaatggacatctcctttcatcctatttactggcttctggcacaatgctaggtactggtgtggtcccaggaactgcccctagcttctctccctcacctgcaccatttacatcctgttagaatctctcagcttccctaataactgggtcttaattctatctctaaaagcccttcaccatgtggcctaactttccattcccactgcgactatctcag

SEQ ID NO: 128514 - DNA, 316 bp, Homo sapiens
agttttaccttagatgtttggttgcttttgaatatgaattgataacctttcatttactaatgttcaaactccttgcttttattttattaatgaaaatgaattccaatataacaatttcagaggggaaaaactatcattaattgcctaacatttttagcttaagtgtaatcggatgatcctttttttttggattacaattagggtttttttttctgtgccattgagattgtatatcattatatccttaccctgaaattattttatggtagtttatttatctgatcccttcacttgtctaggaagtactttagtggtt

SEQ ID NO: 128515 - DNA, 258 bp, Homo sapiens
ctcttcaatggcttcctatgacattaaaaaaaaatctctttactagggtcttcgagaaccgatgtgatccaaccctacctatctttcaacctcttatttcctccttattcactatgctccagccaagcagggctcccttctgttccattaacttgccaaattctctctttcttcaagacctttgctctggtgtttccctctgctttggatgctttctctcctaatcatagtgtgattgctttttttttttttgagatg

SEQ ID NO: 128516 - DNA, 273 bp, Homo sapiens
tagccagttgcctactctacctcttcacctgatgtcctacttttcagatccaacatgatgaaggccaaacttatcatttctctactgtggacagtaccacagatcgattcgctcagcaccactctgacactctttttttttttttttttgagacggagtctcgctctgtcacccaggctggagtgcagtggcgtgatctcagctcactgcaagctccgcctcccgggttcaggccattctcctgcctcagcctcctgagtagctgggactaca

SEQ ID NO: 128517 - DNA, 362 bp, Homo sapiens
aacctagagaagaccgagatgggatttaaaaaattgctgtcatggtcttaccttgcccagggctatggagattaatgggatgatatcagcaccaggctctgggcttctttgaaaaaagatgtccaacaataataacaaatactcagctggcatttatatatagtactgtaaagcttctcatcaaggagcagccatagttatggagaatgcattcgtcagcacacagggctgctattattattttataatccttgaaactgaataacaagagcaatacgaaattacccagaaagccatctcaacaaattaccatcacaatggaaacatcataaaatcttgagaccttgacagttgtgtggacc

SEQ ID NO: 128518 - DNA, 291 bp, Homo sapiens
tggcctatcatatggtctatcttggagatagttccatatgctgatgaatagaatgtatattctacagttgttgggtagaatgtgttgtaaatatctgttaagtttatttgttccggggtatagtttaaatccattgtttctttgttgattttctgtcttgatgacctgtctagtgctgtcagtggagtattgaagtcccccactattattgtgttgctgtctatctcattacttaggtctagtagtagttgtttcataaatttgggaacaccagggttaggtacatatata

SEQ ID NO: 128519 - DNA, 179 bp, Homo sapiens
accagcttcaacttcccactcaccactccatcctgactcccccgtaaacctgacatgtcttagagccagtaacactgaactcttcagccttcctcagatataccaggcctttgaggaagtttgtgcacacactattccctgtgcttagaacaccctggactctgagtcagattgcctgg

SEQ ID NO: 128520 - DNA, 437 bp, Homo sapiens
cccagatttcaacatattgttttcagaaagtgttctttctaatgatgaatgctgatgattactagaaattaaacatttattcagttgtgctaaatggatgaccaagcatcttttaaacgacaacatgcatgagctctttccctcatttagaatttgatttggaggatcagcggtccttgatattggaaccatcttaatccaaaacacagtaaaagcaccaaggacaagcaccggtgccaccgccgggctggaagaatcacccacaagagcggatgccctcacagctgggctcctgaggcccagggcccggaccctctcaccatcttctagcttgtctacgatcgaggcaaaagagtgagatgcctaaaggggtgtgctgtgagcatccacagcctacgggaagccctgttatttatcctccatctctgccttccaag

SEQ ID NO: 128521 - DNA, 137 bp, Homo sapiens
ggaaaggaacttctaagaacacatgttaggaagaagactgatctcaaaagaaatctctaagatatgaaataaaatgtgaattttcaaaaaataataactgaggctgggtgcagtggctcacacctataatcccagca

SEQ ID NO: 128522 - DNA, 442 bp, Homo sapiens
gaaaagactgtggcaagaaagggctaagttaactttcttggtatcagaccttgctcttgttaattggactctacatgtggcaactaacccacatttcagtgacacgactatgcaatttttgccaagggaagagtacacttgtataacgactataattttttctgtctttcccaaatcacctcaaaaacgtttttcttctaacctacctgatgctgccaagaccagctcagtcagggagaccctaacccagcagcgctagaggaattaaaaacacacacacaaaaatatagaggtgtggagtggaaaatcagaggtctcacagccttcagagctgagagccttgaacagagatttacccacatgtttattgacagcaagccagtgataagcattgtttctatggattatagattaactaaaagtattccttacaggaaacaaa

SEQ ID NO: 128523 - DNA, 558 bp, Homo sapiens
gcttcccaaagtgctaggattacaagcatgagccattatgactgtgctcagccctaagattctttacagcattgatagtttatggttccagtgcaggtgaaacaaaaattttaatgtaattacatatttattttcctcagtatgcttagattctgtcctaaagatctgaggacaaaatttagtaataaccgttgtgtaacttaattgatttctggttttgttgttagaggcagtctctgaagacggattgcattctaaaatgtagttagcaaacgtttaattctcagaatgcagttttccttggataaaactttcttccctgctcaaggtctcccaaatccctctcaaattggcttctcttttgttacaaattgtcgtgtatggcacctgattgcccaaaccagaaatcatctactgagtccaacaatttgcaaagagcagttggtacattgtctcaatttcctttcaatacactcaacctaactcctataagcagtcaaaccttttctgaattattgtaggggtcccgtgaccccaggctcttcttcagtctatatc

SEQ ID NO: 128524 - DNA, 733 bp, Homo sapiens
tgcggtggctcaggcctgtaatcccagcactttgggaggccaagatgggtggatcacctgacgtcagcagttcgagaccagcctggccaacatggtgaaaccccatgtctactaaaaatacaaaaaattagccaggcgtggtggcgggagcctgtaatcccagttactcgggaggctgaggcaggagaatcacttgaacctgggaggtggaggttgcagtgagccaagattgaggcattgcactccagcctgggcaacaacagcaaaactccaactcaaaaataaaaaaactcaaaaggataagtctgaggatatacaagaacttcaatatgactagacaaagaagttcaacacaacagacaaaggtctgtctgccagcaaggtcttgtacaaaagcagtatttgggctcaatcccatgagattcccagagaagactcgagcaggagatggattgtacaggaccttgctggctatgtaagagatttgggctgcatcctaagaggaaggccggggtggggtggagggctcaagtttctaacagaggaatggcatgattagtttcatgctttggaaagaaactagggctgcagtgagaatagaccggggaatgcaagactaaaggcagggaccccaagcaagagactgtcagggtaatgcaggaaacaagataatggtggccagactagggcaatgacaccagggatgggagaaactgcaaagcgtaacataata

SEQ ID NO: 128525 - DNA, 153 bp, Homo sapiens
gaatcctcctgcctcggcctcccaaaatgttgggattacaggcgtaagccaccatgcctggctgccacatattttaaatagatgagtaccactttatgcatgactccacgataagtgcgtatgtatgctacacagaacctagttggagttctg

SEQ ID NO: 128526 - DNA, 111 bp, Homo sapiens
agaggggggtggtgagaggggaggaagggaggaggcggaggcagagggcagaagacggggtctgtttgccctaaaacctcaggcagaatgataccctcttcccagcactac

SEQ ID NO: 128527 - DNA, 428 bp, Homo sapiens
gaaggtgaagagaaagtgaaaggattagaaaatctattactaaaacaacagaggaaaatttctcaagtctaacaagaaatgtagacatcctgacacaggaggctcagagatcaccaagtagatacaatttaaaaaggtcttctctggcccggtgcggtggctcatgcctgtaatcccagcactttgggaggccgaggcaggtggatcacctgaggtcaggagttcgagaccagactggccaacatggtgaaaccctgtctctattaaaaatacaaaaattagatgggtgtggtaacacacacctgtaatcccagctactactcaggaggctgaggtgggagaatcgcttgaacttgggaggcagaggctgcagtgagctgagattgcgccactgtactccaggctgagtgacagaatgagactctgtc

SEQ ID NO: 128528 - DNA, 221 bp, Homo sapiens
cagaacacaccacaaagttctgaacgtgctgttctaccagatttttggcaacattacatttcctgaatttgatcattgtattatgattatgtaagagaatacccttgctctcaggctacacacatgctcaactattcaagggtaaaggggcacaacgtctgcaacttaacctccaatgattcagcagaaataattacacacacacacacgcacacacacac

SEQ ID NO: 128529 - DNA, 472 bp, Homo sapiens
gcacccagacccggcctgtagtttttctttgacatctgcctaaattgtattaaacttgggacaattatcaccacccccccaagggagctggagaattgagtcacggatccctaaaaggaggcagaattgtctgtgccttgctggaccattaaggctcaatctctacaggcctttacattctcctccgttgctttgataccagtgggtatcgaggtccccaagcccgggtgggacctccccctcagccagtgttcaggctcttgacacagtcatgaaaatgaattcaaggacgagttggaaaagagtgaaaatacaggatttattgcaaaggggaaagtccacactcatgaaaggggactcgagagaatcacgtgcaaggggggttgaggctgctaccgttatgggttttttgtttgtttgtttgttttttaaagatggagtcttgttctgtccagcccaggctggagtgtag

SEQ ID NO: 128530 - DNA, 648 bp, Homo sapiens
accaatgtaaaagcgtatgaaggaaagtatgtaaagctcaggagtaaatgtacagtcaaatatagaataacataatactgtaagggtggtacagaaataactggtaaccccaatataaaactttaaagaaggctgtgtgtggtgactcacacttgtaatcccagtactttaggaggctgaggtgggaggatcacatgaggccaggtgtctcacaccagcctggacgacatagcaagactttatctctacaaaaataaggaacaacaaaaaaattatcagttatggtggtaggcacctgtagtcccagctacctgggaggctgatgcagaaggatcgcttgaacctgggagtttgaggctgcagtgagctaggattgcaccattgcactgcagcctgggaaatagagccgcatcctgttactaaggtagagtgggggaggggacttaaaagacaaaaaggtattaagggtaagtataatgacaaaaaattgataatggattcactgtatgaaaaatagtaaactctgacttcaaaaacacatagtgtaatggtaggtaaaagtgcagagttttgtaggccattgaatttaaattaaattcaaattaaattaaagtagacatcaaattaaagtagacagttgtaaccaca

SEQ ID NO: 128531 - DNA, 589 bp, Homo sapiens
gacggggtttcaccatgttggtcaggctggtctcgatctcttgacctcatggtctgcctgccttggcctcccaaagtgctgggatgacaggtgtgagccatggcgcctggtgtgatttttctgtaactacatcctacttattctggactaatgagaaaatagcaagggtgtccatcttcatcaacactgccttgtttgggacagtttggtacaggcttcaaggtttcagggccttaagcttttgcaaatcacttgctcaggaaaaactgggggacagcaggcccatttatattcattttaaacacttgacaagaggaagatgtcattttacaaagggtaaatgtttctttgggttatgctgataggttactgttagtgctaatttaaaaagacatggtgtgtcaaaatatggctaactggttcttatatatttcttgctaattcagccatgaataaaatggacttgtacatattgatacttcttatctattaaagaaatccactcattgttttaatcagtatataaatgtaataagtattagttttggaaatacaaattacaataaagagggaaacagaccatgtgtta

SEQ ID NO: 128532 - DNA, 575 bp, Homo sapiens
gtgtgtctatttagagtcatgagattcaatataaattttaggacagatttttctttttctgcaaaaatgtcactgagattctgaaggaattgcattgaatccacagctcactttgggtagcactgtcctcctaacaatattgagtcttccaattcatgaaaacaaaatgtctttccatttattgatattgtctttcatttctttcagcaatattttgcagatttcaggtataatcatttcacctctttggttattcttaaatattttattctttttgaggttaatataaattgaaattatttttcttaacttcccttcagattgttcatggttagtgtattgaaatacaactgatgtttgaatgttgattttgtattgtgcaacattactgaatttatttattaattctaataagtttgttccacctttaggattttctacatataagttcaagttatctgtaaacagaaataattttactccttccttccaatttgaatgtcttttttaaaattcttgcctaatttttttgactagacctttcaatactatgttgaataaaagtgtcaaaagca

SEQ ID NO: 128533 - DNA, 495 bp, Homo sapiens
aatgggtgccgagagtttcccaggctctggctgccttagctgcacagatgcaagctcggctgcagtgcagtgtcctggtgagtctctcctctgctggccctgtcaccacctaggtaggccttccagcagctgagaggtcccattcctcataagaccagtggtctgcagtcgctcccactgccctctagtgggacgaggtccaagctcacagccccttggtgaccttccctgaggccctgctgacctcttggccccccgtctggcccataatctaccccgtcccagacatggctgagcctgagctcatggctggcctgtgcaatccacccctttccttcctgctcggctccatcaaggaggcaccatgtacccgtggtgtgaggcagacaccgtggggaactttgatcccacctattccttgaacccatgttcagtacatcaccacgtcctcccaggtgtcccagcaagaaagctttcaaacatatcttgtttttc

SEQ ID NO: 128534 - DNA, 188 bp, Homo sapiens
catacaggaatgctgatgtcccctgccgtgcctgcgggtcaggaaagtataggaacttccagtgagctgtaagaactcagtaggactcccacatttgaaagaaacagacacagcacacaggaacttggcaaagcatcagaaaagaggagaggaaaaaagatggtaccaaaaaagtagagtttaaaaca

SEQ ID NO: 128535 - DNA, 493 bp, Homo sapiens
tcaaagcttaggggttttaagaggaaagaaaaatgagttgtacaaggcatctgtctagatggctcagtgggtaatagatttaactaactggaaactgtgcattccttcatagtttctatgtttcccttttgccacctttgactagttaaggaagatacatgattgatgatcattgctcagaaaatcttttacttatatttgaatttctgtttttaagatagtaccatttgtaggaaatctgacatctacttaaagtggtagttttttccaccactattttttatattttgtgtagtcttagacatagaaaggcactttaatctcccatttcagatttcctgtagattgcaggggacaagtgagatgtttcatatttaggaatattgagtatatttttcttcatttctttggtaataggcagtgttttgtggcatacttctcaactttttaattaattggactaaagtgtgtagtaatgtaggtaatgggtctt

SEQ ID NO: 128536 - DNA, 682 bp, Homo sapiens
gagaacagtaaacaaattattctttctcgggaaacactggaataaatgtttcctatcccatcctggctgttcaaacactggcctaaccacttggttagcacaggtaccatgtgggatttttttgtttattttttattttatgttcttcatctctctcacctagcacagtgcttgctacataaaaggcccacagtaagccaggcatggtggcacatgcctgtaatcccggcactttgggaggccgaggtgggtgaatggcttgagcccaagagtttgagacaagcctcagcaacagggcgaaaccccgtctctataaaaaatacaaaaattagccagccgtggtgtcacgcgcctgtagtcctagctactcagcaggctgaggtgggaggatcacctgagcccgggaggtaaaagctgaaatgagccgtgattgtgccactgcattccagcctgggtgacagagtgaaaccctgtctcaaaaaataaataagtaaataaataaaggctcacaataaatgtagaatgagtggataaattaattaagttgtcactcagattattaggttaatttgagtcacggaaaataacctgacactaactcaaggatctagtatttcagatgttcttaagaacagtctgaagtttgcagagcggaagagatgagcttgtttaaaatcagtga

SEQ ID NO: 128537 - DNA, 700 bp, Homo sapiens
tgacttatgatattttcagcttatgatgatttatcagggtataaccccatcataagtcaaggagcatctgtattatgttttgtttttttatattctgtcttcaccctcacataaatcatatggccgtcagaaaatccgttgtgtgataagtgtgcaactagcattggatcccataaatgtaccaaagtacctactaagtcatgtgatgtgcaggctgttactgccactgttgccaggtcgtcctcctgtctcccaagagtttactttgggagtctgcatagattgatttctctgaggatgtaggtgttggagtctgagtcatcttaccacttagagcaaacttgagagtgtctgagacttgcccgaagaacttgttcaaacagattgctgattccccaccctgggttttggactcagaagttctgtattggggccaagaatttccatttcttaaaattcccaggtgaagttgatgttgctggtctgaggaccactatttgagaacccctgtcttagagaaagtggttaccaatgggaaaatctataggccccggggcctgaaataacttgtcttttggtgttgaccatacaaactttttaaaagaatactgactctgatagaatcctttctgtgcaatatcgtggaatacgtaactggtgtacacaaagaggtaagtgttctcaaacaagatgggtaagt

SEQ ID NO: 128538 - DNA, 619 bp, Homo sapiens
tttcctatttcagtcaatagcacaacagtcactcacacttaaaaacttcatgtcacccctgagccctctcttgccactgttgttcacatacagttagcattattaccttcataattaatccaatagggagtcaaagccgggctgatttcactgtattaaggcaaaaatcaaatgcaaaacaatgtgtaacatttcactttttctcctcaaatacaaagtagctgttgggcagccagtagctacaaaactgatttattcctcaaaggaattttataatcagcttttttgcagcccttaactttctgtcctgaagatgcttttgtgcaatcatcatgtatcatctggcatctgggctggcttcagtagcttgctcaatgaccaagagaatgccgtggatgtgacacatgggacttctgatactaggtcaggaaaggcttgcagcttccatttgccgctctgggggttcccagctgtgggcaagaagcctgactacgtacatgccactaggctccaagaagccaaagccacagggagagggcctggagaatgaaatgccacatggggatagggaggcctgggagcaccaagatgcagacatgtgcatggagaagcctctgtg

SEQ ID NO: 128539 - DNA, 807 bp, Homo sapiens
gtatttaagcctctcaggaatttccttttaagccttcaactgatcaatattatgcctgtgaacacaaagcatattgtggaacttactgagtaggtctagcaactcttggcaaaattaacctgacctgtttaaaaaaatttcttttggctggccactgcgcccagccactttttttaacatcccaaactgaaatttatccaagacaataattccctattcctccctctttcagcccttggtaactacttttctactttctgtctctgtagatatgattattctaggtacctattgtaagcgggatcatatgtatacttttatatctggcttatttagggtgatgtcttcaagattcatccatgttgtagtgtgtatcagaatttcattgctttgtaaggctgaataataattccattttatgtatatatcacattttgtttatccatttgtcagtggacacaggttgttccaccttttggctattgtgaataatgccaccataaatgttgctgtacaaatagctgctcaagtctttccttttttgtgtatatatacagaagtggagttgttggataaaatggtaattcagtttttaaatgtttgaggaaccttcatattagcctggcttggttttgctttcagcctctaaactcttaggtactttccagtattttctttttctttttctttttcttttcttttctttttttttttttgagatggagtcttcttgctcttgtttcccaggctggagtgcaatggcatgacctcagctcactgcaacctccgtctcccaggttcaagcta

SEQ ID NO: 128540 - DNA, 504 bp, Homo sapiens
tccccaactgcaagactcattgcagaggtacctatacctgccgccatggtcctgaataaagtcttcatcaccatgaaaaaaacccaaacattgacattggttgtgcagtaaaaggcacagcagcccaatgtcattaaaaacccaatttgtgattaacagacactccccttccccagagcagtaaccagacccaaaagcatttcttcagaatgaagactccaaaagaggtaggaaggaaaagtacaatgttcagaacttcaaactgcaattatgcaactctctcatgatgctctgtgttcaggcatcatggctgaaaaccctggattattggttgtaaatcatactacaaataaccaagcttcagctatctcatctttgtcaaatacaattaaatccagtggtcaattctcaccttcatcccactttgacctatcagcagcatctgacatggcaggttccaacctccttgaaacactcttcacccgacttccacaacacaaattt

SEQ ID NO: 128541 - DNA, 222 bp, Homo sapiens
taatttgtggggaccctgctcaaaaatcgttaagaattttcagatagtgatagtgtagtatgaaagccagcacagtgcccttttgagtgtggtgccctatgtgactgcacaggtcacacactcattaagttggttctgtctggagaggtggggacccaagattcaataagatagatgcatagggcaaggtttaactccaaaagtattattcactgtaaaaaa

SEQ ID NO: 128542 - DNA, 327 bp, Homo sapiens
aggctgagatggacagactgggggaaaagcagtccagatgacaggaacagcatgtgcaagggctctgaggcagggctggaaaaggcttagtcttaaattgggtgagtatggatccaggagtcctagagcaatctgaagaagaaactggggaaaacggaagccctagagacagtgctcaagagtgacacctgagccacaagttcaaatcccctgtgggtcagccagctgtagactattctagaccaggggctgcagaggcctgtgcagtagggggatggctcaaggtaatgagaactcattaaaaaccatggagagcccttcctggac

SEQ ID NO: 128543 - DNA, 172 bp, Homo sapiens
ccatactcggtgtccaaactcagtgtgcattttacacttacagatcatctccgtgcagaccagccacatttcaatgctcatagtcacacgtacgtgagggtagtggctactgcattggccaggcacaggcttagatctagcattggttcccccttcctgggcaccttctgtg

SEQ ID NO: 128544 - DNA, 374 bp, Homo sapiens
ggacaatctgtcatagcttagcatgaacttcagaatacggacatagtcttcattacacttcacagaactggaatccctgtgtcctaaaagcaagctaagactgatgggttctagggatctaaatcactcagtaatgaaaaagtgtgcctcaaagttaagggaagaaatcagaggatgggcaggatggggaaagagcacagctcattactctcagttgatctggacaaggaggcccaccataaagagccctcctcaaaaaaaactgataaataaaaaataaaaaaataaagagccctcctccagtagaaactatgagaaagggagagaaagtgttagtgacagtcagacgggctaagacactaaggcatcatccc

SEQ ID NO: 128545 - DNA, 391 bp, Homo sapiens
ccacctcggcctcctaaagtgctgggattacaggcttgggccacgatgcctggtcacctgttgggttttagcgacctggcaggaagctggatttctcaagcttttccaataaagaagaagcagttagatcccaaaagccatgaaaattccacttgtggcttagaaactaagatttaccaaagtccactttgggaggctcccttcctccctaacacacacacacacacacacacacacacacacacacacacacacacaccctgcggataatttatcctgtaatcacagggatagactaattttgtctgcattcacttgatgagagttttgacaacagtgacttctgctatagtaactatagacagaagaattaactcccaagtcttaaaag

SEQ ID NO: 128546 - DNA, 166 bp, Homo sapiens
tctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctcc

SEQ ID NO: 128547 - DNA, 359 bp, Homo sapiens
ggatctcagccctgacaacttgcccaaactcaaacatttagtttgcaatgagcccagaagtaaaactgatttcatctgagcttttctcaagtgtatttccatttgatgggcagtagggttttgttttgagaaaaatgaaaaggtggcaaatagttatttaaggaaaccaaatactgggggaggatgatctcccaggcatggttcaaaggaccacacacctctgccttcaggtctctggaaaatagtcttggggaatctgggtcttaattaaaacaagactttggaggctgggcgcggtggctcatgcctgtaatcccagcactttgggagccaaggggggcggatcacgaggtcaggag

SEQ ID NO: 128548 - DNA, 607 bp, Homo sapiens
attgttgtcacggagatttagggtggctcatgcagcaaaagccagttgatggccgtaggtgggattataatcccggatacattaaaatgccagtcagaaaaacaaaacaaaaaaaaacaaacaaaacaaacaatgggtgggcgccggccctcgggcccccggaaaaaactttctaaagaacaatccgggtggggccgcgcggggcgcccagaagggcacaggtggacaagtgggccacaaacgcggtatccccagagagggagagaacccgggggacaaggacacaaaagagggcggggattcttctcccacacatataaaaaaaaggcccggcggggggcacacccgcgaaagccgttctcggaaacaaaattaccgagagagggcggagttccgagaggaggcccacatatacaggggggaactctctatatctcccacagggagggagagattctccagagagagagagaagaccgcgcgaaatatcactcacagaattaaacgaccccccccacccctctgggggtaacccaacaacaaacagcgacgcaacaacaacaacaacaaagaaagacaaaataaaccaaaacacaagccacacaca

SEQ ID NO: 128549 - DNA, 578 bp, Homo sapiens
aacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagagagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcactttgtcagctcgagctgtaaagccaaggagtcccggttgga

SEQ ID NO: 128550 - DNA, 273 bp, Homo sapiens
gaagtgagtagaataaaaggtagagtggcgacccacccgctcaaatatattgagtagcctctccttccccttaccgccacccaccccacacttacccagagacacagagaaggttcattaagctggaatagtcatctttccttcctgcgtgccttgagactggggctcctcggctttcgagaccatctgggctcaagtcctgctggctcagaacgcctctcatttgctcctggagcggggtgttgccctggggaggcaggtttctctcgtgcg

SEQ ID NO: 128551 - DNA, 233 bp, Homo sapiens
acgcaaaacagatgtagcctgagattttcttccatgtgctgtattctgtggtttcattttcaagtgaggaaaatgttttgaaggagaagaagagatgaaaagcctccattatattccattgcattaaataaattatgaaggattatatacatgagtctataatatttagtatgcaaggattaataacatcttcaaaaaattaaagtgtgacaggataacagcatatatgtgga

SEQ ID NO: 128552 - DNA, 213 bp, Homo sapiens
tcattgccaccatgagatgtacaaaatggagccaaatgtgtcttagggctgtcagttacgagagctagcgaagtcagggtcctgatgtgctatgggttgaaacagcattcagcgtagtgagagtcctgcaggactgaccacgtgggcagtgcacccagatattttcatcaagacatgaagaactcacctttctcttctggttgccttgaccga

SEQ ID NO: 128553 - DNA, 398 bp, Homo sapiens
ttgcacaatacacccaaagtaaaagaacaagattgccaatagccagctggtggctccagtggccccagggatgagaggaaaattgtctttgcacaccttggaaatttgccactatgctacaacccaaccacaggagttctgattcaactctgaccagtcacctgcagaattttcaaccactttagaactagcaccaagaaactttggaattaaggaccttctaagttttttgtttgttttttgttttgagatggagtctccctctgtcacccaggctggagtgcagtggtgcaatcttggctcacttatccaggttcaagtgattctcccacctcagcctcctgagtagctgggactacaggcgtgtgccaccatgcctggctaattttttctatttt

SEQ ID NO: 128554 - DNA, 579 bp, Homo sapiens
cacatagtgggtgctcagtaaacagctgtgtttttcctatggggctagggaatgtctttcaggcttttgacatagcctgttgctggggtcgtattgtgtccggaattggtgggttcttgttctcactgacttcaagaatgaagctgcggaccctcgcgatgagtgttacagttcttaaaggcggcgtgtccggagtttgttccttctgacgttcggatgtgttcagtttcttccttctggtgggttcgtggtctcactggctcaggagtgaagctgcagactttcacggtgaatgttacagctcttaaggccgcgcgtctggagttgttccttcctcccggtgggctggtgggctcgtggtctcgctggcttcagaagtgaagctgcagaccttcgcggtgagtgtttcagctcataaaggcagtgtggacccaaagagtgagcagtagcaagatttattgcaaagagcaaaagaacaaagcttccacagtgtggaagaggaccccagtgggttgccactgctggctcgggcagcctgcttttattctcttatctggccccacccacatcctgctgatt

SEQ ID NO: 128555 - DNA, 294 bp, Homo sapiens
cctccagtcggcctcgtggtcttcctgtccctccccagcctctcaggtgacccggacaatttgctaaggctcttggagaagggcagcccgaggaggctgggcctgccgcccatcgggagcggcagctattttccatcacatcctaaaaagcccagggctctaccgctcctgcagctgggcatagctcccaccaaacacattctcccgaggtcgccctggacgccttgctcggagatgacagaaacgagaaaagaaatacctaagtggacataaagacctagctcaccctggccg

SEQ ID NO: 128556 - DNA, 170 bp, Homo sapiens
agtcgtcgaaaggctggagctgaagagcaaccagcaatagattgtgtctagatgatgagaattgtgaggcgccattgaaaatctcaggacatggagccagcagcaggtaagctgagcgtggcagtgaggctttctagggtctactactctgcaatttgaaccaggtatgt

SEQ ID NO: 128557 - DNA, 159 bp, Homo sapiens
cctcgttatctgccggtcacagcctcccaaagtgttaggattataggcgtgagccaccgcgcccgcctgcctggctttctttctaagaaccccatagagagcttctcttttggacagtaggggcaactgttttttactggtgtgtgtgtgtgtgtgtgt

SEQ ID NO: 128558 - DNA, 327 bp, Homo sapiens
ccacagcaaggaagcagggctgggaggggcccagtggccacctagggtgaggcagctggtgagtggcagagctggggtttggacccaggtctgccagacccggggaccttcttcgtatcacctcccaggcttttcttcctggctagcagagctgggaggagttaatgatgaagacagatactcctggctagcacctatttagttagtttaactcaacttcctctgagcattgttctcggcaccttacacatgctaactcatgtaatcctcgcgatggatccctatggggtaggtgctattcaattccatcttgcagttgatgaaatt

SEQ ID NO: 128559 - DNA, 471 bp, Homo sapiens
attaagattccattcactaatttaaatgttatgctaattaaagtataattctgaaaatgtaaaaaggagttaaaaataaaaagaaagaaaaaactgggttggcctttaggaattacattaaatttattgcgttgtaacaatggtaagctgggtaattatttcattcgcctccgtgctgcattcaagcttctgcttattcatcccattctcacacttcagctcattaacacacacttcccctctcccgctctaatgggagttttcttgtgatggtttaagatgagttgtgagttagatccttgaagcaatgtttagaatttcttcagctgggccacacagagtgttgcaagctgctgcttgatttgatgtttagagagaaaaaaagagaaaacatctggatttctgctttgtaaaccaatttctggagccaacttgctgttactccagcttcttctccatcctctctagaag

SEQ ID NO: 128560 - DNA, 578 bp, Homo sapiens
ttcagctggccccaaggaatgggatcagcagatgggccaggttgtaggaagggtatgggagttctggggaaatggggtcagtggataaggaaggttataagaaagatttgggggctcctgagaatatgggttcggggagcaaggcagattatagggatggtgtagggggttctggggcaatggggtcaatggatgaagcaggttataggaaagatttaggggctcctgagggaataagttcagggagcaaggcagattataggggtggtttacaggattccagggaagcgggttcagggagcaaggcagattatagcggtggtttaaagggttccagggaaatcgggtcaatggatgaaacagataataggaaagatttgggggttcctgagggaatgggtgcaggttacagggctggtttaaggggtcctggggagatggggtcactggatgagtcaggtcataggaatgggattggaggttatggggaaatggggtcaggttatagggaggatttgggggctcctgagggaatgggcacagggagcaaggcaggttatagggatggcttaaggggt

SEQ ID NO: 128561 - DNA, 473 bp, Homo sapiens
ttcagctggccccaaggaatgggatcagcagatgggccaggttgtaggaagggtatgggagttctggggaaatggggtcagtggataaggaagcaggttataggaaagatttaggggctcctgagggaataagttcagggagcaaggcagattataggggtggtttacaggattccagggaagcgggttcagggagcaaggcagattatagcggtggtttaaagggttccagggaaatcgggtcaatggatgaaacagataataggaaagatttgggggttcctgagggaatgggtgcaggttacagggctggtttaaggggtcctggggagatggggtcactggatgagtcaggtcataggaatgggattggaggttatggggaaatggggtcaggttatagggaggatttgggggctcctgagggaatgggcacagggagcaaggcaggttatagggatggcttaaggggt

SEQ ID NO: 128562 - DNA, 308 bp, Homo sapiens
cttcttcttctttgtctttctcttcttccttcctcttctttctttttcttcttttcttcctgttgggggcaggtgttgcaccaaaatccataatgctgacatgtaaaccagttcacaatggaggaactctgattgaagaggatgtcagggatctgctaattccttctccacttccgttttaaaaccgctgcttgaaccaaatggttctgatcactgttgctctcaaatacctccatgctggctgggcgcggtgcctcatgcctgtaatcccagcactttgggatgctgaggcaggacaatcacctgag

SEQ ID NO: 128563 - DNA, 139 bp, Homo sapiens
agtgctgtgaggactgggataggacagctgctttctaagctccttaaattggggaccaggcccagagcccacaaacagaatgctgccctcctcaccaccccaccaggcagcagagggcagggtggcactgccctttcag

SEQ ID NO: 128564 - DNA, 763 bp, Homo sapiens
ggggtttcaccatattgctcaggctggtcttgaactcctgacctcatgatccacccacctcggcctcccaaagtgtcaggattacaggcatgagccaccgcgcccggccgagcaagtgctaacatttatacacttgcctcacgtaattataaattcagtgcaattgtggatcttacatatttagcatgcaccacatgacactagaaaagctgagaaggactaaagctatgtataaagtagctggtgcattgtgttaatgaatggtgttaaccacaccaaatctttattctcaaaatttatttatgcctcacattgttctaaaaaagatgtgagatagctgaaaattgcgtagtatacaacaaaagaaaatgagtcatgatatcaaggcaaagaaaaaaaagggggaaggaaaagtaaaataaaaccaagaaaacaatgtctactgtgggggtccatgcatttgttagtttgtcatgaatttggctttagatttctagaacctgacccaaagagggaaatcagttctgaaatttacactgcttttatgattaaaaaacacatttgttaaggtaaagcatatctatgcttcatactgaaacttaagaaaattaatctcaatattccttagtgtggatagacactatgctgccaaaatatatattgtaaagattctatactatcaagaagtccagatagatcattcttttatgtttagagaggtagagtatcaaagactatatatttttcaggcagtactccatat

SEQ ID NO: 128565 - DNA, 696 bp, Homo sapiens
agtgattagtctatgccagttttctactctgtcgcagaaagttttcttgaccattcttctactcatcatttaaaaatttaaaagcttctatatgtttttggtaagagttctttgctcagatctaatagcatttatcagtgtttttctctcctttaaaatgagattaattttaaaatcctttcgacgaactaactccttattctcggttcccctctttccttatatttgaattttattaattcattttgtctgttcctcttttctccttggtctgcttgctctctttctgcccttttgagttgaaatctcagttcatttattttctttttgtcttgcttaatagcaaaagcatttaatattatgtatttccctcaagtatggatcttgctacagctcataagtttttatatgtagtgtttgagttgtcactgttttctagatagtgtttaattccagactttctttcctctttggtctaagagttatttagaagtatttttaaaaaccaaatcaattttttaaatataagcttctattcttaatttatttcaccgaattgtggttttttttgtttgtttgtttttttaagaattaaaattttgatttgggcacagtggctcatgcctgtaatcccaacacttttggaggccaaggcaggaggatctcttgagcccaagagttcaagatgagcctgga

SEQ ID NO: 128566 - DNA, 333 bp, Homo sapiens
cctatctctgcacttctgccctccatcctgctccacgccgcctctgcttgttattccagcacattccagggtgatgcctgctgaagccacgcagccagtgcctccaccctaccccccatctgacccaccggccccttccgcacgctggaagcctgcccggcctgaagtgtcctcacctgtcgccctatcctcccctccactccagcccaccggtgactcagccctcacagctctctcctccccgagggagccggtgacttggctctgatggtgccgggacccagccccggcatgttcagaatccttgtcctttaacctgcgtccacatgtagt

SEQ ID NO: 128567 - DNA, 544 bp, Homo sapiens
ttcgaggagaggttagaacatctcctggcatataatcacatttctcagccagtcccacactcaagtcagaggagaggtgcctgcagggatccagcaccaaacccaagggagacaagggtggctcatactgttgccagcccaggacaggccaggatccactgagtgaaggccaggttggcttctgtgggacccatccccacagaccctgataaggagaaagggtcctctcagctccaaaagtagctgtgagagccaaggacagtcaagagctgggctgagctttgtatacaggcatccagtctgattcaagggagcaaacatcaagactatctgctttagggtttcctaaggccacaagagaggagacaggggccccatggcacaggtctctcaaaaaagctatgctggccatgaggaccttgagggagcccatagccccttctcacacgtctggtcaaagcagtccatgtgtgagttaagctggggtcaataacagaatatcaattctcaaggcagaactggagaacagcattggttaagcaac

SEQ ID NO: 128568 - DNA, 274 bp, Homo sapiens
aattttatagaggtataaaattcacacagaaaaccgcagaaattgtaagtatttggctagatgaattttcccaaagtgaaacgtatctatataatcttctaggttagaactagactatttacagcatcctagaagccctccttctgtccgtctttgtcacaacccacccttttgcccaaagatgactaatatttgacttttaatggtctaggttagttttgcctgtaccgttacatgaaatttacacaatttgtaatctatcgtttctggtttc

SEQ ID NO: 128569 - DNA, 453 bp, Homo sapiens
acatggtcaaaggtcggtaaatggtaatgatacatggattataatggaagtacaacattaatcccttaatgctggccaggaggtgtgggtcagcgatcctgaagacaggggaaggggccagtcgggccagaccacaaccacaactactcttctcagcatgtgaattaactgattgaatctttttgtccccatgttgcatatgaggaaactgaagcacagagaggttagtgacttgccccaggacatacagccaagaggtagtggagccccgattcaaattctagtcatctggctccaagcctgagctggccaccactgttccatagggtatctcaagggaagtgtggaaggaggctctgagaagagtctctggcgtgcagaggcagacctacagccggcttgcacagctctgacttccggacatgagcctctggaagtcctagggaaaggtct

SEQ ID NO: 128570 - DNA, 219 bp, Homo sapiens
aagaatagaaaattgagaaatcattatgctagagtagtaatcaggaaggaagccattgcctctgatctcagcgtcttggcttattgctgttcccactactggaatgttctctcccatttccacctattaaaagcctgtccagtcaaaaggtagcatggtcaagcagtccaaggtgcaggatgtagttggctttagtctctgtggagccatgggtttgag

SEQ ID NO: 128571 - DNA, 307 bp, Homo sapiens
actatgatcataccactacactccagcgtgggcagtgagctatgattgtagcaatgcactccagcgtgggcaacagaaagaccttgcttccaaaaaacaggtagatgaggccaggcatcgtggttcacacctttaatcccaacactttgggaggcagaggcaggaggattgcttgaggccaaaagttcaagatttgcctgggcaatataggaagaacgcacctctactaaaaatttaaaaatcagtggccaggcccaagggctcacacaggtaatcccataacttggggaggccaaggcaggaggac

SEQ ID NO: 128572 - DNA, 419 bp, Homo sapiens
aactggcacaaagacatgaagtgacttgcacaaggtcagaaagttcagttgtaaccgagccaggcctagaactcaggtcggccgactccagcctagtgccctttccactaccccattgcatttgattgttgagggttgtgaaatagctgctctcttctccagggcccacagctttctgagaaactctgtactcatacactagtgggcaggagtatggatttttcttagttggatttaacacgttggggagcccagggttgagcgtggtttcattcatagatccagagcccaattttgttcatgtgacattcagtaaagtgttagctcccgggtttgtagctgtacttttcttttcatctttcctgctctcatctctcattccatcatccaagggcttgggagcccttctcaaatgccct

SEQ ID NO: 128573 - DNA, 141 bp, Homo sapiens
cgaacaaggattccccactgcttcacatgaggtaagaggaaagaaggggagcagaagcagagatgactaggtgtgagggagcttcaaaggagtggagaaggtttcaaagagggctggagggaacaggaaaggagaggctgg

SEQ ID NO: 128574 - DNA, 396 bp, Homo sapiens
ctggggtcagaacttggagttcccagatccccaaccccactctggggcctgtctgccaccacacagcagatggagccacagggagatgggggctggggtgactgtgatggagtcggagagccagagggagagggtttgggtgtggctgtgagtgtgagacccagagaaggtggtcaagtgtccaaaagagccagccgggcgtggtggctcacgcctgtaatgccagcactttgggaggctaaggcaggcagattgccagattgcttgagcctaggagttcaagaccagcctgggcaacatggcggaacccccgtctctactaaaactacaaaaattagccaggcgtggtggtgcgtgcctgtaatcccagctacttgggaggctgagacaggagaa

SEQ ID NO: 128575 - DNA, 329 bp, Homo sapiens
cttctaaagatgatggatcccaaacaaaaggtaaaactaggttgcgacatgagaatgtaaattgtacaagcccagagaaaagtaaaattgctctctataagaaagggggcagacgtggaatagaatctaggagagggcaggagggcagagaagctggagagacagaaatattagaggaaagaggaagggaaaaaacaggggaaaatcagataggaagaagactttgggtgagatatgtccaataagggaatcagattaaatttccctctgttatgcacaatgtaacccagtcttccatttccccatgaaatattcagcaaaatgcacat

SEQ ID NO: 128576 - DNA, 356 bp, Homo sapiens
tggttgccaggagctggaggcaggaagaatgggaagtgactgcttaatgggtacagggtttccgtgtggggtggttaaaaggttctggaactagatagtggcacgggttgcaaaacatcgtgaaagtacttttaacgccagtgaattgcacattttaaaatgatttaaatggcaaattttccgttatgtgtatttcactacaataacaaaagaatgattcaatgcctggcacagtggcacacaactgcaatcccagtgctttgggggctgaggtgggaggattgcttgaggccaggagttcagagaccaacctggacaccatggcgagaccctgtctttacaaaaaaatttaaaaa

SEQ ID NO: 128577 - DNA, 473 bp, Homo sapiens
caccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggatacatggtgtggcagtttcactgtgaatccagaatgatccagacggctgctgtctctttgttaacaggaagccaaactgatgagtttgtaatgcatttcttatcaaaggtagtttcagaaaagaaaatgtgccccatcagtttggctagaatttcacatacacaagattataggcttaatcagaatatctctgttattttcttgaggaaatagataattccacatccattccattaaatcattttatgccaatgaattatgtatt

SEQ ID NO: 128578 - DNA, 281 bp, Homo sapiens
gtttgactcctcattgcactttttctatctgttacaggtctttcctactttgttcttttgtctcaactccaccctctccctcttgaagtagacctgaatttgtgccgatacacaatttttatcagactggggtatctgaggtgagctcaaccgacctgtcacttcagacttggtttatagactcctttattgcagccctctcctttttactaatctggcagataaacccagtcctcagagacatttctcctctgttaccttccatggtttgcccctttact

SEQ ID NO: 128579 - DNA, 678 bp, Homo sapiens
ggaattacacaatggcataaatgccaggagacagggatctgcaggggccctttgagagactgcctaccacacctgtatgactgagtagatggcagtgcattaatgaagattaggaatgcagttgaaagagattttagggggttaatgaagagacttgtttcagatagaaactgttgcctattcaaatggatctgtgcagcagcattagtaatggagaagtagattggagggtggtcatcgttttataggtagcatgtgaaaccatacaagtgaccactaccttacctccttacaaatcattgctcagaggccaccctttcgatgaggtctgtcttcaccaatctcttaaaattttaactcttttttcactctaatatcccatctccaccttttgagttatgcatagcacttaccatcttctgtcacgcccatgatttacttattgttcattgtctgtttcttccaccagaatgtgagctcgattaaagcagagttctttgttttatacactgatgtacacttagtgcttagtagagtacctgatgtatagctgatacgcaatagttatgcaaagaaggataaaactttgtaaaagtagtacatctaagccaaaggtggaaataatccaagtattcattgatggatggatagataaaccagatgtggtacatacataca

SEQ ID NO: 128580 - DNA, 249 bp, Homo sapiens
acaaagcaaactggcacggatgtgattgtagttgctaacaattctccttactgtgcccagctgtatttctctcagtaccaggagccagctgacatgtctaagctgctcacacatctctgctgagcaagccactcaaatacaccatacccagtgaagccccactatacatccccagtacgggacaatgtgtctgaagccccactacacatccccaataagggataatgtgtctgcagtgaagtacttttt

SEQ ID NO: 128581 - DNA, 470 bp, Homo sapiens
taattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctata

SEQ ID NO: 128582 - DNA, 329 bp, Homo sapiens
caacacggcttttatagtagtaataatggcctttgtttttgcatgtatttcatcaatttacatgcttaattaaatttggtgttaattgcaataaaagatacaattggaataaacaggtttgagaacaactacaaccaacccttggtttggtaagcatagaactcaactggagggagccgaagattgtcatactaccagcaagcatttggcagaccatgagcattagaatgaccgtgaggttagaatgttttatagagggaagggaatgtgccagttagtatgttgtgatagctaagtggttgttgcatagaagaacttgtacaggtctg

SEQ ID NO: 128583 - DNA, 730 bp, Homo sapiens
gtctttgtggcacctccttccacccaaccttgctcccaccatgtgagatgctggcttccccttttgctttccaccatgattgaaagctccctgaggcttccccagaagccaagcagatgctggcacatgcttcgggtacggcctgcagaaccgtgagccaattaagcctcttttctttataaaatacccagtctcaggtatttctttatagcaatgcaagaacagcctaatacactgggatagtccattcattctaagtctgttgttattcaacaaatatttataaatcatatcctatgtgtcacacctatgattttctgccttaaataatagggttccctttcatcattttttttccttgccacttatttgacaatactggttgcttctgctttctgacattgaattcagttaatcttattctgcttttgccatctgtgataataagttattatcctagaaatatgttttgaatttaaactgaatatccatcttgaagttgccttaaattctttatgataaaatccatttagcataataatccgaaaagacagagtgaaaaaaacattatttaaaatagttgatttaatgttgttatgaaatataacaggactcttgaaaaggtgattaatattcttacacatgttgaaacagaacaatatgagttttttcttatctacttttcttatctggtcttctctggcttctaactttattagcattcgtatat

SEQ ID NO: 128584 - DNA, 581 bp, Homo sapiens
tttaaaattaaaatttaattaatttatttatttttgagatggaatcttgctctgttgccgaggctggagtgcagtggcgtgatcttggctcactgcaacctccaccttttgggttcaagtgattcttctgcctcagcctctcaagtagctgggattacaggtggctgctaccacacctggctaatttttgtatttttagcagagacaaggtttctccacattgaccaggctggtctcaaactcctgacctccggtgatctacccttctcggtctcccaaagtgctgggattacaggcgtgagccactgtgcccaacctaaatttattaaggcggggtctcaccatgttgcccaggctggtcttgggctcctgagctcaagtgatcctcctacctcggcctcccaaagtgctgggattacaggtgtcagccaccatgctcggccacaagcttgtctttataacaaagccattcccatgataactgatccatgttcacaataatggcaatccattcatgagggtggaactcccatgacctagtcaccttttaaaggcctcacttctcaataccattacatttg

SEQ ID NO: 128585 - DNA, 809 bp, Homo sapiens
ccagtggtgtcttctctccagtacacaattccaagatccttaagggcagggatcagatcatggtgatacatacaggaggggttgattactaagtgtttgctgaatgaatacatgaatgtaatgctatttcttatgttcatggttcattttattctttctcctagaatgagttctcccttcacttccagcaattcaaattttgcttaactctaaactaggctcaatttcactttctatgtaaaattattcctgaaggtttctttttctgtgacttttccctcatgtaaatgcccatacatgtcacacagtcaaccttgctccagattacattccttctaatactcttccacccaattaaacttaagggcctgcgtgtcttccactttctcaacacttagcatgcttaatgatactggaaatgtatgtaattaataaatatttactgctgtgacaggacaaaaacagcacattaattgggaaatccataaattatatatgcatgcatctagtgttccttaaacttaaggatttaaaaatattttattataatgtttatgcaaaatgcaaaagatagggctaagtaatatttgtattttgcctaagatataaaagccttcaatgatccatgccaactctaaatgatattctggattccatattagcatttaagataccagtaatggtttgaaatcacaaatatcctttaaaaagctgtaaatgttctacaatggataccgacactggctaacctttattgggaacttactctctaatctattgggcagcctgtgctgagtgctttcaatgtg

SEQ ID NO: 128586 - DNA, 394 bp, Homo sapiens
gtaattgggtaatagcagtctgaaacttgagttttgtcaaaataactccctatggaggttagttgaaaaaattcttgatgagaacagtcaagaagtaacatgattaattttgaagagaatcaattatattttttatttttttgagacatggttttgctgttgttgcccaggctggaatgcaatggtgtggtctcggctcactacaacctctgtttcctgggttcaggctattctcagcctcctgagtagctgggattacaggtagagacagggcttcactatgttggccaggctagtcttgaactcctgacctcaggcgatcgtggcctcagcctcccaaagtgctgggattacagatgtgagccactgtgcccaccacaattatgttaatttt

SEQ ID NO: 128587 - DNA, 512 bp, Homo sapiens
ttcatccatgttgccacaaatggcaggatttcattcttttttatgcctgaatagtattgtattgtgcatatatgtcacattttctttattcattcatcagctgatggacatttaggttgattccatatcttggctactgtgatctcttcagtatactgatttcctcttctatggatgaattcccaacagtggaactgctggatcacatggtagttctatttttaaattttttgagcaacctttagactgttttccatcatggctatactaatttacattcccactagcagtgtaaaggatcttttattcttttattcttgagggtttttccttgacttattactcttcctgatggatgaaagtatgtgtgggttagcagctctgctatatactataccagaatctcttctattacacagtcctcaccctaccccaccctccatcctctatcaccactctttgaagtttatagatcaaagtttgtgttcttttttgcttgtttgggtgttacc

SEQ ID NO: 128588 - DNA, 846 bp, Homo sapiens
agtgtggagctggctttccaaacacctttctcttatgcaaaccccattccaagaccttttcccagattggaattaaataccaagcttatcaagtgtcttattgttaaatctgtgtttctccccaccccccaccatacaaatagcttcctttattaagtcagttatattttttttcataagtactttttaccagtacatttgttgttgttgttgttgtttttctgtataccaccattggcacctgtaaaatttgactttattatggcttgtgggtacttgaaagctttttgttttaatgtatttttaaaatctaattttgatgattgtaaaaggtgaaaatgtaacttgggtctttttttcttttaaccaaatagcatgtgattgctttactgctgcaagatttttctatttaggctagttagaactttgctagtacagtatcagttcctagttattgccttcctgccccccaagaaagccacacattgcctctattttgtgaacagtttagtgccagacattttttaacctgattcagattttcataaacattttggcagttgtctagatcagtagctattaacaattgtctttctttttaagacagtggaactcttaaaaatgaaaatgtagaaatgtatataaagtgagtaaaagctgagcaactctggcagaggcccctctgcccctgaaattattaggctgagatctgttgagtgaggtttattgagcacagtgctatttgccaggtgctgtactagataccagtgagaaactgttgaaaaggacactggtttcctctttgtgagttcagagattcccggacacggtggagagtctagagat

SEQ ID NO: 128589 - DNA, 505 bp, Homo sapiens
gctccccctttcccctccaccatgactgtaagcttctgaggcttctgaggtttctctagaaaccaagctgatgacagaccatgcttcctgtacagcctgcagaaccatgagccaattaagcctcttttcttgatcaattacccagtctcaggtatttctttagaacaatgcaagaacagcctaatatacacaccattctgcctggacccacattggggctcccagaacctccctatatgaataaaacccagagtgggtgagggcagaatcttagttccaccacaagacaagtggcaaaacgcagtaggatgcgttcatgaaccctttccagggacagaaagacccgggagggccaagcacagatgctccagtgattcatctgagagaagcagagggaaggggctagaaaactcagtaccaaacaccccacttcaccacggcctccccccaggcatctgctacaacttaagactggtttcctttttaatggacacctgttccactc

SEQ ID NO: 128590 - DNA, 423 bp, Homo sapiens
tagcggtccgaatcggcaggcacaagaggacaggctgcattctgagaagtaattttcagaacactggagagcatagttctattcagcacctaaggtactgtccgtttctgggcttcattttaaaagagacacccaggcaaatgaagccagtctggagatgatctccaggacagtcaagggttttgacatgatgccacgctaagaattgctggagcatgtgtggatgtttagctgggaaagagactctggggaggagaggcataatagcaaatgtccaatagattggtgcagttgaaagcagctgggaaggtggtttggaccagataatgaagggatttggttgccttgctaaagattctgcagtttattctgttggcaatagggggctactggaggcttctaaggaagaagcaatgagattta

SEQ ID NO: 128591 - DNA, 458 bp, Homo sapiens
aagaaatttattttgctttttttctctctctcctgtttttttttggaagtggtgggggacaaggaggcgaggtggtgagtggtgaaaacacaagctagatagctttggagttcaaattggagctcggcctctcactaacatggtaaagttgaggaggaaacttaaacccatgggcctgtttccttgcttagaggacgtacacatccactgcaaaggactttacaaataattaacgtgataaaaataaagtgctcagcacaagatgggtacaaaataactggctgctattttcataatttaaaagcaagcttgtcacaactcaaaagttacaatcaagcaacattgatttatttgtgtttttaccctcccacaccttgttccatattttatttcataaaaataaaatatgaaaagataaaactggccaggcatggtggctcacgcctgcagtcccagca

SEQ ID NO: 128592 - DNA, 172 bp, Homo sapiens
actgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttg

SEQ ID NO: 128593 - DNA, 172 bp, Homo sapiens
tttatgtcacctctctgagcctcagtgtcttcatctatgaaatgaggctaatggtgcctgccttggtaagtttcaagaattcaatgagctaagtagtgcctttgccctaggaattagaggtgacaacagggccctactgcagcccgagaggagcgggtgtaagacagcctgt

SEQ ID NO: 128594 - DNA, 881 bp, Homo sapiens
taactaatctaggaatttaataaaaccttgtaacagcaatatgagaagagaaaattatagtttttcacttatgaacacagaaaaatccaaaataaaattttaacagttgaatctaatagggcattgaaaatgatacacagtgactgagtagggtatatcccagaaatgcaaaagtaaacattagaaaactcttttgggattgtggtagatttttaaaactatttgatagccattgatgatacctacttttagcatattaggaacagagcattatgttcctagtttgataaaaagttatctgtcaaaaacttaaatcacattacaattatgaaactttgagaagtattcccatcaaagtcaagaacagggtgatattgttctgaaggttttagccaatgcagtaggacatggatggagctggaggccattatccttaaccaactaacacaggaacagaaaaccaaatactgcatgttctcacttataggtgggagctgaatgatgagaacacgtggacatatagagtagaacaacacacactggggctgttggacggatggaaggagggagaggatggggaaattactaatgagtactaggtttgatacctgttgatgaactaatctgtatcacaaacccatgcagagttactatgcagaaaatgtacatgtacccttgacttaaatagacttcgcaacaattttttgcaaaaacacaaaaaaagaaaacatttggggcggcgcggaagttttaacattcttggggcggccagttaaactgcaaagtccagacaccggcagagtggggcacaaaacggggcattgacaaaggttggtaggtcaggaccgaaccccgggaggggaaagggacaagagcaaatc

SEQ ID NO: 128595 - DNA, 663 bp, Homo sapiens
ggctgaggagagggggaaatgaggagttgctgttcaatgggtatagtttcagtcatgtaagacacaaaaagctctagagatctgctgtacagcatggtatgtatagttaacagtctgtactgcacacttaaaaattggttaagagggtagatcccatattaagtgctttttttaagcacaataaaaataaataaaaaataaagatgaaatattaagagttggatgatttaggatatacttaggccctgaaaaatctagaactttttactagaaaaatcaataggtcacaaagtctccatgaatgtatttttgataacaacactgaccaaaagaatcttccaatgttctaaactaaaaatgaaagaaaaaaaacaaggattcccatagccagggtaaggctaactgaggagacactccagaattatgttcttctctcctaaaaatcaggaagggtggcccttctaactctactccaattctcaaagcatttaaaaaaaaaaaaggcagagaaatcctatgtccaaaatcagtaaaaatttaggtgctattaatacacgggtgaacacaacagacaataaaattaaataagtaaataaaatactttcagatgataacaaagctatgaaggttaacatacaatgtgactgaatagatactaaaggg

SEQ ID NO: 128596 - DNA, 1314 bp, Homo sapiens
attgatttgtacactttaaatggctgaattttatgatatatgaatatctcaataatgttaaaaaaatttccagttgaaaaagtatattcccatatctgtgttgttctaaacctatttaaaaatcctctagtaacagaattaagttgtgtgtttttttttttttttttttttggggccagaccaagaacctcggtttccaaagagaaacccccaacaaaaacacccagaacaaaaaagagaaacaatgtgtatgggcgttttaacaatcttcacatcttcaatataaatctcccaaatattgagtttttttatccccaggtgcctatttggctcttatgggtttaagaggtggcctcaatatagctaaaccatgtgtggcgcatagggggcatactcatattgtggggagagtgcccaattctcttagaatctcattccatatttgtggcgacaacacctttacaatgtgtgtggggagaggaccttctctgtggagcgcggcatgtgatctccttttaaaaattattaagcggaaatctaaccctttgtgctgtgacccccccccattttttcttttcttgtgtgcgtatctccaggtctgtcccccaatatatcttcctgtgcacgcgagcagggcgcgccgtggttgagcacttgttttgtgtcgccaacacaaaccctcttgtgaacccgcggtgggtctcgccctgttgcacctgtcgcctgtgttggaaccaacttggtgcctctctgttggacccatcctcgtgcgggcgaacatctccccacgaggagagaacctctcgagatattttcccacaggctgtcgggccggggggagactcgtggctactacacaattttctcttctgttgtacactcccccttcttataattcgtttttattttacacccctttaaaccatcttcacgcggggcggcgaacaaaactactacccaattttttttgggcacccatcacagcattctttttgtgccgcccccaaaaaacatcaatgccccccagagggacagtgtctctaaaacagagaacaaacaccgtgggggggtcgtgggaggccgaccacctcttgggggcgacgatctcgcaaggggggcacagacaactcttttcttggacacatttgtgtgtctccgagtcggttctcacacacaacatcctcccctgtgggattttttgtaatgaaacccccccaccggcggtttgtttcttgcgtcacacccaacgtctggttgtttcttccttggggcctgaaaatttccacttctacccgtgcgacactcactcccgag

SEQ ID NO: 128597 - DNA, 429 bp, Homo sapiens
taacaattgttagtgaggatgtggcaaaattagaaccttgtgcaccgctatgtgaatataaaatggtgctgctgctgtggaaaatattacgacaattcctcaaaatattaaacacagggccaggtgcgatggctgacgcctgtaatcccagcactttgggaggccaaggcgggcagatcacctgaggttaggagttcaagaccagcctaaccaacatggagaaatcctgtctctactaaaaaaaaaaagaagaagaaaaaaatacaaaattagcagggcatggtgatgcatgcctgtaatcctagctactcggaaggctgaggcaggacaatcgcttgaacccaggaggcacaggttgcagtgagccaaaatcgcatcactgcactccagcctgggcaacaagagcaaaactccatctcaaaaaaaaaa

SEQ ID NO: 128598 - DNA, 446 bp, Homo sapiens
  misc_feature (388)..(388): n is a, c, g, or t
ttgcattcaacctctgacatacttctttcttgaggactttgccacatggaatcttcaatggccatgtgggtggaatggcatccagtaataatggccttatcaccagcaacctttactgacatttcacataatccctcgtggtcaataccaggcttgcatcatggctcagacggttgtgtacaggaatgttttgtcaatatgtcatctctaatatccccatatctgcctgtaatctcctatccttccaattctcatcccttgccattctcaccacctgtgtgtttcagcctcagagaaaagcatcagctattgatgtttccatattctcctcatcaatcaacctcttctggacttattttctaggtggctcaggaagctacgtaggctntaagaagtttgtctgagaagtgaagaaaagagagaaaggaaatggaggagcgaagtca

SEQ ID NO: 128599 - DNA, 1180 bp, Homo sapiens
caacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacaacagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 128600 - DNA, 646 bp, Homo sapiens
caacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacagtaagccaccccagtctcccttcctgcaaaggagacctcagacccattagtagtctcaccaaagactgatagaagcccttcctgtccagctttccccaggtagcctgcccttttgggcaactctggggaaccatgattccctgtcttgcctttccttcacaggtctgcacacctcattgccccttttgcaactactgaggcacttgcagctgcctcagacttctcagctccccttgagatgcctggatcttcacacccccaactccttagctactaaggaatgtgcccctcacagggctgacctacccacagctgcctctcccacacgtgacccttacctacact

SEQ ID NO: 128601 - DNA, 523 bp, Homo sapiens
tcaggattcctacaagaggaactagaagttccagaagcctgtgggcagggtccagggtgacttgttcttcctttgcaggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacagtaagccaccccagtctcccttcctgcaaaggagacctcagacccattagtagtctcaccaaagactgatagaagcccttcctgtccagctttccccaggtagcctgcccttttgggcaactctggggaaccatgattccctgtcttgcctttccttcacaggtctgcacacctcattgccccttttgcaactactgaggcacttgcagctgcctcagac

SEQ ID NO: 128602 - DNA, 977 bp, Homo sapiens
gcgggcacccccattccataccaggcctatcatctcctacatcggatggcttacatcactctacaccacgagggagcaggaaggtgttcagggtggaacctcggaagaggcacacccatccccttttgcgccatggaggcaggaagtgactaggtagcaacagaaaaccccaatgcctgaggctggactgcgatgcagaaaagcaggcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacaacagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 128603 - DNA, 438 bp, Homo sapiens
gtagctgggactacaggcacgtgtcaccatgcccggctaattttttgtatttttagtagagacggggtttcaccgtgttagccaggatggcctcaatctcctgacctcctgatccgcctgccttggcactcccaaagtgctgagattacagacgtgagccaccgcgctcggccataagctttttacatgggatcaattgccactgccaccagaaaggctgtcacagtgttgagttggggtatctttctgtcaagtttgaatccaaccttcctccacttgtgaatgaagttcttaatcttcatgcctcagtttcctcatttgtaagttggtgcaataatgatcaagggttgttatgagagctacataaattaataatacatggtaaggtgcctaaagaacagtacctagcgcatagtattcaggaaaagtcactgttta

SEQ ID NO: 128604 - DNA, 292 bp, Homo sapiens
tccctactaactacctttaaactagaacacactatgtcttcttacttctaggacacaatccctgatcaccccagtcttggttaactccctgtactgggatgaatagcgccctttaaaaattcaccagtacctctgaatatagctctaatccaatgactaatatccttttaagagggaaatttggacggacacacacagggagaacacaacgtgactacaaaggcagagactgggatgatgcagctacaagccaaggaacagcaaagattgggcacagccactagaggctagg

SEQ ID NO: 128605 - DNA, 362 bp, Homo sapiens
ttagggttctgctatgagaagggctagaatctgagagcctgtcgttcagctttaagtcagagtacaaagcaaaagaacctaccatatccgagggtgagagtgtatctttgactctgcttctttgggttaaggaggctggtagagagctagcacgcactgggtggaatgaggatagctggcagcttaaaccccgcttttctccttctgtgtaaaataccttcatgggaaactgtgggcctctctctgaacagtggaactgctactgtgctcctttgcttcagctggtggcacaggtggcgcagtgaggctagagcaagttcaggctggaataccagggaaaggtgtcccaagaaagcctgtga

SEQ ID NO: 128606 - DNA, 360 bp, Homo sapiens
ccgcctgctgtgtgtagtcagagccaaatatattagtaaagttgacataatgactagtgcacacttaactgctgacatttggtttactttagaggttatggaaatagtgactggttatattatcaaaatctctttttgtccaagttgtcgttaatatttcctacactgcaaaatttcagcactttgttaatgaaaggaaaatatttttgcttattctaacccagcagaatctgaaaaggagattttaaaacccaaacatttggtaatacagacatagacgacctattttaggaagactatttctatttttttaatttttaatttttttttttttttttgagacagaatgttgctctctca

SEQ ID NO: 128607 - DNA, 302 bp, Homo sapiens
ccaatttccctatagtaaaaaaagtttatagataccctttagccattttgctaatgagatgtgactttatttttctagagaatttttgtatattgatgtgaatctttgtcaagtgtgataaacattttttttctgactgttatttacattttttggtttgggatattttttgcatacattttaaataaatgtgtcttttcttattctttgtgactttttatgtcttttgttctcctgtaattcaggtaatattactctatatggcattttatttagtcttgctagaatttattttaaaattt

SEQ ID NO: 128608 - DNA, 708 bp, Homo sapiens
gataatgtatacataggaccatgcctcaaacttaaagtgcactcagtaagtggtagcaattgctttgattatattttaatgttcttactactatttttttatgggttccttcacaaattcattccttgttttccttctacccggagtttttttaagtagacagcagaaggacgttttaggcaaaggaactgcataatcccaggcagagaagaatgaaaatacttgattatatgaggaaatagagagtattctgatatagctagaaggcacaataaggagcagtgactatggaaaattagcggtgagattggggccaacccatgacaggccttgttccattgttgtggctttatcttctattcttgcttctcaaagtgttgtctttgaaccagtagcatccgtagcacctgggagcttattagaaatgtagaatctcagacctgctgaatcagattctgcattttaataaattatatggggatataatttatatgcatgttggtgtttgaaaagctctattctagatcattgaaagctttttaaggagaagagtgatgtggtcatctttgggttttagaaaaagtattctggtggaacaatagagaataaattgagattagactagaagcagtgaaagtacctaagaggctaccgcacttataaggctacttcatgtgagagaagaagagagtggactagagcagaact

SEQ ID NO: 128609 - DNA, 421 bp, Homo sapiens
agacagtcttttgtctggaaaataaataaaatgcaaggcatcagactctccaagagagtattgcatctggagttcatgttatcatagtaccttccttctaaagaagtgtagctggtaaataatcaaatgtaacagtccacactcatgattgaccttgcctggagtatgccgtcagtcaacattaaggtgttcattacaatggaggaggtaaatttaaagagtcactgtattttttgccttccaagatcactttaggtgtccttaatgtactgtaaaatctttctctttttctgaacaaaggctgagcctttaatgaccatcagttgttaaaaagaccagtgctaagctgggcacactggctcgtgcctataatcccagctactcgggaggctgaggtgggaggattgcttgagcccaggag

SEQ ID NO: 128610 - DNA, 348 bp, Homo sapiens
aaggagcaccgtgagggttgtgtgtcccaggattgaaaaggtcatcatacataaatcttctgtaggtgaagtgaaggtgaatgaaagttacagcagtctaagaacagagaaaatgccatgggctcattgtcttgatgaatttggctgtgactctgctcctaaatgctgggctggttctgacctgggcacaggagtttagaagaggggtctgagaggacccagagaggtaccttgatttggaacatcccagggcattgcttctggccttagcaacgaccctttgcctgaaaccatggactggtcttaagaattgaatctgtctgccctgtaatggcgtgcgtttaggaa

SEQ ID NO: 128611 - DNA, 1031 bp, Homo sapiens
gtactttcacttctttctttcacaatcaaggactcattttctgtccagttttatactctaagaacaattattgcaaaagttcaaaatagatttatttaaaattattgttcttcagtcattcccaacatagagtaagcttttctttctatatgtttctgttagtttgttgtttttaatctcatattaaagcttttttttttttctttttttcttgagacgggggtatcactctatctcccaggctggaatgcagtggtgtgatcttggctcactgcaacctccgcttcccgggttgaagcgattctcctgcctcagtctccctagtggctgggattacaggcgcctgccgccatgcccagctaatttttgtatttttagtaaagacgaggtttcactgtgttggctaggctggtctcaaacttttgacctcagatgatcctccctgagccaccgcgtgagccaccagcgtgagccactgcgcccagccaaaagcttttacacatctttgaaaagtcttctgtgtgataaccatttgtttcttatataagataaaagctttaatctgttagataataagaaaattctgaagaataactatgatgtgtgctacatattaatatcaattattctctgccaagaatgtgcatataacatacttaatactaatattaaatatatctttcttttccttcaattatttagaaaacatttcaagattttgctgtatgaacattagtcattgcattataagaagataaaatggcaccttggtgacatgatttgttttcagaacaatatgactcactgtcactgttagctatatgacttcagatcacttttatcatcactattaactaaatgagctacatgactctgtaaagtttattaaaatacccttatatggaaattagcagtcttgaagagatacagtgaagaatcacatgctttttgaaagaacattgaggtcgggtacggtggctcatgcctgtaatcccagcactttgggacactgaggcgggcggatcacgagg

SEQ ID NO: 128612 - DNA, 769 bp, Homo sapiens
gggcataaacccagacttgagcaaacactaagacaatggctcctgcaagaactgtctcctctcaatatttggagtatgtcagatacagcagtgcctttcagaatgtgcctaacatccctaaagaatttgaatatgccactctttttttctgatttaaaattttcttactgttgcaaattaagaaattaaaaagatgtttaagattttccataaaaataccaccccccaggaaaaactatagctaatatttggtacaaaattagggtcatatgctgtgcatttattacagtacatcatctgcatctttccatgtcaaatttatatatctattttttaaattttctttatcaaggtatctaacaattacagttttgagaaaagcaattaaaatttcttcctatctgctagagtttgttttaattttaaaggtagccaaagaaataaatgcatttttcaagcatcatggcaatatttgtcaggaaaaatataggcagcagtgtaattataaggcaaggattatattctggaatattgcagggtttatgagctggttacttgcttcactacattaactgaactcattagtgaaaccaagttttaagggcaagcttaatttgttttttaaaatgggattttataatattgaaacatgtttaaatgatcacagttattggcaattaatcatttggtatttaaggaaaaggttataaatattcagtataatttaaaaatcataaaagtgagttttggctcatttataagaaggaga

SEQ ID NO: 128613 - DNA, 264 bp, Homo sapiens
tctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcag

SEQ ID NO: 128614 - DNA, 347 bp, Homo sapiens
catgctattaactttgcctgaaattctctccctccttttcccacttaacctgaattcctacacatcctttaaaaatccgacttaagaattacatctctcaaaactttctctgcctttctttcctcccagatggttaatactctttactaagtgcaatctctgtttcttgtatacttctactgtaatttattttatctttctcccctacctatgaacatcttgaaaccattatcaatttcttattcattcctaaattcttggtacctaaaaaaaagtaccccagtaaagtgtttaatgttaaactgaataggggctgggcgcggtggctcacgcctgtaatcccaaca

SEQ ID NO: 128615 - DNA, 406 bp, Homo sapiens
acgagactggggcctaataaaaaggagcgtctgtctatacaggagcttaaatgggctgtaccttgtagcattctgaggacaggcctgaattctgggaagcgaaagtgataaaagtattgtccagtcctttttaagttggtggctgagcttggtgaggtgtgtttttaaaagacctttagtccgttctacttttcttgaagacggaggaccgtaaaggatataaaggtttcactgaatactaagagcttgaaaaactgcttggctgatttgactaataaaggctggtctgttatcagactgtatagaggtaggaaggctaaactgaggaattatgtctgacagaagggaagaaatgactgtggtgaccttctcagaccctgtaggaaaggcctttacttattcagtg

SEQ ID NO: 128616 - DNA, 302 bp, Homo sapiens
cactgcagccacatggggccagaaagtgccgtcgtccacctagctaactgctccctccgcttcgagactcagctcaagcgtcacctcctttagaaagcccttccagatcttctctccccctgaatccgacttccttctctgagccctggtaatccctggacatggtgtgccaggggtccttccgccctgccagaccccacctaagctgcagggtcattgagatgagtgtgacccccttcatctatgcagcctgtgtctggcacacagtaggtctcttagatgaatggatgaacatcatttgt

SEQ ID NO: 128617 - DNA, 358 bp, Homo sapiens
aggagtatcagacctatggtgctgctgagcacttaggtttttattctaaaggctatatgagttattgtggcattctgagaaaggaatgatgcatacaacctcatgttttctgaaagataagcctgactgctgtgttgagacaaggacacggcacacgagaagcagataggtctgttaagaggttgttgagttaaacaaaacaaaacaaaacaaaaaatgtgccgttcaagttttcagctttaagatatctttggataatgttatttctattctttatttttttcattagaagttaccaaattaagatggtaagacctctgagaccaaaattttgtcccatctctaccccctcacaact

SEQ ID NO: 128618 - DNA, 712 bp, Homo sapiens
ctcaaatatttgaaatatgtgaattctttaataatatgttctattatttacctcagagggattaatttgtactgattgggtaaatattggttagtgtaaataatgcacccgagattagaaagtggttaaatattcattgaaaaaatgactatgcagtgaagagaagaccgtcactcatcatagcttcaactttccctagccaggttagctcttgtgtccagggtttggttttttcttttctaccctaaacccagttatgagagcagcagcacagtacaagtaggcacgctgaactcttcattgtccctttaagctgtcaggttcctactctttcttgcctcctagaatatttgatggtatcagctgtggaaatgacattggacatgctccttggtataaaggtaatgagaagggaaagtataaattgatgttctaaatttttttataaatcatataggcaatactttcttttaaaagattacctagactttggcaataaagtgaagtggattattttaaatatctccacaataatatcgatagataattttattttttttaagacagtgtctccccatgtcacccagactggagtgcagtggcacaatctcggctcactgaagcctcgacctcctgggctcaagtgttcctcccacctcacccttccaagtagctgggactacaggtgcatgctaccacgcctgggtaattt

SEQ ID NO: 128619 - DNA, 394 bp, Homo sapiens
ggctcggtaccacaacgctgactcttcctctagataatcaccttcagtctgcctaactgatgctatggaagaacaaacagagactcagaagggtaagagggtggtggtggcgggtggtagatgatgaaagattacttactggtgtgaaccttcaagatttgagacaagtcttagttaatttggaaagtttattttgccaagatggcattgaggatgtgcacccctaacagcctcaggaagtcctgacaatatatacccaaggtggttagggcatagcttagttttatacattttagagagacatgagacatcaatcaatgtatgtaagaagtgcactgattcagtctggaaaggcgggacaacttgaagcaaaggcaggaagactggaagcggg

SEQ ID NO: 128620 - DNA, 579 bp, Homo sapiens
gggcttcctgatcgtgcacaggaaatggaggagatttaaatcaaactagtttattgttctctgctggtggtcttggtaactaagatgccttcacattgctggatacaattcttattactcttatgctctgtgcttgttcatcgcctgactacttcaaggctcaatattcttgtaaaatataaagtgaacattatgtgactactctaataataaaattactgtgaaaccaagtcctcaaagagaaaaggacataatgtttctactagacaagccacatactaacatgtcattcgaagttaaagttctaagccagattaattcatgaaccagatagatattccagggtaatctttagcatatggtgtattaaatcaatcttggtagtctgttccttcaaccctgtttggtttgaggtttaaaaacgtggaaaagaccacgtattagaatgcaggccagttaaagactaataaaacaataatagttattataaccattatgttagttatatgaccagttctctctgagggcaagggagtgtgtgtagcctcaaaccacaaagggtcacaccctgtgaatgta

SEQ ID NO: 128621 - DNA, 321 bp, Homo sapiens
ggcttgtgcctaacttagatctgtgattttggcaagatttcaaagaaagtgattcagagtatctgccagaatctcagtttcttattgccaggtctgtgccctttccactaattgtttgaattaatcacaattacctatgaagcctcttctcattctttggacatcttttccctattctgtgttaggcatcatttgtaaaaatctcaggagagtttattctttgggaaccatattgccttttcatgtctgtagtcaggagaccttttgtttccagatgagttccatccagcttcgacagctgcattcgctccaaacattttt

SEQ ID NO: 128622 - DNA, 352 bp, Homo sapiens
aaaaagcatctcactttatggtcaaaggatttttgggaagggagccaagaccattcaatgggaaaaggacaggtttttaacaaatgttgctgggaaaactggatatccacatgcaaaagaatgaagttggacttttacataacacaatatatgaaaactaactcaaaatgggaaaataatggcagacagggcgcataactaacttggagctcccactcagacacaccgagtagtgtgtggagactcacaccgtgaacttttactcgaagaactactaccacgggaacgtaccaggaaagccgagagaatccatagacctttcaaaggaagcagtttacagctgctggtcccc

SEQ ID NO: 128623 - DNA, 858 bp, Homo sapiens
gattattctgtttattttcagcctgactcaatttgtggatgaaaaaactaacatccagaaagtaattaattaaattccaggccttttaatgaacagtcttctgctttttctcttaacaatataatttctcctatggaacaatttgaaagccatgcatgcaaatttagactaaaagcaatggacataaaagaaacctgtatacattcttcggtattacgcacatgtgatgagtggtgcttttgggcacttgcctgacagtagcttggacagaaaagacactggagcctcagagaataactattgaagcaattctggaattaagaaataaggcctgaaatgagatggtaaaagatgttagaggaagagaagcaaggtaagacaaggtgacacacagaatcagaaatgatgaacaggaagcaacttttaaaataaatgttttctgagtagctactaatatgccaagccctgtgctgggcattgacattgcagcagtgaacaaaacagacacgatcctggctctcgtcaagtttatattttatagaacaaaaaaaaaaaaaaaaaaatttgtgcgcggctacgaccccagaaagtttttaacccattcgttggggcgcggaccatatgtgtaattgacaattgggccaaggtcggccaaagggaatcttgctccgaatatggtggtgtttccccaaaaaaaaccgcggggaccgggttttcgaacaccaagggttcgggctcacggtctcacaggcacagagctagctaccccgcgcggcgggaacaaaacaaacattcaaacacaacaacacaatatcacacatgtagccacaaaacaaatcaaccaacacacacaacaga

SEQ ID NO: 128624 - DNA, 716 bp, Homo sapiens
gattattctgtttattttcagcctgactcaatttgtggatgaaaaaactaacatccagaaagtaattaattaaattccaggccttttaatgaacagtcttctgctttttctcttaacaatataatttctcctatggaacaatttgaaagccatgcatgcaaatttagactaaaagcaatggacataaaagaaacctgtatacattcttcggtattacgcacatgtgatgagtggtgcttttgggcacttgcctgacagtagcttggacagaaaagacactggagcctcagagaataactattgaagcaattctggaattaagaaataaggcctgaaatgagatggtaaaagatgttagaggaagagaagcaaggtaagacaaggtgacacacagaatcagaaatgatgaacaggaagcaacttttaaaataaatgttttctgagtagctactaatatgccaagccctgtgctgggcattgacattgcagcagtgaacaaaacagacacgatcctggctctcgtcaagtttatattttataggaaatagatgataaagaagtaaaataaaataatgtcagatggcgatgagttcctggaaagaaatgaaacaggttaatatgatagagactggcccaggatggctagaagaggggtagaagtcaatgggggagtgttcaaggcaggaaacagttttaggcagagctcctaagccagt

SEQ ID NO: 128625 - DNA, 380 bp, Homo sapiens
ctaatgatgacttagagtttcacaggttcttaattgaccattttcattcaccttggctgatgcctagtgttacttaatgcttagtaagaaatctttaggccaggggcggtggctcacccctataatcccaaactttgggaggcagaggccggcggatcagctgaagtaaggagttccagaccagcctggccaatgtggtgaaaccccatctctattaaaaagtacaaaaattagccaggcgtgctggcgcgtgcctataacccctgttactctggaggctggggctggagaattgcttgaacctgggaggcagaggttgcagtgagcggagatcatgccactgcattccagcctgggcaacaggagtgaaactctgtctc

SEQ ID NO: 128626 - DNA, 543 bp, Homo sapiens
ctgaattccatgtacaaaggtagggtcagtggaacacaaaagcattatcagtggttcaaaaactaactccttgcagcttgttccctggatcatagtttgagttggtgtaaagggaagggaagaggagatgctcaaaaatatatccagtacacagtccacatattgctggatcaatgagctattgttttaaatgaaaaaatatgtatccattcccttcctccttggaaggctcggcacagttacacattattaagaactactttatcatacacttccggaactggaaaagactttgaatggccactggttcaactctgtccttgttacggtcaagggctaggaaacctgcataatttcacccagtagtcacaaacggaagtgctcactccactctcccacgaggctcagtcattaaacggaagtgaaaggtggaggaagcgaacagccactcagactgggacaagagaggcaaggacactttggaggtcatgctgtgtcccaggagagcagtacggggtaaggcatggggagcccagaggatac

SEQ ID NO: 128627 - DNA, 318 bp, Homo sapiens
ttcggtccttctgacaggtaggaatgagtcactgctttggctgccagcgacagaaaccagccctggctaatttagcacaaggagaacatgctggagggtgggcgcctgttgcatagtccagcaggcagctcagagacgggaccccggggtgctggtggctggggggccggttactgtggccaagaacacaaacatgccctgcagcttcaaggatgctgccctccaaatggcccctccttgccttgctcgctccagagtcaaagtgctgggaagagtgttttatcagtcaaacattaggccatgggcctgccctcagcg

SEQ ID NO: 128628 - DNA, 253 bp, Homo sapiens
tcaaatctcagtgtatgttaataactattagaacacaaccatgcccaggcatttacatgtggctgttttccccatataatagaagagttgaatagttggcaatgaagactgtggcctacaaaacctgaaatatatactatcggtccctttacaggaaaaatttgccaaaccctactctaaacaatattccatgactggaaatgtgttttctaaaattctcgtattaatgcagagaataaaagcaacagatgtc

SEQ ID NO: 128629 - DNA, 389 bp, Homo sapiens
atgctttggcaatgggcttgacataattttctggctaaatcattctttcctcacttatttgaaatgtcaactttatcatcctgtgaaatattaccctttttttcatttttggattctccagtgttttccatggagctgtctgtcaacacccccattaatatcagtctgtaatattcattatgctttatgctttaacaacaagcagggctaccttatgggtgctacatgccccaatcacaaaggtgccacctgctacaataatataatagcatttaaagaaacaaatgccaaatttaaaatcattcttcaaaataacaaccttacatattcataacatggaaagacaagaatattctagcaaatattgtagacatcaacacagaaatcaa

SEQ ID NO: 128630 - DNA, 477 bp, Homo sapiens
tgaatttagggagatcatttaataattgttctcggtaaaaatagacacaaaaagtacacattttacctattattttaacattaacacattttaacctttagttctgcttttattgcaattttccacataaattaagcattcctatttataaaattatactagtttaaagtctgatattcctacaagaatagtaggtatattgaaggtattaaaaataggcaatcatttaggctgggtgcagtgactcacacctgtaatcccaacactttgggaggccaaggcaggtggatccacctgaggtcaggagttcaagaccagcctgggcaacttggtgaaccccgtttctactaaaaatacacaaaattagctgggtggggcggcacatgcctatagtctcagctactcaggaggctgaggcaggagaatcgtttgaaccaggaggcagaggttgccgttgagctgaaatcgcaacattgg

SEQ ID NO: 128631 - DNA, 392 bp, Homo sapiens
taatttgggttgtaaattgactgttgtctcctgagcagtctcctggtgagggagagtttcactggagctttgaaacacatgttagacagccttgccctgtagggagtgtctcgtgaaggagaggtaaacaattataattgcatttctaaagggctaagtaggacatgggaaactggaaaatggagaaaagaagagaaaaaaatagtaactcattctctttttcttagaaaaatgaggatacttggtcacatcctcacatggtgaagaataagatggtctcttcatttcccttcaacactagtcccatcgtgaggctctgccctcatgacctaatctaatcctaactgcctcccaaaggtcccacctccacatcccattattggggattaggg

SEQ ID NO: 128632 - DNA, 243 bp, Homo sapiens
gggacatgtatgaagtctactcgaaagatgtgtcctttaattactcctgcacttggcgaggcctctgcttcccagccttgtgttaactgtggcctctgttcagactcctgcagcacacggaggagtcagcgtcatggggtctacagatccaaaacacaggccgggcgcggtggctcacgcctgtaatcccagcattttgggaagccgaggcgggcagatcacctgaggtcgggagttcgagac

SEQ ID NO: 128633 - DNA, 116 bp, Homo sapiens
ggaaatcgcaccactgcactccagctgcctgagcaacggagcaagacactgtctcacaaacaaataaaacaccagctaactatatcaataaatttctctcagccattgcactccgg

SEQ ID NO: 128634 - DNA, 250 bp, Homo sapiens
aaaatgtgtaccaaaaagcccccaggaaactataaatgctgagcatgggacttgggtgcctctggaatgtccttctgcctcagctactctgagataacatggttccctgtgttcatggaacccagatggccaaaagtcaatgatccagcacttaaaagaaaagaaagcgattcaagagcctctgtacccacctaggcctcagcctccccaggacctactcacctatactcttcacaacaggtaacgttgc

SEQ ID NO: 128635 - DNA, 960 bp, Homo sapiens
agaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggtggatgtctggattctgttacaggagtatgcagggtggtggaattagaaggttggcaaaaaaaaggcaaaatgtgtggtgttaggtacagggggttggggttaaaggaaaaagtgggtgtgccaggaggttaagggagagtacattttagtggagaagtaagatataggagaggagggaaaaagagtttgagaaaaaggattaggtttgaaaatattgc

SEQ ID NO: 128636 - DNA, 1318 bp, Homo sapiens
agaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgata

SEQ ID NO: 128637 - DNA, 1452 bp, Homo sapiens
acagcggtgggagcctgcgggccgcagccccggcgagagtgtgccgcacgcccgcctccgaggccaggccctagctccgagaacccctcctgcggccggggcggctttgttcccggttccgacgggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgata

SEQ ID NO: 128638 - DNA, 1576 bp, Homo sapiens
ggccgggcgcgcgggcgggcggcagtggcttggcggccgttgtctgtggaggggggcctcgccgggctcccggaggccgagcggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagggtgcagaaaacctatgccgaggactcctattttagaagggaaactaggtaaagaaaagtcagcagagaaaaaggaaaagagagaaatactgcctggctcagaaaacaacattcttttcagttgaaatagagggaatgcagctgaaagaagagaatgcttctggtgagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgata

SEQ ID NO: 128639 - DNA, 1501 bp, Homo sapiens
agaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgata

SEQ ID NO: 128640 - DNA, 2629 bp, Homo sapiens
agaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgataaaagttttttgttctggtgaagtttgtgaaatatatttaaattcttaatttttctagtgttaagtcataatcgtttatagttgatttatattaaatgcttttgcattttggcatatcaatttaatgattaacatattcaaacttggtaatcactccccttattttcagtcgctcttcccccaatctgtttagaaatccttttaaagccttcttacagaagatagtcatcagttagatttagcccccttttaagagaatctccctttcaattttagccgtaacattatcaatttcagacttcatcctgcatctcccatcacctcctcaaagaaaaaaggtcaacattttttcctactttatttaaatggtaaccagcagaggttgcagtgagccaagatcactccactccactccagcctgagtgacagagctagacactgtgtctcaaaaaataaaaataaaaaataagactcatcagataatgtattttttccttacaactatcatagatatttttaagaacccaagaggaaaacagtctatcacatttaccacaatatttatcatttgtattaatcttccttaattcttgatgttccaagtttacataggtatcagtccttttcatctggaaaatttcttttagtgcaggtctgttgacatttaattctcttattttttcttcatctgagaatgtctttattttgccttaattcatgaaagatatttttgctggatataaactactgtgttgacagttctttcagcctccatggtttctgatgagaaatgtgcagccattaaagtaatatttcccctgtatgaaacatgttatttttctctgagtattttcaggaatctttgtctttggtttttattggtttgattatgatgtgcccgggtgtttgaatttattctctttgggatttgttgagcttaaatgtgtaagtttatgcctttcatcagattatgtaaagttttaaaccattcagatattttctgctctactttctcctccctcttaggctccagtgatgcaagtgttagactctttggtattatctcacagatctcagaacctctgttcatttattttattttaataaatcatttcagttaacaaaatca

SEQ ID NO: 128641 - DNA, 1183 bp, Homo sapiens
agaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaataaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgata

SEQ ID NO: 128642 - DNA, 577 bp, Homo sapiens
attttagacatctacttgagtggattaagagacacacatagctggtcaaacacgatttctgggcatatctatgagggtgtttctggaagacactgagataaccatgacccaatgtggatgggcactgatatggtttggctgtgtccccacccagatctcatcttgaattgtagttcctgtaatacctacatgtcgtgggagggacccagtgggaggtgactgaatcatggtggtggttaccgccatgctgttctcatgacagtgagtgagttctcatgatctgatggttttataaggggcttttcccctttgggtcagcacttcttgttgctgccatgtgaagagggatagctttgcttccccttctgccatgattgtgaggcccctgcagccatgtggaactgtcagcccattaaacccctttgttctttataaattgctcagactcaggtatttcttcatagctgtataaaaatggatgaatacaggcaccatccaattggttgagagcccagatagaataacaaggaagaggaaaggtgaattatctccttctgaaatggaaacatccttcttc

SEQ ID NO: 128643 - DNA, 290 bp, Homo sapiens
ctattcctgctctcagagcacagtaccctcagtcagagaacctcatcagtcagcccatcccccgtgttgtagagatgggcaaatgagtgcacagagatctgattgtcctaaggttacaaagtgaatcagcaacagatccaggaatgaggatactgcctcctggtcctgggctctcgagtgggtccagagccctgccgtcgatacatcagccttcagaagggacttccaggcctgggaaagcctccccaggaggcatccttatagctaagcagtctagacagaagggtgca

SEQ ID NO: 128644 - DNA, 1306 bp, Homo sapiens
  misc_feature (912)..(912): n is a, c, g, or t
  misc_feature (924)..(924): n is a, c, g, or t
  misc_feature (999)..(999): n is a, c, g, or t
  misc_feature (1039)..(1039): n is a, c, g, or t
cgacgaattatgtatgagcgtcgatacgctggtgttatttcagtcacggggctcggagtttgcttgtttctgactgtgcccttgtgtattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcagagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatantaacattttcantgatgagcaagacatacttaatgcatattttggtttgtgtatccatgcacctaccttagaaaacaagtattgtcngttacctctgcatggaacagcattaccctcctctctcccnagatgtgactactgagggcagttctgagtgtttaatttcagattttttcctctgcatttacacacacacacaaaccacaccacacacacacacacacacacacacacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttccc

SEQ ID NO: 128645 - DNA, 1399 bp, Homo sapiens
  misc_feature (1005)..(1005): n is a, c, g, or t
  misc_feature (1017)..(1017): n is a, c, g, or t
  misc_feature (1092)..(1092): n is a, c, g, or t
  misc_feature (1132)..(1132): n is a, c, g, or t
gctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcagagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatantaacattttcantgatgagcaagacatacttaatgcatattttggtttgtgtatccatgcacctaccttagaaaacaagtattgtcngttacctctgcatggaacagcattaccctcctctctcccnagatgtgactactgagggcagttctgagtgtttaatttcagattttttcctctgcatttacacacacacacaaaccacaccacacacacacacacacacacacacacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttccc

SEQ ID NO: 128646 - DNA, 912 bp, Homo sapiens
  misc_feature (518)..(518): n is a, c, g, or t
  misc_feature (530)..(530): n is a, c, g, or t
  misc_feature (605)..(605): n is a, c, g, or t
  misc_feature (645)..(645): n is a, c, g, or t
agaccaacacagcctggaccaccacagccaccccagcagaggccttatggatatgaccagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatantaacattttcantgatgagcaagacatacttaatgcatattttggtttgtgtatccatgcacctaccttagaaaacaagtattgtcngttacctctgcatggaacagcattaccctcctctctcccnagatgtgactactgagggcagttctgagtgtttaatttcagattttttcctctgcatttacacacacacacaaaccacaccacacacacacacacacacacacacacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttccc

SEQ ID NO: 128647 - DNA, 1183 bp, Homo sapiens
  misc_feature (789)..(789): n is a, c, g, or t
  misc_feature (801)..(801): n is a, c, g, or t
  misc_feature (876)..(876): n is a, c, g, or t
  misc_feature (916)..(916): n is a, c, g, or t
agaccaacacagcctggaccaccacagccaccccagcagaggccttatggatatgaccagctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatantaacattttcantgatgagcaagacatacttaatgcatattttggtttgtgtatccatgcacctaccttagaaaacaagtattgtcngttacctctgcatggaacagcattaccctcctctctcccnagatgtgactactgagggcagttctgagtgtttaatttcagattttttcctctgcatttacacacacacacaaaccacaccacacacacacacacacacacacacacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttccc

SEQ ID NO: 128648 - DNA, 1253 bp, Homo sapiens
  misc_feature (859)..(859): n is a, c, g, or t
  misc_feature (871)..(871): n is a, c, g, or t
  misc_feature (946)..(946): n is a, c, g, or t
  misc_feature (986)..(986): n is a, c, g, or t
gctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcagagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatantaacattttcantgatgagcaagacatacttaatgcatattttggtttgtgtatccatgcacctaccttagaaaacaagtattgtcngttacctctgcatggaacagcattaccctcctctctcccnagatgtgactactgagggcagttctgagtgtttaatttcagattttttcctctgcatttacacacacacacaaaccacaccacacacacacacacacacacacacacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttccc

SEQ ID NO: 128649 - DNA, 1016 bp, Homo sapiens
  misc_feature (606)..(606): n is a, c, g, or t
  misc_feature (618)..(618): n is a, c, g, or t
  misc_feature (693)..(693): n is a, c, g, or t
  misc_feature (733)..(733): n is a, c, g, or t
ataaccctctgctgcagaataccctgatgcgacagaagtctctctagagtttggaaacctttaccaacaaagaaaaattctgatgtattctctttcagttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatantaacattttcantgatgagcaagacatacttaatgcatattttggtttgtgtatccatgcacctaccttagaaaacaagtattgtcngttacctctgcatggaacagcattaccctcctctctcccnagatgtgactactgagggcagttctgagtgtttaatttcagattttttcctctgcatttacacacacacgcacacaaaccacaccacaaaccacaccacacacacacacacacacacacacacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttccc

SEQ ID NO: 128650 - DNA, 1022 bp, Homo sapiens
gctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcagagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaaggtgagtgtctctcagatctaaaggaccagagaacctttgtccctccacggatgcgaacactggtaagagtgggagaatatcaaaaatgccctcactgccttcttctccccatgtctatcacaacacctgatgtcgcaccgacggcttgatagtaccaacagttgcgattgttaatacttcttttgttttcatagtgatgccagatactatttcaagcagttcacatggattaatttatttaatccttaagaagacattgtttctattatctccaaataataatgagtcacacacttcagttttcatccatatgaaagccatgtgacttgacacaaatcttctaagttctctgagctccagattcctggtccatgaaatggaagtaaagaattatagttcatgttttagatcatagttatcagcaacataataataaaatgaggctatcgtggtacagagatgttaaagaattttcctggggcgcagtggcagtggtagtctaatccagagctccaagccatttaaagctcattcacatttgcatttgtctatgaagttcagatgttgctcactagggcttcaccccatagggcctgctggtgcttccaatgagacacccac

SEQ ID NO: 128651 - DNA, 298 bp, Homo sapiens
cttaacattatagcacacaccttttgtgatggtataacatggtctaatcaccatggttaatatgtgtattcctattagtggatgttccataatctacttggccttttccctaattgttaggcatttttagttctttctgcattctgctattgcaaatgtcactgtactttggtccatgatgaatttccaggagggcgagcagggtagaatgagtactgtccagtgagtactgtccagcagtgaccactattgtgccccactcctccctttcagaatagccgttggcatacagtaggag

SEQ ID NO: 128652 - DNA, 124 bp, Homo sapiens
gccactaactgattgtacagggtgctaggatgtggctgtctggaccttggaggttcaaagagctattcctgtcccacaggggttttatcaagggcaagatcggagtccacaagcacacccagga

SEQ ID NO: 128653 - DNA, 537 bp, Homo sapiens
aaagaggctccgatgagctcacggagtcaggaaccaggtcttggagaggcagtaagagtgctgtggcctctcccagtgcctgcctcccggtgcagggcccataggctatgatgggcgggcaggaattcaagagagaagcagggggacccgaggccacagggcaggtgggcagaaagggggtcctggacccgctcgaggatgactctgagaggacaagtactaagcagatggcagatggcagccttcggtgtagacggcttcaagcagctggcagcatccccagggcccggggccagcctttgtgtcctgcagtcagaccaggcgcatgaccaagctggtcacctaaaacttatctcacttcagggagactgaaccccaagatccccgtgctctgcttgagggtattaaattggcagacgaaacggccagccagccatgctgaccagtgacaggacagcccttcccaggcaagtttgatcttgttcccacactcccaagatcctcttcccataatcccaataacccatgaaaatgtcc

SEQ ID NO: 128654 - DNA, 505 bp, Homo sapiens
acaaagacaacgaaagcagccattaaatggctctgcaggaggcagagggagagaagtgtttttgctccagagaggaaaggggagagggaaggagggctgggaaacggactgaagaggagaccagagccaggagctggatagtgacaggaggctgggtactggtgggccaagtcaaactctgcaaagccagggcccagaggatgcccaaggatggagaacatggaaactgacctctgtgtttctgtcaagtgtgcctttcgtctcaccctccagcactaaagggctcaattcacttgtgttaccaaggtttggtgactgcggagttaccaaggtttggtgactgcagagtctaaggggagcctggcagagatgaaggggaaagactgaactgtggaaactatcaacttagtccattttgtgcttctatgacagaatacctgagactggtaacttataatgaacagaagtttatttggctcacagttttggagggtgggaagtccaa

SEQ ID NO: 128655 - DNA, 431 bp, Homo sapiens
attcggcacagggctgaggcgcaccctcggagctccccctgcctgcctcctcctcctcctcctcttttctgcttcctgaaggttacctgccttttagggggctcttgtctaaaggatcttcttgctttctcagctatccttggcttctttttcgtcttcctcctcctttaactctttctctcctttcctcccttcacccgttcgtcccaagcccttgggtgcatcccgccctagggcacaccagacggccagaatggggaccctagggtggagggaattcccccacgccatctccgcacctgtgcccgcctctcccccctcgaggccccgtcgagggagggaaggggcagtaagcggggggtcgacaaccccccccaaaacctttaaagtcttccattttctggctctcctcctcattgacgtccctcttc

SEQ ID NO: 128656 - DNA, 1157 bp, Homo sapiens
cgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttagggggtctccctgcaatgcagcgcccccttccgtcctcgggactcctcgctcccacccggaggaggctgcgccagctttaggccccgccctcctcccaatggctccgcccacagactcccttatttcaatggccgcgccctcttttcccgacctctccttttcattggtccctctcactcccaaatgactcctccccttcgttggcccgcccctttcctctggcccctcctctccaagaaaattagctcctccctcgttctccacctgctctgagctgggagcagccagaggcggtgcaagcgcccagctccccagagctccccaacctcggacctcaccgcagggcgctgggctggagagcaggttcgggcagccgtcgggaataccgaccatcctcttctcccttctaacctgggcttcctttttccctgcctaatctcacctcctgacctgctgggtcctccggtgcagtgggagggccggcttgctccacccgcagccccggggtggcgtagggaagggggctggaagccacgggtacggttaacctggcccttccctccccatctcccctacttccctggaaggtcccattctttctcaccggctgggctcttttctgcttcctgaaggttacctgccttttagggggctcttgtctaaaggatcttcttgctttctcagctatccttggcttctttttcgtcttcctcctcctttaactctttctctcctttcctcccttcacccgttcgtcccaagcccttgggtgcatcccgccctagggcacaccagacggccagaatggggaccctagggtggagggaattcccccacgccatctccgcacctgtgcccgcctctcccccctcgaggccccgtcgagggagggaaggggcagtaagcggggggtcgacaaccccccccaaaacctttaaagtcttccattttctggctctcctcctcattgacgtccctcttc

SEQ ID NO: 128657 - DNA, 533 bp, Homo sapiens
ttgcattatcctcccacccgcccactgccaccaacactgctgaattatgggctagaagagctggtctccagtcttgccagatcccaatactgtctggaattaggcaatgagaggaactctggtcattcaacccatgtcggatgtgcaaggtgaaacttcacaaaaataatgtgtaaccaagaaaggaccacacagaaccacagaaaagtcctctctctttctcatccatctgtcgttctttgaagctcagcattatcttgcttcccagaagaggaaaaagaagtagggagatgaaaaagggtgctcagatcttaatctcagtgtcccaaaggaaggacagactgttccagctgaatctgggatgatcaaacacatctcaggcaagcaaagctgacagtcaggtctgtcatccgactgaaaactagacagggaccagggatcctaactggttgctgggtaaaaactacagggacgtctgaccaagggcactgggtctgcagaagaaaatggatccccttctcttgatgtctagt

SEQ ID NO: 128658 - DNA, 235 bp, Homo sapiens
aatctccagtgctacatgagggcgaggtatgactgtgcgtcgcccacagcctctgccttactctcctctcacatatacacacacaagcacacctctgccctatacctagcataagatttgtgtacgtgggagggccttaagtgtttgggtgtttttcgtttcttgccttataagcttttttggaaaagattccagaagacacttagagtaatcaaacatcgtgcagctggcatgg

SEQ ID NO: 128659 - DNA, 720 bp, Homo sapiens
ctgggctgacctctttcagctggagaaagccataagcgctcactaacctgccgtgctcaccatgaacttccacttgaccacataggcatccccctcgtggaactgcccgatgctttgtttggggagcctgctatagtcaaattccaggatgtaccagacatccacggagacactggtgatctcaaactgcctcctgtggtgtccttccaccaggccatagccacagccaatgttcaccctgtccaggatggcacctgctgttgtctggggcacggacaccatccgtgtcacgttgttccgcttgacatcggccctggagtcttcctataggggaacatgaagacatcggttcagttgcctgtttccgcagctattccttgtcacactcaacgctgcttcagctgttcatgggacagcataaaaatacaccttccacactctgtctcaggatgtttaactgcagtcagggaaaggctgcattttcagaaagactctggcaggtctgaacacccattggccacactggtgcatggggtgcctgaaaacaggtgcaaacccgactcttcacctcccagagtcagattagaattggaggccagtctgctgttctattagtgaatcctgggaaggcctcttagctttaaggggtgtgtgtgtgtgtgtgtgtatgtgtgtccattttttttaattaaaaaagtattttagttgaaaaaataaaaa

SEQ ID NO: 128660 - DNA, 410 bp, Homo sapiens
cctgaaaaaaaaaatttataggaaaatttccccaaaaggtaagcacaataaaaagtcaaaaggaggtacgggctgaagaatgacttcctgcaatgtgtaatttcaagttcccatacagataactcctctgaggatctgaggaacatgtgttcttaccttgtcctgattctcctatacatcttcttgggagagaactgtgcaacttaaaggctaccttattttgtactgtgaatgtctctggagctccttgggaaaaaagttatctgatttagctactatgtgccttttgaaagaaaagggctatgtaagaagacagcagtctcacactgtgccagaaaaacactccaaactgaaaatgaaaacaaagtttcacttttggctctagtgatacttgttgtacttgctataga

SEQ ID NO: 128661 - DNA, 303 bp, Homo sapiens
ggcactgctggataacagggaccaggacttataaagtctgattcccatgtgcctaggacgctcgctggcacatagggagcattccgttgttgatgaagatgatgagagagatcgtgactcatctcatggtaaattccactagcatccctaagtagaattggctgggcactttttaaaaactgatgactatttcagaccattacgcccagatttcatctctacattttaaaaacagtgtagtaaagctggcaatgacacaaaagagaacaggagaaaaacaattatagtgataaaaaaaataag

SEQ ID NO: 128662 - DNA, 245 bp, Homo sapiens
ctggcctacgtgcacgtccaggcatagtaccttcccttgaacttaattatgatatagattcttttgctcacatgttttttttgttgaccttctccttcttatcaccctgctctcctactacattcctttttgctgaagtaatgaaaatcataataaaaaaaactgagggaactcagaggccggtgccggtgcaggtccttggtgtgctgagtgccggtcccctggacccagtgttgtttccctat

SEQ ID NO: 128663 - DNA, 122 bp, Homo sapiens
cgccaccctccccagcacctagctccgctccttggaaatccaaggttgtctcccaggcccagggcgaagggcctaactgtgccaaacagactcagggagggaagacaaaccgccaatgctcc

SEQ ID NO: 128664 - DNA, 313 bp, Homo sapiens
gtgatccacccacgttggcctcccaaagtgctgggattacaggtgtgagccgctgcccctggccctaaatagattttaaataagttttctggatgcacacactagtaaacacaaatgccaaagacttgccttccaattctctgtctacctctaactcaggctgttgtcttggcacagttaaacaacttttctagcctcaatattttcatcttcaaaatcaaaaataaaatgtattacatatggatctatgacaaatagtgatatattccatgtgcacgttatcattaaacatgaattaaccaatatttaaatc

SEQ ID NO: 128665 - DNA, 382 bp, Homo sapiens
ttaaatgttgaaggtatggcccaaagtacagcccagtgaaagtgatttgggaaaggaccaagctactgaactttttactgaatgattagcattattggatttgaggatagaacaataaattcctagatcaatgctcctaaaatgcagtattgcgatatactactgggtcatgatctattaataccttccccagaggtaattattattctgattatcaccatggttaggcttacctcggaagaaatggaataatacaatatgaacttgcttgtctggcttctttcccttaatgtgtctgtgagattcaacccatttgtcagtgtaccaattacttattgtattgctgtgtaattttctgtatagtattatatgaatataacac

SEQ ID NO: 128666 - DNA, 302 bp, Homo sapiens
cggtgccctcactgcgaccgaggcgccctggagtcgtggcggaggacgtttcctgcgttaagacaggtgtctgtgctgcgctcaaagaaaatgtaccccctaagtttgtgtgtgtgtttaaatttattttaaacttttagtaagattcactttttggtgttcagttcagtgagctgtagcaggtgcatggactgtagtgacttccaccgcagtcaggatactcaggaaggcagcctctctcctccccgctcttgcagccgcctgtctgttcctcagtcctcctgctttgcccattccagaat

SEQ ID NO: 128667 - DNA, 312 bp, Homo sapiens
cagtgagcagaaatagctcttcactcgtatcccagccatgcttcatccttggctgggaactatcttgggagagtgtaagcatggtttgaatattgcagtggatccccagtggggaagccatcagctaactgcattctttgaaacatgttaatttaagtggcacatctccatggctgccacaaaggctgtgcgtgatacattttaatttaacaaacatttattgattgccaattttatacaaataatatgctagacacttgtatatcttcttttgagaattgtctattcatgtcctgggcacacattatggag

SEQ ID NO: 128668 - DNA, 888 bp, Homo sapiens
tttgggcagcagcactggttatctccctggacatatgcccagacagtgtaagtgacttgctcagggccacgcagccagcaaaaaatagaacctaatgaaatagggttctccttgccacacccccaagctgaaactgtgcccagaagctggtccttctgtttacaagttcccattattaggacaacctgtaatctttttttcctccatgtctcagagttcatttttggatcatggcagagttaaaaaagtggagaggctatagacatgcctggctttctggccactagatctttgtggcggtctagggtgtatttgttgtgccccagtttgtctgcattttaaggcggaactggccctggctgggaacgaggaggtccaggagcagtaggaatgttgatcttaggtcttgggcctgcctccagcacccaccaaaagtcaccggatgtggaatattagactcatgtaaagcaggaagtttgcaccagagccaagaagagagcttgcagctgccagggaatggcctggcggaggaagcgcagcctcgcccagctcagcagacctgcttcatgacagaggcagctcttctgcactctactggggccacgccctgccagcatatatcactcccttcacctggtcaggcccaggtaccttgcctcaacagcaagttctccagaattgaggggaagagagggagtgaatttgcttctctaactccagccacctgtctctgccctctcctggtctataatgctactttgcattccatttgtttattgtctgcccacctctcaaaggatatcagggccacaaaggaccttaaagaccaccttatacaatggtttcaaggtttctcctttcccatcacgaccagcccacctgccaaat

SEQ ID NO: 128669 - DNA, 514 bp, Homo sapiens
agcagtctgtacagagaggggaataaggggaatgaacacagggagagcagaggcaggagaccacatgtgctacacgagagaagaaagggagagccacagttcccaaacctccagctcagggccccacgcagcttcactgcactttatttccttccttcctgctgtagatcgaggctatgtaccaaacaaatcaatcccacacatgaagggtcactgagatgaaaggaaaagtttcaagaaagggatgaacagtgtcaaacaggtaaagtagtaaagaggaaggcagatgagggaaagacaaataaaaggtcactagtgccttatgaaaagggccgttgaggtaaaattttagagactgaagtcagattatcgggacaaaagagaagcaaagaaacagacattgaatataacctacttgattgagaagtttggcaataaaaacataggataggctgggtgtggtggctcaggccagtaataccagcattttgggaggccgaggtgagcagatgac

SEQ ID NO: 128670 - DNA, 184 bp, Homo sapiens
gtcatagccaaggagagcttaaggaggcaggatgaataaatgcaatgtggaatcctggagggggtcgtgggacagaaaaaggacattagattacaaatgaaggaaatctaaataaaccaaggactttagtcagtgatcatattcttgactgaataattgtgacaaatgagccgtattaatataa

SEQ ID NO: 128671 - DNA, 631 bp, Homo sapiens
gaacacggattatccccagacccttgtcatttctctcagtgagctctgagttctagactgctttgaaaatgccatattcattttgctaacttagtatttggggaccctgttccttggctgttcttttcttggaacccttctcagtcaagcctgtagggtatctttctttacccaccactcattcaattttgtttaaaacatgcacgcaaccctaaggagtctcaagaataagcttacttggttagtgtgttatttattgagcatagcttgtcccaaccactgtgttagattataaaaattagtggattgagtccactttgttgtgttgttttcattattgaaaataaatataactttgtatttgaaaaaaaaatgaggttgtgttatggcatgataaaacagtaaagttgtacctcagcattttgatgtagggattttctgcttatcttatttatacttttatcactttaatgtttatccgtatgcatttatcacttattatcttaaataaactcttaatttctcgaaaagttttagatttgcagcaaaagtggagaggaaggtacagagattacataacttatatcacccctgtccctcacccacattgagaggtattatgaggacctcg

SEQ ID NO: 128672 - DNA, 450 bp, Homo sapiens
gcctcccaggttcaggtgattctcctgtctcaaccttccgagtagctgggactacaggcatgagccaccatgcctggctaatttttgtatttttagtagagatggtgtttcacatgttggccaggctaatctcgaactcctgaacttgggtgaaccacccgccttggcctcccaaaatgctgggattataggcatgagccactgtgccctgccaaaaataaaacaaaattttaaatgcttgtgatcctatgatatcagtcttttcagtttcctctttctctgaaagtgggtaagctttattgtgattattacctatgaactttgttcctccctttaggaaagtgagatttgactttgattgaatgaaaaatatttaatgctagtaatctgaaaagaggaaatatactcatttttcctctcacatttgaattgggatgaattttatatcta

SEQ ID NO: 128673 - DNA, 489 bp, Homo sapiens
ctgccctcgtccctgctgcaggtgcaccggccctgccagcccagtcccagccctgttcctccatggtgaatgcacgtgcttctctttctgctcaaattcctttcctatccatgtttgctggggaagttccagttctctccagacgccacctctgtgagaagcagcctctgacaagcttgccctctgctgcaacacccagggctctcagggcttgcagcacctcatccaaacttccgcttgacgccccactcctgggctgaaataacgtgcagacacgtctagtccccctactgtgtgcattcctgcaggagaggccagtgcgcactgcaactcatgggttttgaatgaatacatgaagggaggggaggttcctccagcattatctgaaagtgggtggcaacaaaacacaggacatcctgagcccacactgacttaaagcaagtccttgctttgctgtagacagtgcaaataaagagactagtctgttgt

SEQ ID NO: 128674 - DNA, 260 bp, Homo sapiens
tcccgggcccagcaaacaggtaatgtgactctcctgcctagtccctggcctccaggaagattttgacatattcctggctccaaaaaacaggtgacgtgactctacttatcattccctatccacgggtgtaattgtcacatttatcttggcctagctcacagatggcataagtctcataccttgaaccagccaatagcagagatcctgtgtctcttagcaaggcttaggcaaataggtgagttcatgggcctccgctttat

SEQ ID NO: 128675 - DNA, 337 bp, Homo sapiens
ctactcccttccccacaataattatgctagttttctattcatcatctctatctaagtattccacatagtatttcaggttaatgaatatttttatatctcctatttccagataaaaccatataaagttctctcaggtcagacgcacagaaacacatgtataagctacatcatcatatatcatcactttggtgttttaagtcatagaaccattgctcactgtagaacaagacagcaaaaatgatgctttatgaaaacagaaagtaaatttcacatctatcattcatcttataaattctttgtatcaaaattttaattaattagagtgacctagtttcct

SEQ ID NO: 128676 - DNA, 267 bp, Homo sapiens
atgttgcgcaggctggtctcaaactcttgagctgggattacaggcatgtgccaccgtgcccagccccaatctagtttaaatataaaactggagccaagatataaaagtaaaagaaacttttttccctagataggaaagtttaaaaacttgggaatttagatagatgtggaggtttaagtttagatcctaccagtaagtagactctccccatgtagcacttgtggtatatcttagcactttggagagaaagttgaactcttttcagcc

SEQ ID NO: 128677 - DNA, 489 bp, Homo sapiens
gatcttgggcagatcacttaacctctctgagcctcagtttcctcatctgtaaaatgggaatgttaatcctatccacattttaggatggttaggagtctggaatgaaacgatagacatatagtgttgggcaaaatgcctagtgcagtggctgattcaacaaatggtaatgattattacactaacttgatggagaaataaagatcggatcactctgtgatcacctgtggcctctgtgccagcagccactcatttgttattcctctgaaatattcaactcgtgtaattttatatttatggcatgtgtcagcctcttttgctattaatgcattaaaataggtttcattttttattacagataaattgctgatgctgtaaatcctacttcttttcctttacactctagggagaaaaagaaaggggtaaagccattcaagagaatcagggaatagagaaaaatgtcttgggaatctcctgttgggactcagagaa

SEQ ID NO: 128678 - DNA, 334 bp, Homo sapiens
cttttatccccccatgctaaattactatttacccttcctaatagtgaagatgcatctgcaaacaaaggatcagtagcttcaagaggactggttaaagcatgatatcttttttgtattatttattttatgtctagctgattaatagggattttagagttattttagcctaaccagcccctttgaacagttgaagaagctatgatgcatggcaggcaataagttttagacacaggtcttttgattgtgtggttgacctactcaagccaactctagagaaaaaatggtttattttagagaatctcatgaaaatccaaggacaggtatcaaaaattag

SEQ ID NO: 128679 - DNA, 375 bp, Homo sapiens
gttccctgagaagatcctagcccttgtaagatggaagctgacatcactgtaatgttcaaggggcacagacattaggatgggcggtgtgatctgaacacaggataatgctgctagtgtcagcaagaggtcccaacacccgccctgcagctgccaaacaatcactgacagactagaaggctttccagacccctgcagtgtaacaccattgtatggcagccttgatcttcgtggggccttgtgggactccagaatgatgctaggggaaccagggctcaggccctggtccactcctttcctgtgatctcaccatttccatagctgtaagtatgtatgcagtacacacaggtatgaatttcacatttatatttctagcct

SEQ ID NO: 128680 - DNA, 451 bp, Homo sapiens
atcctcccgcctgaacccgaaaaagtgctgggacttgagctaccacacctggccctgtgtttccaatgaaaatgttctaggcattcataccaataatcttcctgaagttttgtcctttttttgttttaactccataccacctattggctaaatgcatctctttatacaatagtgtccaaaatgttgggcatatttgttcacagtttctaaaatcagagtgataccaccattaaccattctttttttgttggagatttccacaacctgctagacaagctcttgcagagctctaacactctgtgtgaattatttctgcgaatattgaggaaaaattgatggcagaaaatgtcttcgagttatgttgagttcctgcttttgaaatacgtgtatattgccacttattcagactgaatcacagtactgtaatgacggcgctgagtttcttcccaaa

SEQ ID NO: 128681 - DNA, 228 bp, Homo sapiens
tcacgccatcgcactccagcctgggcaacaagagtgaaactccgtctcaaaaacaaaacaaaacaaaacaaaacagatgaatctcagctgcagatacccagccctgcccctcaggtggcgactgccccactgagcctcggtttcctcatctgaaaatgggaggtcagatattgccctatcatatgggatggactgggtcagaggggttcacgggggacagtgccaaga

SEQ ID NO: 128682 - DNA, 672 bp, Homo sapiens
ggcacccagctgaagtgacttgtttttattaaaagctttattatcagaagtagaaattatgtgaaacatagagagatgcaatataggaaattccaggaagatggtgtaactgaaaacgttagatagatacaaaaccttaaacacgtatctgggaaatttggagagcagtgcaaggaggtagaacagcatgatcttctctggactaaatcaagaaagggaaaacaagggagtttttctggaaagacaaaatgcaatctcgtagtcatagaatgatcaactctatgaaatgcaggctcttttttttttgccccaagtagctttaagaagtagaagttccatccttgtctgttctttacttgaccattgtggtagttaggaaaattctgagtacaatggagtgagaagtgaaaaccagaggtcctgtatctctatgtcttagtcatactaaaaaatttaaacatatcttatagagtcatttgtttagaaggaagtgtttgattaatttgtaaagaagagaaatgttttaaaaataacgaaagtacttgttaaaagcagtacttggctaccaggttgtgatgcttgctctctttaccctcactaaagattaggatttaactattgtatttacatacaatttgttattagtaggacagatagtcagttttaaataat

SEQ ID NO: 128683 - DNA, 537 bp, Homo sapiens
gcaagcacatgattcactttcagtcattaacttccatttagcagagtgtgttatccagttgcccgtcaacctcagggagctccctggggcagtggcccattctcccttagggtctgagctctgcttctcagactcaggttctgtcccctctcatacaaggagcttcccaaaggcagccatacgtctcacagcaaatcacaggagaggatgtacggagagtggatggcccttctcactagtatttctttttgaaagatgtatgtggccgggcacagtggctcacacctgtaatcccagcactttaggaggccaaggtgggcagatcacctgaggtcagaagttcaagaccagcctggccaacatggcaaaacccaatgtctattgaaaatacaaaaattagcagggcgtggtggtgggtgcttgtaatcccagctacttgggaggctgaggcaggagaatcgcttgaacccgggaggtggaggttgcagtgagccgagattgcaccactgcactccagcctgggcaacaagagcgaaa

SEQ ID NO: 128684 - DNA, 281 bp, Homo sapiens
ctgaaagtttcagatagactcctgaggttctaaagtctccttaggactgtggtactcagcgagccagccctggagtgactccctcctgagggcagcctggctgtgagcattccttggggagggaggtacaagggctagataggagtgacaggggcgaaagtcttactctgaatcctagggtgtagtgtgattagtggcatcttagctgctataagcagatgtctatcctggaagatggctgtagaagggacccctcttgaggtgggtggggataccagggg

SEQ ID NO: 128685 - DNA, 709 bp, Homo sapiens
taccctaaattctctgtttattgtttttcttgttttttctctggactttaccacattgcttagttttgcttgtctttgagatgtgtaacagtgttagtgtacagtgtgtgttctgcaccttggtgtttcattcaatggttacctttctgggatttatccatgttgatgcatgtagctctggcacattcattttcactgctctccagtatttcactgtagaaacataccacaatggatgtttgcttttgtttccactttttttgctgttttgaacagcactgccgtgaacatgcatgtacatatcagtttagcctgagtgtgaatttctctaagacactggttctcaaacattttggttttaggacctttttaccaggacccctaaactccaaaaaccttttgtgcgtatgcattgtatctatttatctatatcatggtagagattaaaactggcaaattaaatatgttattaaaaatactgattctaacccattacatgttaactataaatagcatattttaataaaaatatattttccaaaagagatttagtgagaagagtagcattattttatatttttgcaaatctctaatgcctgagttaacagaagacaacgagagtctcctatctgctacggcattcagtctttttttttgagatggagtctccctctgttgcccaggctggagtgcagtggtgcagcctctg

SEQ ID NO: 128686 - DNA, 799 bp, Homo sapiens
tcctgacttcaggtgatcctcctgcctctgcctcccaaagtgcaagtgctgggattacaggcatgagccaccgcacccagcctagcaatttattttctaaagaaaatttcctagatggtggactgtctggatagtggaaataaaggacagggatgagttaagactatctaaagttagagccccgaagcgtggttggaacattaagatagtagttttggtttagttggaatgaaggtattttgcataagctgaatctgagatttcattagacctaggttcattcagttgatacctattaagcatgttctaggggttataaagatgcaacagaacagacatcgagttcatgttctaatagactctgagatgagaagatagaattgtttggaaatctttcgccatgagcatgaattaaagtcatgggaatggatggagatttgggcctagttctaggtagcagataatcctgtagtttatttaaacctctatatttagggtttgatataataacgtaatgattataatcagctatacagcagttgatattaaaataaggatacaagagaatattggggaattacagtggatcttttaagcagctatgttccttttctgtatgtggaagacgataaaagacatttctttgtctttaaattctaagctgttatttcattaaagttcagtaacttaatgtctctggctgcttattacttggcaatatctcactagctcatcgatgtcagtgtaggctggtctacaataaatgcataaaagaaacagaggccagtgattcatatga

SEQ ID NO: 128687 - DNA, 710 bp, Homo sapiens
gggataaaagaggcaaagggcatgagaaatgagtctttggaaaattattgtaactaacactaatgcttatttagcatctttcattcaaagaccttcagacatttcctaattgagttctgtagtacttctggagtgtgggtaaggaacatttagagactcctgtgcccagtgctgtaaggcctgccatccccgtgtggcatgttgcagctgttttgtagggtacatcatattccttcctgggccagagaatggaggagacagcgttatccagctgaaatcccagaaggattaggggaacaggagtgaattacctggattggaatttggccagctttctgggtcagaaatcctattcctataaaaatgttctatctttaaaacattttatatcctgctttatctccaagaaaataaacgctacatcacttattttctgcaaatacctttgggagcttaacattaatattgaggaatgtgacagcctatatctactattaatgaggaaagaaagcgaggttaacattttatctaaaagatattagaagagaaaaactatttgtattatgcctgtcgaaagtaagctgtgggggacatgaagataataacatatgaccagttcccacaaaaaacttacaaactggtttgatgaataggagacatacatagataattatggggaagatatatatgtatcttcagtatcagaagaa

SEQ ID NO: 128688 - DNA, 451 bp, Homo sapiens
tgacattatctaatcctaattacctcccaaaggccccacctccaaatgactcaacatacggattttgggattaaatctccaacacatgaaatttgggggacacattcaaaccattgcatccatcctctgcattcagaaagatagtccaacagaaagatctggaatcaagagacccagctgattaccaattccagttttgctctgatgtgctgaatgaccttagacaagccccttcccctctctgggcttctctttgctatccagttcaatgaaggaataggactagatcagggatgcgtacatgtggtgagcctgctgatcatccccacgccttcatccatacctcacagcaagccgtaccaatctctaaggaatcactgcacggctgagccccatttgccaggtgatctttaaggaaagtggttctcaaactttagtgaatcagaatcag

SEQ ID NO: 128689 - DNA, 164 bp, Homo sapiens
gtgctcgcccctgagcctgaggagatctgggtggcggagatgctgtgtggcctcaagatgaagctgaagcgacggcgagtgtcgctcgtgctccctgagcaccacgaggccttcaacaggctgcttggtaggaggacaccccagagagcacctccaatcctgtt

SEQ ID NO: 128690 - DNA, 198 bp, Homo sapiens
aggccccgggggagacccagctggactctccagaccttccccagccagcgagctcccatgctgcacgtggggacaggagccaccattcgcccattcccgggggaaacagaggcactgccctcagccactgcctggggagcgctagggcgccacacactgcacttcattgcctcctgcgacacaggtggggagcaaagg

SEQ ID NO: 128691 - DNA, 453 bp, Homo sapiens
aagaaaaacacttaatgccgtttctactcaaagtttatcttttttcatcctcaaatttaataaataggacagtgttttgtcgtggaaagcctgtagactttgcagtcattagactctactgccagtgagttgttggatgactttagaaaatcagtctctgtgcctctgtaaaatgacaatgacatctgcctaacagggctgagaaaatcaaattctgaaccacacataaagtagctaaagtaccctgcctaatgccttgtagcaactcaataattgctatttcccttcctttctcccttttgatcccagtggctttaatgttaagtttatgtagcttatgttggggaccttaacaaaatttccttaagtatctaattctagaaataagcagtttggattgatagtccacttttttcttggaagaatctgtaaaacataagatgtttattggct

SEQ ID NO: 128692 - DNA, 353 bp, Homo sapiens
acaacactgcaaaggcaggcttcatgactttgtttgggattcttcctcttacactcgtgtgcacactcatagctatgcatgctcacatacatgttcagggcattgtaaacacacaggaaaataacagttacacccatgaatcaacataatatggctgagtaagccagtctcactcatcattcatttaaaatttcaaaactaaatgctggagctcttgaaattttagcactcaccttctacacatatgtacatgcatgtgcatgtatgaatacacacatgcatgtgtgtatacacatgaaccctcacaacatacacatgcatgcatgcgcaggcacatgggcacacatacacac

SEQ ID NO: 128693 - DNA, 339 bp, Homo sapiens
ttaaaacttgtttctgtatgactgaacatgctacaaagttaaaaggaaagcagcctgggcgcagtggctcatgcctgtaatcccagcactttgggagaccaacatgggcaaatcacctgaggtcaggagtttgagaccagcctggccaacgtggtgaaaccccatctctactaaaaatacaaaaaaaaagttagccaggtgtggtggcatgtacctgtaatcccagctactcaagaggctgtggccagagaatcgcttcaacccgggaggcggaggttgcagtgagccaagatcacactgctgcactatagcctgggcaacaaagcaagactccatctt

SEQ ID NO: 128694 - DNA, 201 bp, Homo sapiens
aggcagcaaccctgctgacacctcagtcttgaacttctagcgtccaaaactgtgaaacaatggatttctgttatttaggacatccagtctgtggtactttattataacagcccttgcaatctaatacagcaggtgacatgaaatccttacttaagaagctggaaaaacaccagatgcaggatcacgcctgtaatcacagca

SEQ ID NO: 128695 - DNA, 705 bp, Homo sapiens
cacccacaagcaggtatgaaacaacagcaacataagaaaacaacatttgaattcaacagcttgttatttgggggtgaggaggacaggttttaattaacagttgtatttttgtttttccaaacagctttgtgtttaccaattcaaacttggacttcagagaaaacagagagcactctactatgataacacagaactagtaccataattttttttggttaagaaaggtatgtacgttctggaagttacctgggtagaataaaaaacagaataaaagtggaaagaacaaaagaatttaaaaaatgaatagaatttattttcaaataaatgtgcattttgttaaccaaaataataaacattaaatgtgtttgtgttttgtgccacataactattttttaatgtcctattattcacagcctagttagaggaccaggggttcattgaagtcagcatgtttaagagcagtcccacaattcttaccaggctgaaaaccactgccttcaccagctctggttgcaattatcatatgcaatacattttgttttaaatggaagcttttataatgaaatttagaagccagcgtcatttctcttcctttgctttctactaaaaaagaatttgaggacagacaataaaggaaatggcaaggaactattctatgaccttgggcaaatctcttcggtagttcggccttgtatacacacacat

SEQ ID NO: 128696 - DNA, 718 bp, Homo sapiens
tatacgttatttgctatactgctggtgtaaaatcatttgtttgtcttatctattctaaagaatataaacacataaagagagaatctactgattattttctgtgtcatcattatatttaaaccagggctataaatatatagacagtaaaaaattatgtatgtcaaataaacggtgtttcttgcttctgcattatagagataatgctcttgataacttcattaaaatgcatgtgactttaagtgtttcttctaatgaaaataagaaagtttcatctaattgcttcaagatgatgctaccgtcgaagacctaagaaaaatgggagctatgtttcaaaatgcgaacctggggttagtgttaccaagcacactgtcttcctactgaagcttcaaacaaacctgaagcatccagcagtcataaaaattcatctcactggccaggcacggtggctcacacctgtaatcccagcactttgggaggctgagggggtggatcatttgaggtcaggagttcaagaccagcctggccaatgtggtgaaatcccatctctactagaaatacaaaaattagccaggcggtagtggcatgcgcctgtaatcccagctactcgggaggctgaggtaggagaaccgcttgagcctgggaagcagaggttgaagtgagctgagatcgcgccactgcactccagcctgggtgtcagaatgagacactgtctcaaaat

SEQ ID NO: 128697 - DNA, 203 bp, Homo sapiens
cataattcttacatcataatattagagtgtgtatattctgcttctaagctttgaaactggtgaaaaaaatatgccttctgggttcaaggaggaaatatgagttaagcaatataacagggagtagtggtatatattgctccaatctactaaagagtactggggttctaaagaattagaagtgcatgctctaatgaatcctttct

SEQ ID NO: 128698 - DNA, 390 bp, Homo sapiens
aactgatacttgttctatgttagtaaagcggatatgtgtcttttgacaatttacatgtgaaataactgcagctgttttctaattgaatttcaaggctccattccatgggctcagagaaatctgattctctactgctttcagcatgatatcagacaatttagagtttctctccagtctgggggttgcatatgatttctggggtttggggtggtgtgaagttggtataatatcactacaactgtctattcttgctctagtcactgggacctcagcctgagggactacacagattgctgccgcaaatccccccgcttccttttcagcaatgcaagggaaaacatcacattcttttgatttcccaccaattcatcctctttccaccccggcaaa

SEQ ID NO: 128699 - DNA, 137 bp, Homo sapiens
aacgaaaatagccaataaagtcatagatgagaaaattcggaggtcttaagtgaatagatcttaggcattaagtaaatacattctacggatgatttatcaaaagagaaatagtgcagtaaaagtaacagattcaaaat

SEQ ID NO: 128700 - DNA, 218 bp, Homo sapiens
tggagttagagaccagcctgggaaacatggtaaaacctcatctctacaaaaaaaacagaaaaattagctgggggccgggcgcagtggctcacacctgtaatcccagcaccttgggaagtcgaggcaggaggatcatgcggtcaggagttcaagacaggtttgactgacatggtgaaacttcatctctacattgtaaaaatacaataattagcccggca

SEQ ID NO: 128701 - DNA, 457 bp, Homo sapiens
ataacttacatatgtgtgaaagtttattggtacaggctagttattgtagcattgcttgaaccaggtaaagactatgacctccctagatgccatcagtagggaactagccaaataaacaatggtaaagccacacaatgaagcaccacgatgccatcccaaacgaagaatgcggaaactctgagaccactgttataggaagatctcagagatacttagtgaagtgaaaaggcaaggtacaggccgggtgcagtggcttatgcctgtaatcccagcactttgggaggccaaggcagatggatcactcgaagtcaagagttcgagaccagcccggccaacatggcgaaaccccatctctaccaaaaacacaaaacttagccgggtgtggtggcagacccctgcaatcccagttacccaggaggccaaggcaggagaattgcttgagcccgggaggcaaagg

SEQ ID NO: 128702 - DNA, 686 bp, Homo sapiens
gatcaggaaaggtgcacggggggagatgagaggcctgagcggcttcccagcgaaggtttttgaagcacggtttgattttctctctccccctcaccatccccagattttagttgtgactatctccaggtacatggcttgcgacaggcggtgtataaaaactaatgtgagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttgtaaaacagcctccataatcaatggtgtacgatctactctctggtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatat

SEQ ID NO: 128703 - DNA, 165 bp, Homo sapiens
taagtgatgggacgtttgagctgggcctccttaaaatagggcctgcgaaggttttggcaagaatgtgcaggtatggatcctcagaggggtccatgatcactgaaagttagataaccattacaggttttggaagagtagattacaaaaggcagacaaacagggaca

SEQ ID NO: 128704 - DNA, 291 bp, Homo sapiens
  misc_feature (45)..(47): n is a, c, g, or t
atctacgaggatcttgagctcagtaggtcatcaggggtgtcatgnnnaggcatgtgtgtgtgtgagttctgtgacctgacttttgatctctgctttctgatcagagtgaaagcagaatgtggcccttgtgacatgcacttctgaaatgtttccacagagtggcagcactctcccactgagaaatctgcctctacctggctgtgccaggatccccttcaaccaggttctgcggaccagaggtgaccagccctcagcacacccacatgcctggccagtgacacccctgatgta

SEQ ID NO: 128705 - DNA, 156 bp, Homo sapiens
ctgaggcaaaacataatacaaaaggaccaactgaggaaatggctccaaagacccgtggctgcagaaccaactataagaagatcttattgcccactgccttcctggagaagcttttcagaggtggttctagacgccaaagccctgagacgaaagagc

SEQ ID NO: 128706 - DNA, 536 bp, Homo sapiens
aatgtcactgtgatttataaaaatggattagaatgttgaggtaattttctttcatttgttaataaattcttgaattagatgtgggagtggagttgtactgtacagtaactatcatctagagttgaggtagtcatacttgataacatagttgtctctttttgatttttgaatgagccttgttttagttattatttatttaaaacattttaataattcagatgaccttacagcctagatttttttttaagtacatgaggaacgttttcatctggatgccctatcagcacatccagtgtgactttgacataatttgcctgataacagtttttacagtttacctccctggttccactaatggcagagatactacctgtgaaatgtctcttagagccatctcctccttgctgtcactactaatatattcttccaaccaatgataataatagctgttatttgttagggctttgtatgttctagatactgtattaataagcatatatcatctaattaatcctccctacagtgctccaagagag

SEQ ID NO: 128707 - DNA, 469 bp, Homo sapiens
ccatgtggggcatcacgtgtgacaacgtccggcacaaaagttttaaatttggatataatttaatttactcattttttcttttctggcgtatgctttgggtgtcatatccaagaaatagtaatcacggtcaaatccagtatcatgaagctttttggtcctataatttttctaagtgtcttataatttcattaggtctcaaaagcattgaatctttcaggtattatttgattaaaatgatgtctgtttagagttcttcacacagtcagaaatggcttccttagaataaacattcatcaactctggtttggtttcttgaaaaggttcagaagttaatgtcaacaagcaaagatcctttgaaagttaagtgagtttctctaagttttggtgcagtttaaagacataggatcctctaatattgccttaacgctgagctatatttgggaagttggcatacagagggtctgtcttg

SEQ ID NO: 128708 - DNA, 452 bp, Homo sapiens
gtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatc

SEQ ID NO: 128709 - DNA, 452 bp, Homo sapiens
gacaactgtcacttactgtaagacttttttttctttacattctgacactttccatcatttctacaattagcttatggacctggctgaaaagccactgcctgtctgccacggcacaatgaaagtacgaaacagtaacaccattttcttcctgacaaagatgacaaacctcccaaaaggataatttctctctggggataaaaccacacaaggctctgaattggatctggtttaagagtcttctgagcctgaatgccaattatgcaggaaattgtgcaggaactagtatagatgactaaatcctcactccttgaagttagaaagaagagccttggtacctggaagacaaaacagaacatatgcactacatataaaggtggaaaagtcatacgatttaagagcatgaaagatacaagaataggatattataaatgcattctctcattcacttccgt

SEQ ID NO: 128710 - DNA, 153 bp, Homo sapiens
gaacagggaagaggaagagatttgggctgccgcctgtccctcatttaggaactagtggaaaacgatttaggtcagctatctcaggtgattctaaatgttttcacttgttagcagagcatgagccctcttccccagcccagcggggctggggaa

SEQ ID NO: 128711 - DNA, 532 bp, Homo sapiens
gaaggacaaaattgccatctttatgaaagattaggaagagggctatgaggaattaaaggaatatgaaaatttagtatatgggtgaatgagacttttggtcagcaaccacagaagactgatcctttgtagagaagtatttgttttctgtcttatgttttctatggagtactataagagttctggacaaaaagctaaaaacgatgtgcctatctacagctatttttcttgaataaaaaataggattatttaaactcttttttcacatttcctaggatgatgtgtaggagagttatagtcctttgaattttatgctttttgtacctgagtttatgaaatgagttaatggccaactggagaaggaaggaaggaaggaaggaagggaaggagagaaaaggaagatctataaagctatattaaaggaaggtggatgattttcataggccattatactttataaggactataaccaagcagttttaagaaaatacttagaacttagtttattgagtgggaaagcaaaaatcctctggaa

SEQ ID NO: 128712 - DNA, 1100 bp, Homo sapiens
gcagtttaaaaccagaatttattttaaaggttagtctatgaaaaaaatgagtaaagcctcaaaatgtgaacaaacaaataaacacttggggaagggtagaatattttcaaatactgtatgatgtgagtgaaaccatttttagattgtataaatttatttccatgaccttgtaaagcaatctttattctaacatgatattactgtttcaaccatgaatcctaaattcttttggagaatcacaattgcacatattatcttgcatttgtctgtgttttcattagagtcctcagatcgtgtgtccaattattcagctgggaatgtatgttagcatagatattggtaaggaaactaaacttatatttttgtttgccctctgatcattgctttaattccaaagttttaatgccgatctgacttatccatatatatttaaatagggtaaagactatttaagatgggtatttggaacattgtaacttttttgttagcagttttaactgcacttaacattgcctctgctaaattaatattaaactttttaaataggaataagtgggaaaaactacattttaacaccgaaataattaagaaccgtgtcaaatctttccttcttctatttaagctcatgagaactttgtgtgtgtctgtgtgagtgtgtgtgtgtgtgtgtgtgtgtagtctattgattgcctttgaattaaatcctgtgttagtttgtaatgctgagtagactgttaaaaaaggaactaaaataatcttgactaagtatagtcaggggtacaatcattggtattcagttacactgcatttttattctcaagaataagaaaaaggacaaaatcttaaagagcattagataatatgaacattacctttcaactatcagtgactgtagggagtattgctagatagaatatagataaaaataccactgacttgcattcctgtgagcttttctgaggattaatgggaagtcatattgatgaggcattggaaaataaacatatcaaataaagacaatgaaagacagttggctttcttgctggactgcacaactggtagctaggattctttttcaatgagtaaatgagagaaaaaaa

SEQ ID NO: 128713 - DNA, 456 bp, Homo sapiens
gggatccttcctagcttgaaagtcactattttgaagttaacacttggagcactgaagtcttatgccttttagaagacatccttattttcaatctttgaaacattgaacatgacccaaatcttattgcaattagtgtatatagtacgaacgtgccacatcttactgggtaagctggaatttaacttgggtgactaattgtgccacaggacattgattagtcttgggaaagatctacctgggaatccaaatttcctgctttatatagctatgtcaataagacagccacctgaaatctgcatgaatataccagcagtaactttagtttgatttcctgcatttttcacaaggaaaataaattctagttgttacttgcctgaagggtggaatctattatagaattcaccaatatatgaacaagggacatgtgtttcttttcagtgtgattttttttttttt

SEQ ID NO: 128714 - DNA, 272 bp, Homo sapiens
tatccttggggcaagcccaaatgtccccttgggtgttgtccaagagctttctctgagcaaccatcattctcggcagggatttcggaaaccctgctagaggctagaggaaggccagctggagtggctgggcctggctgtgatgtctctgttggctttggaggaattacacgcgggcccctctccctgaggttaggtcagcatctcatttaagcacctcttggtgggcccagcacacagcatgcgtcaatacatgtttacagctcatatgaatg

SEQ ID NO: 128715 - DNA, 333 bp, Homo sapiens
ttgtgagttgttggcataaaagagactatgtacaggtataagaaaggaaggctcaagactgtgtcaatggaaaggcatggggctggagagtaaggaaaaaagctgcaggcagaaagttggaaagttagagttaggataagccagaaaatgttctttatctcttctaacttggcttactccatgttcctaggaagacatttcccaattactctcactcttttctgtagaagaaataattctaacagaatgaggctagatgaagaaataaaaaaaaatctaaatgactgcgactctactgacttctctgcatgagacctagtactggccccttac

SEQ ID NO: 128716 - DNA, 316 bp, Homo sapiens
aacacaacggaaaaacaaaactcctgatccctcctgatggcttggaggttagggtttttcaaggatagtggggtgaacaggggactagggaataggtgctgctgatgggttggggatgccatgctgggggtatcaaaaatggttctctagcactgagtccaactctgggtggggggccgcaggacgggttcagtggagtctggggtctgagtcttgaatctggggaccaatagagtcagacagtcatcagaaatgcaaaagtctgaaaagacatttcaaaaggccaacctcaggatccacagtagcgatgttatcg

SEQ ID NO: 128717 - DNA, 222 bp, Homo sapiens
tggctttccaaagagctatgctaaagacaggcccagagactatgacctggggcttccacatcagggatttccaggggtctctgcacagagaaagctttaccatctcttggcttcagtcttttacacctgtctcaaaaaggaagaaaaggccatgcgtggtggctcacacctgtaatctcagcactttgagaggccgaggttggtggatcacttgaggtcacg

SEQ ID NO: 128718 - DNA, 234 bp, Homo sapiens
tcaagaatgcatcccacatataaactgcaccattctctacaaaattcttggcccctcactggacagtatgattaagtatgtctggggtcaaatccaagcaattgtatttttaacagctccctgggattttttaagacaaatggccccatgcttcattgtttgaaaaacctctggtcctccataaaggagtaagtgcatgcattctgtaaaaaattatttgtaaacatgtattat

SEQ ID NO: 128719 - DNA, 719 bp, Homo sapiens
gaacatccctaatctgaaattcaaaatgcttcaaaattcaaacctttctgaacaccaacatgatgctcaaaggaaatgctcattgcagcatttcagattttgtattttcagattagggatgctccaggggtatttattctgcaaatattataacatctgaaaaagtttaaaatccaaatcacttctggttccaagtaatttaaataaaagattagcaaagatgcaattgtgagaaatatcattatattcaagggacagtgaaaagaaaagtatttggaggcaaaaaaattggattgggcccaattttggggagtatggtttagaaatgatagttttaggcaatggaggatttatcgatagcaataatttgcccactaagacaatgagagtattgtttttggaaaactgtcctgtagataataagtcagagagcatgaattgtgagactttgatggcgaagagacaagctggaggactttcccacaagcgtgaggtgatgacagcatgaattggctgggagtcagtagaaataaaaaagataaatctgagggacatttgaaaggaaaagcagacaggacctgctgaaaaaaacacaatagagacgtgtgttgagaagagctgtaagaatgaagcaaggaaaattggtgctaatgttaatgtccctgaatgaagcaagaaagttgggaaagggggaggctgattgaagaggcaggacgtag

SEQ ID NO: 128720 - DNA, 122 bp, Homo sapiens
cacgccatgtccttgtccttgggggctagaatgtgacaggcatgcttgttgtttcgctgaagccggccccccaaggactcttcctctgagccacggaaaaccattcattttctttcagtaac

SEQ ID NO: 128721 - DNA, 635 bp, Homo sapiens
aagtggaaaaaaagccacagaatacacagaaatctaaacagtaatttgggtgatgagactggcaattctttttggtctttctgcttttataggtcttcgttatttctacagtaagcacatgactattaggataaaaaaaatcttggcctggtgtggtgctgtaatcctagcaccttgggaagattgtttgagaccgggagttcaagagcccctgggcaacatatcgagaccctgtgtctacaaaaaaatgaaaattagccaggtgtattggtacatgcctgtagtcctagctacttgggaggctgaggtgaaaggaacacttgagctcagaaggttgatgctgcagtgagccgtgatcgcaccactgcactccagcctggatgaaagtgagaccctgtctcaaaaaaaaaaattgtggtgattcacacctgtaatcacagcactttgggaagccgaagcgggagggtcctttgaggccaagagttcaaggccagcctgggcagtataatgagaccctgtctctacaaaaaatttttaaaagtaaagaaattttaagataactaaatactacatagacatatattttaaatatttattacataaaggtaaaccaaatagaagaggaaataatgtta

SEQ ID NO: 128722 - DNA, 330 bp, Homo sapiens
tcttagtttagcttttttatgtgactttgtattactcactttatttattcatttaacaaatatggtgcagtgcttggggtggggtgtttcagaaattgcacttaattctgagcagaaagaataaggaagacaggcagccccaatcctcataaagattataacctaatggtgaaagcagacattaaacaagtcatgttataaataattgtttgactaacaattgcgatatgtgttctgaagagtaaagccacagtgtcatgagtgtgtagaacagaaggccctaacctagcctaggatgcctgaaatttcttgaggaaatggcatttaagt

SEQ ID NO: 128723 - DNA, 443 bp, Homo sapiens
cctaaatctgatctttgtaaataagctgactcccttgtctgcccaagaatactaaactggagactttcatagatgccctgagagagactcctgtctcctgcttttggtgtacagtagcattggcttttccagccctgtggggtcccaaattgttggaatctcagtggatttatattgccaaatttagaacacatgacccttagtaggctgtattttattccgtttttccttgcaaaccagccagttcttgtttgtttttatcttattcttacagtagctcactaaaagcatacaaggggcagtcaacacacaccagcattctactgccaactgcttcccataaagctacaaattcagatgacacagggtctcccaagttattgaagttttagcagatgttttgctacaagtgtaacaagggttgccagctttctagtctgcaa

SEQ ID NO: 128724 - DNA, 336 bp, Homo sapiens
tggggcctctatcagttagggatcaagcagagaaacatccaggaggagatatatattgagatatttatatgcaaggaatcagcttacagaattgtgtgggctggctaggcaactcaaatctggctgggcacagtgggggaggccagtaatcccagcactttgggaggcaaaggtaggtggatcacttgaggccaggagttcaagaccagcctgggcaacatagcaagactctgcctgtacaaaaaataattagccaagcatggtgacagacacttgtggtcccagccacttgggaggctgaggcgggaggatcacttgagcctgggagctcgacac

SEQ ID NO: 128725 - DNA, 676 bp, Homo sapiens
ggcaggtgggtgtgcatgtggctcagattgtggcagaggaacaagtagaagccttcctgggaggctgggaatactgggctgggatgtgcaggctgcattctcaaacagtgggggccgtcggaccacgacaccatcagagcagcttccggaagaggaggtgggtcatggagagcctggggttgggcagggagattggagaagaagctactgtaagttcaaaggcagcaacagtctccacccctaccgggatataacgtgcaaagaaggagactggatgtagaaatctagaaggacttggggaccaattgaatgtagaaatagaattaaagtcaaagacgacagccctgttttgagcctgaataatttggaaggctcacagggcctttaaccgctatgtgaaggagagccaattatttgcaagcaatctgaggagctgtggaacagccaggagagtctgaccacaggttggcaggatggatctgtagctctggaaagaagccagagtcagaaacagtttatccaggagatgcctacattaccatcagagtcaaagcatgggagtgatgcgcttggaccagggagagctcgcagagtgacctggggcctcctgcatgtaatgtgtgtcaagggcaggctcctataatgtctcaataatatgggggctggctcatgaata

SEQ ID NO: 128726 - DNA, 288 bp, Homo sapiens
acattcactctaaatattccatttataactaatacgtcctagagcaactgttgtcttcggaacagtgaccactataatgtatcagtctgtccatggtgtaggaaattttgaaaacacataagctattatgtctgacaaagtagatgtcaactttctttcgctggccactggcacagacttggcgaggcttcagaactgtgcgaggcttatggtttacccgcgatgcttctagggttatgtctcgctttgtgtttcggtcaaacattctgaagaaataatggtaagatc

SEQ ID NO: 128727 - DNA, 398 bp, Homo sapiens
gctactgtagaggaatacgcagtttattaagggctttgatctatctgggctaaaatcccagctagttctattgttagctgaatgcatggccttaggtaaattactttctttctttgggtcacatttttgacaactgaaaaagtgttaccaaaacaccaggaggtcggtctagggctccttgctcaccacacagaaaaccaattactgagacaatgagtattgccacagaagaaggcgttttacttgggtgaagtcactcaaagagataggagatcagtttgaaatccgtctttcccagctgactgaaattcggggtttatatagctagagaggtgatgtagctgcgtgcaggggaaacagaaattgaggaggggtgaggaagtcatcatgatggatga

SEQ ID NO: 128728 - DNA, 491 bp, Homo sapiens
tatactggccatttgaaactaaggcctgcccgagatcatataatagcctaggaggtgacaaaggacagacacaggagccaaacccatgcccatccctccctaagtccaaaatcatagaaaaaaaaaaaataagaatcaacatgggcggttatttttaagggccagcatgttcaaggtgggggcaaatccaagagacactaagcctcagagcatgaacaagcatgtgggtgctgagtggaggggaccagtgtttaccagggtgatgtcagactctgcaaggctcgctccccgtgtttctggtctcttcccatgagcaccaggcaccccttaccatccccaaactaggcacatctgtaacgctgaatggaagcctacttgtttacatgtgttctatgttagactgggggcatccctagaacacacacagattgactggtgggcagaattctgctaggtgcatgcacccgagtgagcctttctctttgaatgtg

SEQ ID NO: 128729 - DNA, 323 bp, Homo sapiens
agaaaaaatatgcagaaatgaagttttttcttagaagcatcaaataggctgaaactctagcaaggattatcagtcaatgctaagaatgcccaatggccacgttaggatttggttgcaaataaatatgcactgggagacacattggtctgatgggaatgtgtagcatcttttatatctctctgcccaaatcacacacagcctaatccacctttctttcagtttattccgcaacccccctaacttacattaacattttttgatttacacagattgccaaaaactctccctcctccccactctctcgctctctctctttttctctc

SEQ ID NO: 128730 - DNA, 421 bp, Homo sapiens
acttcccagctgggtagatttggggatgctctttaacttctctatgcctcaagttccctgactgctaaatgggcatggagtctactacctgagagagtgatcatgaggatcatgtgagtccaattatataaagcatttaaagcctaacacatactgagctctgtaatcgtcagatgaggttcttactcactttgctgtactgtctctaagagaagtttagaatcaacccaaccaacagtacattttggaactgacagcagccagaaaggggaggcaatgtgcccaagtcacaaaggttgccaatgtcagaaccatgtctcttgactgtaagctgttgtaccccagtgggatgaagggaaagaagagaagaggaaggaagagggagaagcagtagacttcttctccttagaagacatgaaaa

SEQ ID NO: 128731 - DNA, 378 bp, Homo sapiens
gtgcagaacacagcggggaaggctgaaggagctggaggtgccttctgagctagcttaagagggttgggtttgtacttccaggttaataggaagccattaaaaccccaccaggttttaaaccaggtgtggtgggtgtgatatgaacagatttgttagtttatgaaataaagtcttatttggctctgtttccagtgactatcattgtaagtataagtgcatggaggagcttaagtgctctttgccttgtgaatagtgagtgcttgataaatattaatcacctcacaaggtgtgtatgtgagtgtgtgttgaacaaggcagcattttaggcatccatgtgtaggtgtgtgccagtgacacaggaagtgaataccttaggct

SEQ ID NO: 128732 - DNA, 382 bp, Homo sapiens
gcagcaggtgtcacagaaggaccctgtcccagctggtcctgctccactgctatgatggtgtggcctctgatctctgaccgtgtcttgaggggagaccaggcccttgatcacaagcgtatccatggtgaggttccgtggatggaagctcatgaatgttccttcctgatgttcatctgccaccttgctattgaatgcatcttgtttataactgccttctaagtattgaatagaaataaagcatttgtacaggatgggtaaggtataaagaatattgacacattggacacagaggacctccaccaagtttagggagtagaatctcaagaaacataactgtggatgctccctggaggccctgcctgagtcccgggtcccttccctt

SEQ ID NO: 128733 - DNA, 556 bp, Homo sapiens
acaaggatattataacaacctcctaacaggtctctactttcactcatctttctccagtaatcaattctagcttggtagctagaatcattttttaaacatgtaaaatagatagtctgtcttttatttaaaactctgtatttaaaaccttcccaccaaaacagcacagtactggcataaaaacagacacacagatcaatggaacagaatagagaactcagaaacaaatccacacacctacagtgaactcatttttgacacaggtgccacgaacatgcactgagggaaagacagtctcttcaataaatggtgccgggaaaactggatatccatctacaggagaataaaacaagacccctatctttcaccattaacaaaaatcaaatcaaaatagattaaagacttaaatctacaacctcaaactatgaaactactaccagaaaacattggaaaaactctccaggacatcggtctggggaacaacttcttgagcaataccccacaagcacaggtaaccaaagcaaaaatggacagatgggatcacatcaagttaaaaagc

SEQ ID NO: 128734 - DNA, 307 bp, Homo sapiens
tattcaatatgttataacccattactatatcttttaattttgatattcaaattgtctatgctgaaacatgtttctagaacattactacttaaaaactgttcacaattatttcatttgggaagaaagactagtgattgggagtggataaaaaagaaattttaccttttaaatacctttctattatctttgatttttaaaaaattctatttcccaccgtattttgttttaagaaaatgtcagaagaggttctctgggccataacattagggctgtgatgctcaactctgacaaaatgttataatttgtt

SEQ ID NO: 128735 - DNA, 1073 bp, Homo sapiens
agggagggtgggcactgccccgcatttgccctccaggtgtcaggtgcccacctggtgatgtggagttagctgctgaatgtgcaactgtagggaaatacaccctactttttgaagcctcacttggagcctaagagttctctagagtcatatcttgattggatttataagttaaagttgggggaaaatccattttaatacaagttttgataaacccaatttattttataaggaaggagccgtttaccctgcagtcattaacttagaattgttagtttaattttccaccagcaggaagaaaatcttgcaatacctaagtagttcaaattagaaagtgtgtcaacagtttttccttttccactatttaaccctaaaaatgataaatgtcttcaatttgatctgactttcagttgtatggtatgcctctgtaggtgggaaagggtgtgtgtgccaaccccacccccaaccccccacatatgcagaaaacttggtttgatcccaggagccccagaaaggaaggggtgcttgtgagaaatgttgccggtaagtgctagtattaatacttgtagcagtcacttgctggtgttagtacttgtagcaaaagttgcatctcagaactgccaaaatagtgtgactttttaagacgccttttggagtcattaaaaatccccaaacatacacccaaccacccctgccatccagaagcttaactaaacattactcattctgctttcattacacgtctgcctggctttgccacaaacacactttgccttccagtcaggattaagcttctgtgttaggccatgactggtgtgaaagtaacccctctgtccttgttgactgggacagaaagactgctcgctcgcccgtgtgaaattgtgaatggaatcatggaatcctggagccaaagcaagttggttgccttcctgcaggactatcctaatgctcatcaccttgactggcaaaaggtgtcctaattctaacgtttcatgggtctcctgtaaacaaggacgtgatctcagatgtggctttctcaataaaaagaagaccattctgtggcacactaacaccta

SEQ ID NO: 128736 - DNA, 493 bp, Homo sapiens
tggttaccaagggctgagggggaggcaagcaggaatgactaggttggggtgctggtgatttttagggcagtgaaagtattctgtatgatactgcaatggtggctacatattatgcatctgtcaaaatccattgaactggacaacactaataaaaactacagactttagttaataataatgtctcagcattaaccaaatgtaacaaatgtaccatatgaatttaaggtgttaataataagggaaactaggggcgtgaaggaactctgcactacttgttcaattttctgtaaacccaaaactgccctaaaatacaaagactaggccgggtgcggtggctcatgcctgtaatccaagcacttgggaggccaaggtgggaggatcatgaggtcaaaagatcgagaccatcctggccaacatggtgaaactccgtctgtctccactaaaaatacaaaaattagctgagtgtagcggcatgcgcccgtggtcccagcta

SEQ ID NO: 128737 - DNA, 220 bp, Homo sapiens
cagatctctggtatagcataaacaaatttaatctttacttattggtagtagtagtaaagcataatgggccttttatatggtgagccaaaaatatttttttgttaatattttcttcttttggataacttggactattcagttgacatttagtcagctattcttgcagtaatataagccattctgtccactggattcattctcctctaaagtggtgtttcac

SEQ ID NO: 128738 - DNA, 445 bp, Homo sapiens
aggctgatggcttaatgttttttattattctggaaacttctctgccattgttttcttcaaatagtctctctccacattctatctattatttccttttgtaatcttagtcagttttatgtaaggctttctcctcttgttctttgtatcttaactcatattatccagatagtttattctgaataattgtttcaggtctatattccaggtcacccactctttttcacataagcccagtctcttatttaacccatccactgaatttttaatttcagtaattttttgtttttggagttctgtttgattctttcttgaattttcctggttatttttgattttctgttgttctttgctcatttatttccactctgttttatttacataattatattgtttctgataattccagtatcttaatttcttaagaattaaaaaagttttcctgctg

SEQ ID NO: 128739 - DNA, 631 bp, Homo sapiens
gtttttctcgacgttaattaagttttatcgtaggtactttatgttgttatccacattagcaaaagaaataactcctcccacccaaagaatggcagattggtgtgacgtggttatgcaataaactaacagtaaattattttgtgtaattctttgctgtattaccttctctatctttgtttttattcctttaagaggtaactagagagccagtagatactagacgcaatatttcctctactttgaattttaaagatcgtgtattatattgcagttcctgaaataatttcatattaactgaaaatagcattggacaatactttcctatggctgaatttttttttttatgttttcaaccttgtggtgtcttcccacaattaggaaagtattccgtatgaatacagctgaaagtgctgtggtttcctccctgttcttcagccttgccctcctctgtttcaggatctgtgttttctaacctagctgccctcaagactctctctttggttcattctcctaaaaagccccttcctacccttcttctacagagttctatatgttaaatcttcatttgtatgattgcataatttttgatccactcagtcgtcagcctgatggtttggttgatgggttggtt

SEQ ID NO: 128740 - DNA, 440 bp, Homo sapiens
cacagggtaggattacatgggtaaagattacattagtaaagtccagaaaagccagcttttattccagaaaaggtgaacatgtaacatggaagtcttgactcaattaagatggccgtgtggtcccaatacaataccaaagcaaattcgaagaaaatctccaaggatttaaaccaacctgtgcaatgcgagtgtgttcagatacctggagccagcctttggaacctgctggatcaaaaccaacgtgtgctctgtggggcccctgaaacacgaatcctctgtggggttgattgagaaaggattcacaggcttcaagtcccagcaagatttatttgctagaattcaagcaaatctttacgaaagggagttctcatggatgaggccactgttgggggctgggccaggactagatggagccatggattccagcctggcagcttcga

SEQ ID NO: 128741 - DNA, 222 bp, Homo sapiens
acaggtgtgagccaccatgcccgcctggaaattatttttactctgaactctgaaatcattgctctattgctttctagctttcaggatttcttgtttagatgtatagtgccattttcattctttctctttttttttttttagatttacataatagtaaaactcatcttttgtcataagcagtactattggttttgacaaaggcttagaattgtttatcgttca

SEQ ID NO: 128742 - DNA, 159 bp, Homo sapiens
tggctttggccacagcagtgtcactgagcttcttcacagcctgtttgatctggtgcttgttggctttgacatccacaatggacacaagttgtgttgttgtcttctatcttcttcatggctgactcagtggttgggggaacctgatgatgaattattggt

SEQ ID NO: 128743 - DNA, 204 bp, Homo sapiens
ttctgggattacagatgtgagccaccatgcccggccttcatcctcattcttgaaagacatatttgctgagtacaggattgtatgttggtagttatttttgtgttgaagatactattccatgtcttctgattaaattattgatgtcaaaattaactatcagtcttattgtccttcttttgaaggtagtttatctttctccttggg

SEQ ID NO: 128744 - DNA, 524 bp, Homo sapiens
cctgggctcaagtgttcctctcacttcagtctcccaagtacctaggaccacagttgcatatagtctaatgcacctgtaacttttttgtggtgttctattgcacagtatggtgactatggtggacaataatgtatcgtatatttcaaaatagctaaaagacgattttaaatgttctcatcacaaagaaatggtaaacatctgaggtgatggataggctaattaacccgatttgatcattccacagtatatgtatattgaaacatcatgtaccccataactatgtataataattattatttgtcagttaaaagtaaaacaacaagaaagacaaagacacagggtatccaagatgctgtttgctcttctctaagcatatgtctcttctagagatagagccaggggctgacaagtgatgtagctgcttccgctagacctaagtaccttgagaggtgtgttcaggggagtaaacatttgctccattactgttgccctaaagttaacaaaccctcatatcccctcaacac

SEQ ID NO: 128745 - DNA, 428 bp, Homo sapiens
cagttgtggccattattagagtaagatatgccactaatgtatgcacatattatctcattatttttgattgaataaaaagatggggtaattaattttgtgcttagctataaaattagtgtaaatatatcaaaatatcaaatttgaaataaacagtaggaaacaactataatgaagcttgcatcattctgagattttattaaagagtatacattgaggttacattcacataagagcccatttcctgtagaaagtcagtctaccagagcagttatttaagtaaatttgatattgattataccctataactccaagctaagacatgggttactataaatatgaggggagaaggagggtctacacatggaagcttactgacaaaagttgatcactggccaggcgcagtggctcacgcctgtaatcccagcact

SEQ ID NO: 128746 - DNA, 264 bp, Homo sapiens
gaacattctaaccctgataaccacagggctatgcagaaagactgctacacacagatcacagtagccacttgaggaccatggattttccagcccaagggtgatgtcagaaggaaagtagtggaaaggcaaagttctgagcctgagctcggcctccctctgaggaagcaaccacagcagggccggggcagggccacctccttggtggcctcacaggctgtgcaccaccgagggtgatggcaacaggggacaaggaaggaggtacca

SEQ ID NO: 128747 - DNA, 218 bp, Homo sapiens
gtcagttgttgtttttttaatcacatttctaaaattcccttttgataagcaagaaccagccatctaatttgactctttccttgttattgggttggaattgagacctggtgattccattcagatgtttgtaaatactttattgcactgaagtctggtatgtgtatctaggccctcttttcatttccctttgaagcacctcaaaaatacaccttaatttt

SEQ ID NO: 128748 - DNA, 292 bp, Homo sapiens
attagaggaggcagcaatgatgttcttgccaattccccaagcaatgcaataattccccatcctgagcagctgctgagtgggaatgtctctggaaaagcctcccaggccgcaggcagcgagaaggtggggcaggcagctggactctccatcactggatggtcaccaaacagggttcattcagacctgcacacctctccgtgtacctcatcatcattgctttgggcgggccccgtggcctactgagagttcctggccattgatggacatggccgtcctcatttttctgagggcc

SEQ ID NO: 128749 - DNA, 457 bp, Homo sapiens
cctggagaggggaatctcagtgagaagcaagccaacttttaccacagaatcctagagagacaagaaaattggagcccagagatacctctaaagacagatatgaagaatcagctcagtagtggttagatctcatattatggttatccactttttagtagcttttctatatttaggtttatctcaatttatgggtattgcttccttaatccaaactctaattctcagcttcccctatagctagactacagtcaagcaatctggttgtgccaaccacgcacacacataattttaattcaggtgtgagctgaggaaagaagatctgtgtgtgtttctatttttgaaggagagagctctcaggatttttgtggaagcaattggcaagtgcttctaaggttacatttctcatacagaattgtcattggtgatggtgctggtcagcaccgtgataatctacttt

SEQ ID NO: 128750 - DNA, 939 bp, Homo sapiens
atctaacacttactaagtgttaccctactctaggcattgttttaatccctttatattattcttatgcaatttaaacatcatagcaaaccttctcctacaaagaagccactattgttatttccattttatagacgtgcagactgaagacagagagggtaagtaacttggccaaaaatcactcagctaataaaggaaagccaaattcaaagccaggcagactgactctagaactgcaccctgaaccaatacactatattgcctctgtgctatggatcttgggtttcatggtatagacaaggaggagccactcaaaggttttacaccggcaaacaataggtttagtctgcattttaggatcacagcaatgtggagaacggattagaaaagtgtaaagagacctgcaaggtccaagctatagagatgttgaaggcagggtttaaggcagcagtataaagaaaggaagactttacagacacccaggaagattttataaacacccagaatgtagaaattattagggattttaagagtgtggtggctgaagacccaggaattcctgctctgccatttaccattctctccatatgcatttacatttacagaaaataagaaatcacaagctgaatgaaaatcaaagtatgatactatgaggtggctcagcatctaaataccacagagcaggaatacagtaaaactggactggaacatttggcttaggatcaagatgcaattaagggcctctatcttaagtccaattctgtatcttgggattttcctatcttcaggccaacaacacagtatagaaatcggaagcagtgtccagcatacttaggcttacatgcaaagagagaacaagaatgagacacagaatgaatgcctgggttgcacaaagtgttctggttgaacttactacactgactatatggaaagaggaagtat

SEQ ID NO: 128751 - DNA, 424 bp, Homo sapiens
tgatacttaataatagtgaggtcatttcatgttgcaacacttaatgaagcattaagtaagcacagttaagatttcacataaatacgtttaaagaactacaaagttcaagctttggaagatattaataagtaacgaatgcattacttctattaataaataataagaacaagtactataattgactgaatacttaatatgtgccaatatgataaccatcttacatacattatcttatttaattcataaaacagccttagaggtacgtgttcttactgcagttttacagaaaagggactgaatttaaaagtttaacttacaaatggacaaactgaaaggaagtgaaatggtttgaaccatagcctgttgatttaaaatcaagccattcatcaacaataaatccagataaaggccaacacacacacac

SEQ ID NO: 128752 - DNA, 647 bp, Homo sapiens
gctggtctcaaattcctgggctcaagcgatcacttcccgctcagccttccaaagtgccaggatttacaggcgtgagctaccacaccaggcctgctctctgaatttctagagaaaatgcatagttgcctcggacggttcaaggggaccacgcaatcaccaaactccatctttcagttttttgttgaattagctgggttgtcatatagtttcctatagctgtactgtattttgttagttatattcctccaatgtcatttaacatatatctttgttcatgtttcctataaattaataaattcaaggggcttgattagcgtcatatatctgtacgtggacagatacttcataggtggtgtcatatactaatattgggaggtatgtaatggttatgctgtcatcccttgatgattattgccttgattaattaattcatctcttttttctttttggtcctaagattggataaatatagactttattttttatagcagttttaggttcatgaaaaaactgtggaaggtatagatatgttccatataccagctgctcccagaaaggcatagcctctcccattatcaacttccttcaatggtacatttgttacaattcatgaacttatattgacacatattactactcacagtcca

SEQ ID NO: 128753 - DNA, 464 bp, Homo sapiens
cagccaagaaaatagggcaatggttccctaaattattacactattctgatgtttcatttctgcaacaaaatgagaaaacccaatgtagagaatttttcataaagctaaatatattttctatgagataaaagtgaggaggcattttcaatttactacagaagaataactattgttcacagtacattcaattttattttttgtaattttactaatctatataattcaaaactctgagacccattgattcagggaactctgtgcaattagaatgatttttttgagaaactgacttgaataaaggaagttcagcccaaaaagaaaccagatctgaaatatttctgaatttccctaaaagtgatcacaaaatatctcaaaagctgaaagtgtcaagaatacttttttttgttttgagacagagtctcactctgtggcccagagtagagtgccatggcacaatctcggct

SEQ ID NO: 128754 - DNA, 507 bp, Homo sapiens
tggtgcctgaaacatttgtcacttttagggaattgcaatcttgagtctgtggatcagaaataagctcctggtcttttattgagaatcctgcatttcgagtaagtaatttcccgaagcagctgggatttactcagtgttcttagttataattaaatgataaatcttcacatggaaggcatccaacattgaatatgtcagttccatcgaagcggaatagagcacaagatacatttacctagggaaatgattccactttggaaaactctattctcttgtcagaagtcagatgacaagcagttgcctatgaacagtcaataacaaaaggctctttagtggcttatgatacatcttttacaccctatgtctatgcagttttctggaaataatgagtggttccttccttgcctaacatttccttattggcatcagcatcccccaggtctgaataggcttggccctcagcattgatttagggatggctaccccataatgctcagctggagtgca

SEQ ID NO: 128755 - DNA, 336 bp, Homo sapiens
gagagtggagacagggttctcactgggcagagctggcatgtttctgtagagatgagtcattttcattaaataatgtgacaaaggccggggccaagaggaattatgaagcaagaaggatgtgcctcagcctctgtgcaccatggggcttcagaggggagaaggggctggggacacggagtgggcctgtggggggagctttccaggttggcgaaggggcagagggaggcagggagagcactgcatgggtggaggggcagtgtgtctatgggaaggtgtggaactaatgagctcctttggggacctgggcctcccctcctttaccaaacccagggccca

SEQ ID NO: 128756 - DNA, 277 bp, Homo sapiens
gcagtggcatcgcagggacaggctgcagggagtgtctggtgacaaatctggagggagccttccttcagtttgcacaaggaccttcggggagggagctcaagggccccccgggggttcctgtgggatccgtggaattcccctcaggccggggagggcggagccccctgtgcctgggccctcctgccccatctgcccagccgtggatatgtgtgtgtctgccagttggtgcctgggctccctggagggaggggcaagcatggacattcctggaaactga

SEQ ID NO: 128757 - DNA, 408 bp, Homo sapiens
ctggactcaagtgatcatcctgcctcagcctcccaagtagctaggactacaggcatgcaccaccatgtccagctaatttttttattttattttattttattttatttggtagagagagggtcttgctatgttgcccaggctggtcttgaactcctggtctcaagcaacctctctgcttcagcctcccaaaatgttgggattacaggcatgagccaccacacctggccttcatttttttagtttattttttaaatgtcattagcaaatatatcttagaattgtcttagtatttaaaggagaattacttattttttactcctctacaagtgaagattgactttaatgttgagaatgttatgcatcaactatatatagacacaaagacatgtttagttctttgatgaaata

SEQ ID NO: 128758 - DNA, 415 bp, Homo sapiens
gagtctcccggggtgggaggaaggagaagacagccctcagtgtaactttatctcccaggcaatgcgctgccacacctggactccctagcatttcctcacctctacaaaagccccagccacaccacaccagaaccacctgctcactcacacgcatggcgcttcagcatgttctaatggtgtagacaggcaagaaatgcgaataatgagagggtttcagatactggtgacagccacaagagaaaagaaaaagcagctgatgtgagagagtgagagtaggaagctattttagagcaagtggtccaagcagaccctctgaggaggtaacattcaagtagaaacctgtgaaacaagaaggtgccagccatgtaaacactcagggaaaagctgtcctggtgggggaatgtgcaaaggccct

SEQ ID NO: 128759 - DNA, 388 bp, Homo sapiens
gtggagttttccagaggctttttgatgtgtgatattgtgagattgaattcagaagcaaatacgagaatccagctgcttttataagggtaaaatttaaaggacattggcaaacgtgttttcctcttctcaccaatttttttgttttctttaaaaataaaaacatagcaggctgggtactgtgggaggctgagttaggaagatcacttgaggccaggagtttgagacctgtccctattttaaaaataaagaaaaagaaaaaaggcaggtacaggggtcaggggtacacacctgtagttcttagctacgtgggaggctgaggtgggaacatcccttgaacccctgagtttgaggctgcagtgagctatgattgtgccactgggtgacagaa

SEQ ID NO: 128760 - DNA, 411 bp, Homo sapiens
gaaggaactgtaataaaattaaacaaaagaaaaaaagtcacaattcaaggatcttactaaagattactcctagccaaggcttcaacagcaagcaatgtgatttggaggaaaggcattcaactgtacatcagaaccctgggtcatggtttaagcttgtcaataactagttatatcacttggcccaagtatcctttgacttctccaggtgggctcagttcctcatctatcttttcatgacactatgaatttgggattgatctaaaaacctattgatctaaaaacctgactattaaacatctagagatagaaccagtgatgcttagtaagtataacaagaattcatatctagctccccaagcataagcagaaattttctacagaaaaatgactaaaatggggggaaaaagaagg

SEQ ID NO: 128761 - DNA, 141 bp, Homo sapiens
ggctcaattgtagaacatgattttaataaccctggcaggaggggatcatttttcttttgtcacttaactccgattctgttggagaaagacgagacatgaaaagagagaaagacaggctgacagagtaaaagagggtactag

SEQ ID NO: 128762 - DNA, 258 bp, Homo sapiens
ccttaccctcacagagagaggaacatcatggggaacagccgtgcaaaggccctgaggcaagaaagaacttgatgcctgaaaatctgggtgtctggagcacagatggggacagatggacagggcagttcattcaggacctcagggctggctgtgctagggtattgattctaaatctcaagaacaatgtccagagagtagtgattgattttaggtggagagtgacatgatccaatttttattttaataagatcacttcca

SEQ ID NO: 128763 - DNA, 705 bp, Homo sapiens
catatgaatgaaatcatacaatatgcagtgttttgtgtctggcttctctcacttagcataatgttttcaaggtttttctatgttgtaacataaatcagtacttcatttttatggctttattcattttcaatttttatgatattccattgtatggatataccacattttcgtttatgaagacatttggatgtttgccatcttctgctactatgaacattcatgtgcaagtttttgtgtgggcttaggtttttaattctcttgggtatatacctaggaatggaattgctgagtcaaatgctaactctgtgtttaacattttaaggaactgacaagtggttttccaaagtagctgcaccatttcacgtgcccaccagcagtggatgagggtctcaatttctccacatccttgcaaaaaacttggttttgtctgtctttttttattataaccatcttaagagtgtaaactagtgtttcattatagttttgatttgcatttccctgatgactaatgatgttgagcatattttcatgtgcttattggccatctgtatatcctctttggagaagtgtctattcaagttattttcttactttttaaattgggttatttgtttttattcttgagtgttgaaagtttcttatgtattctggacataagtctcttctcagatatatgatttgcaaatatttcctcccagttctgcc

SEQ ID NO: 128764 - DNA, 83 bp, Homo sapiens
gtgttaacagtggaaggaaatcacaggtagccagttctcctgtggcagagagcccatactctgaagagaatctggtttctgag

SEQ ID NO: 128765 - DNA, 421 bp, Homo sapiens
ccaaagtccttgagtggatggagctctgcaaataatcaccatgcccaccaggggcaggccaccaggatatggtgttcctcgtctgctttttcccttccttccatttgctgtgctcggtgactccctccagatctgactgcatttttccccagagggccctctcagctttttctgatcgagactttctggccatgcctagacttgggagactgtgggacttgataacagaccctgattcttctttatgagtgaaaagcaggccatagacacagacaggaccacacaggtctaaggaatgactgtgagctcttcttaggtttccagagtaggaatgtcaacctggacattcctacgttaatgtaaccctgcattaaacagaacataaacaccaaagcaagtttgttctccacagaggaccaaa

SEQ ID NO: 128766 - DNA, 800 bp, Homo sapiens
ggaaagaaagagacactgaatgaaagggcttgataactaatggaaagtggggagaagggagaaacaaaggtgaaaagtggttgttaggtttcagatgtggatgattggagggcaggtagcaacattagtaaccacaagaggaaaagcaggtttggggacaagattgagtttggtcacatcaacaataaccatgcatttagtgagttacagtttacaaaatcccttctagatattattttaatctgtcctttggcaattgaagtgcctaggggatatccatgcagaaagatttattcaagaagcaagtggaaatgagtcaaaggacggactggttccttaattatggcactgggaatagtttagaaattacaattccatgagctagctaagctaggaattcctgaactagctaagagcaaacatgctttaaaagaaataatgatggcaacatcttggaaggcaaaatttagatgcccaggcaagaggtgtacagttacttaaagtcaggagagcagtataaaaggtcagtaggaaagagcttcaaaggctcttgctctcattcctacttctcctcagtgtttagatctgacctctccctttccttgagaccacccttaatctctctttcccctctggtatagtttacctggctcttttatgtgcatgtagagagcacacatgtgcctgtgcccaacaccccactctgttcattggtttctgttgtggattgagctcttccaaagcttaacctcagtccatccttgtgttacaagttgaaagcatgcaagctgccctaataa

SEQ ID NO: 128767 - DNA, 702 bp, Homo sapiens
ggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgc

SEQ ID NO: 128768 - DNA, 645 bp, Homo sapiens
caaacactaaaccattgctcttaggagaaatccagggttaccttcttgtgagtctctggtcaaatcatttttgtcatttttgcacaaccttgttttatgtgtgtttctgtttaaagacatcgtatatgtatatgtgattcattaacattgaactcaaggcaaacagcacattacgcatgcctgaatgaagcttatctaacacacatagtctctccctgagtcatatcacagctttgttgtgcttagaaacactagacagccccacagtactatacttgggggtcattgtatacagtgaaattaccaataaaaaacatgacactaaatgggctgcggagagcacactcgattatggtgtgagagccgaagcaagaaggcagctgtttgacttcagctaggaacgtgtgcagcagcctctccaattttccacgatcctctccaattttccacgatccgtgcatgtccacaagtgactgtgaaagtgccagaaatattgacttggaggttacaaataaattttatgcctcctgcagtgactcatgcctgtaattccccgactttgggtggccgaggtgggaggactgctttgagcccaggagttctagaccagcctaggcaacagagcgagactctatctctgcaaaa

SEQ ID NO: 128769 - DNA, 523 bp, Homo sapiens
gaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagac

SEQ ID NO: 128770 - DNA, 334 bp, Homo sapiens
tgctgggattacaggcgtgagccactgtgcctggcgcagtgactttattatttccccttcaatattgtgatggatattttgagtcttttggctctccatataaaattcacaatcagtttgctgatatccacaaatatgctgggagtttggaattgcatgaaatctgtagatgaagttgggaagaagtgacatcttgacagtattgtctttgtatccacaaacatagaatatctctccatttgtgtaatttttttttctttcattagacttttgtagtttttttttcatatagatcttgtatgtattttggtagatttatacctaaatatttcat

SEQ ID NO: 128771 - DNA, 268 bp, Homo sapiens
atgaagtgatgatgcaaatgagtattaggactatgagcaaatgaatgggagcagtaacaaaagtccaaaagtcaggaaaaatgaaaatccacgaacttggcgatgctccagagaggaaaccagcaagtgttgacgctaaactggcagaaacatcaatacttcctggctcccccactgggtgcatcaatttaccaccggcaggctgctcttctgcttcaagtgacaaacagtaagtgctttcaatgacagtatgaaaaggaatgaccca

SEQ ID NO: 128772 - DNA, 188 bp, Homo sapiens
acactaactgattccaagttggtttgcttttgctaagtacacatgtatcacacaaaaaacacacaccaacacattaagaaagctattcccagctggacacgatggcacatgcctgtaatctcagcactttgggaagctgaggcaggaggatcacttgagcccaggagttcgagatcagcctgggcaac

SEQ ID NO: 128773 - DNA, 552 bp, Homo sapiens
ggatgtctcaggacgactagcatatgtttctcaattaaaagcaaaacaatgtgatgccccaggtgattttaattatctggttaagtggctcttctccgaggcaaatcaaatctaaggaaacctccaagagtacttaggtatatcaagaaaccctgtgacaatgtgaaagttcgctgagctgggatggggaccatagctttggctcctgcttctgctggcttattatgtattttccttgggccaaataatcaaagattatggacttcagagttttgttgagatgctttacttctaggggcctacatatctgcatatctaaaataagagaatgagactagattaatatttcccatactaggttctacaaaatgctaattcattgagacctaaacattgactccctagaaataatgcaagatatttcaaacgctcatatggtcaaaaaattcaaattattctgtctctttctgtcttggagattcaaattactatgtctctttcttaattggagattcacaatgcatatttgcagtgctaaaatactaacaaact

SEQ ID NO: 128774 - DNA, 350 bp, Homo sapiens
accgcttccagctccatccatacccctgcaaaggacatcatcttgttcctttttatggaagccctgaaatttgtcccttgagtttcgtgtatattggggaatgtctcagattcccaaatcacaccaattgtaattgctgtattttgagggtggacccctattcaatttctacagggccttcatacagttgttttaatatttttttccatatttttagttgttactacagaatctgaccaagctttttggccattaccactcttatgagttttaaagttgtttctcagcttaggctttccataccctgtgattattgtgaatttggccttacatccaaacatggagctgtc

SEQ ID NO: 128775 - DNA, 556 bp, Homo sapiens
cagaaaactaaagacagagctgttattgtaccatctggtttgcatgaggaatctcttggcatctcttaactgcacattttataaatgctaaatcccagatggcatacattgtaacagtgaagagttttataaaggcttccaaaaacaaattctttcaaatttgaatactggatagtctaagcaggggctaggaatttaaattctacacttgattaaactggctttgttagctgaacaaatttcccttttttcttatgtctttccttcttcctaattattggttctgtgacttgaaaatttcaatccatgtaattcttctaccaacaggtcccctctataactcaagttctagaaaaactgcaggaacgacaatcattggaaaaacctatgttaggtgccattttgtttcaaagatggtagaatttaccacaagggaggtgtgttatagcatccattagcagatcatcaaataccatcaaaaccgttcaactcttacaaagctgatggttggattggaaagacaagcaaatgtaaactccaagcattgtgttgaaat

SEQ ID NO: 128776 - DNA, 240 bp, Homo sapiens
atgttcaaatcctttgatccagaaattctacttcttaggtatttatttttaaaatacataaataatcaacatttcacaggaagatttatatgcaaggatgttgttcatcataatagtatttaatttctaactggaaactaagtggccataatatgaaacagttaaagtcatagaaatatacaatgtaatactatgcagccattaacagaaatgcaagtcctcaaatcattttcaatgaca

SEQ ID NO: 128777 - DNA, 671 bp, Homo sapiens
cagaaggatgaatcaaagcaattttgcaatagttcacagcatgcctgcctggcagtttctcttaggacatcagaagcattctacttgtctccaaatgtcaaggaaatgacaacccttttctatgaaaagtacccaagttctctaatggtcacaggcagttttacaaatgaaaatactttcaggaatttggctcagagtggttaatagtactttcttctcaaagttttccaccttcatcactatggatttatgtcactctcataaatacaaactaggcttagctctatttccagaggtcactgggagaaagtggagagagatcatagcaatgctttctttccttcacttactttttaaaaattttcatttgaaattttaccactgttaaacatgcacgaaactagagccagatagtttttcaaagtattttatgaaaaataccatcccctgtcatagattgatcagttgacagtctcccatttcccacatcttactccccagaggctactactttcaaacttcaggtttttcttttggtatttacttctatgtcactaaacagtatactttcattgatatttgatttatttttagtgttaggaataatctgttgatttctacatggaaaattaatgtttagctctttcaccacctcttgtctcattacacat

SEQ ID NO: 128778 - DNA, 305 bp, Homo sapiens
tggtctccatgtctctgctctggtcttcaaagtattggagatcatagcatattactcccttgcttaagtcattcagtgggttaaatcctacttctcttagggcaaatatcagaatctttgacgagacctgcagggcatggtctggcccctgcctacttgtccaaaactcatcttgctcatatttcacttcttcctctgctccagctacactgaccggagccacatgccctccttttcagttcaatcctcacatattacagatgaagcaatagacaaagtgatatgaaatggtctgctgaaggtca

SEQ ID NO: 128779 - DNA, 385 bp, Homo sapiens
attaaactcatccctaaaacacagcctattccctactggcatcttttggaatctgcaaacatgactctctgaaagaaaaacgttaacctgacaatatttccgatggctaacatttattggatcattaaatttgtgtccacaaaaccctgaggaagatcccagtgtatctattttataaatgaggaaactgaatttagagaggttaaataactcctgtaacatcttaacagctactaactgactatgctccgacacttaaaaaaaatactttttgattgaatgcacgtcaatcacaaggggcggggggcacaaattcaacgtaaaatctaaatagaaaatatcttctagtggccaggggtggtggctcactcctggaattccaaca

SEQ ID NO: 128780 - DNA, 603 bp, Homo sapiens
aaacaataaaatgaacttttttgaactaggagttttgatacatatatatagagagagattcatgaaactgccaccacagtcaccattcaaacagttccatcactctaaaaacttattttgtcctatacccttgtacttacttacactgtctctccatccctcacccttggcaacaactatgctcttctccaccactatagttttaccttttccagaatgttacatatatggaatcataccgtatgctaccttttgaaactggcctcttttgctcagcacaaactctttgagattcatccttgtttttgcaggtataaatagttcattccttttttattgctgagcagtatttcattccatttgataccacagtgggaactaggatgagtgggtccttttgggaaacctcagttaacaatctgggaattctggaaactgtctcagtgaattttcatactttattacattaaatgcattggtctgtctgcattttgaatggatcttttaactatgtttgatactgtaatttcttgcattgatcatttgaagaatattggttttctgaaacacacagatcatctaaatgttgatacatttccttat

SEQ ID NO: 128781 - DNA, 365 bp, Homo sapiens
ctccaccaccatcctagtccaagctgccattgttctttctcctggacaaatacaaaacacttcttgctgttttcccagcctccacactttctcccttccaattcattatgcacaatgtgtccagagtaaaccctttgtttgtttgtttgttttggagacagggtctcactttgtcagtcaggctggagtacagtactacaatcatagctcactatagcctcaaactccagggctcaagcgatcttcccacctcagcctcccaagttgctgagataatgtacaggtgtgcactaccatgcccactcattttttattttttgtagagacaaggtcttgctatgttgcccaggctggcctggaactcc

SEQ ID NO: 128782 - DNA, 205 bp, Homo sapiens
ttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttgga

SEQ ID NO: 128783 - DNA, 173 bp, Homo sapiens
caattctggagtggtagaaacagttgtctaagtgggaaggggttgtggcagcggtctgagggccacagaatatgcctccttccataaggtataaggaagcccctacagttctttagttctgtttctttttcttttttaattttttgagacagggtcttgctctattgcccagg

SEQ ID NO: 128784 - DNA, 369 bp, Homo sapiens
tgttggccaggctggtctcgaactcctggtctcaagtgttctgcccgccttggcctctcaaagtgtggggatcataggcgtgagccactgcacctggcctaactacaaactttcgtgggctgaaaatatttttttctcattcactagatttttagttattataaagaaaggtgatatgaacatttatgtacaagttttgtttggacatatgttttaatttctcttggataaataaatatctagtcatggaatgactcctaaagaaaccttctgccaacacttgttcacatatcaccaacactatgaatgatcaattcttttaatttagtatatagtgacatgtcattataggctttttttttttttttt

SEQ ID NO: 128785 - DNA, 117 bp, Homo sapiens
catctaataagcatttcagaacaaaacacaaggagaaacaacctaagaaataattcaagtctgggtgcgatggctcacgcccgtaattccaacactttgggatgctgaggtgggaga

SEQ ID NO: 128786 - DNA, 456 bp, Homo sapiens
tgttttcccagggaccagagaaggaaaaggggttagtaatgttgagtaaaatgctcaaacaaaaacgtcaaagtctgcttaatataatgcttaaagacaaagggccagaattctcatcgctgtttaaaagttgcaaaagggctgctgccccctctttctctctggaaatgcaccctctcaaccactagtggtaatgctcttttgacaaacaagaaaacttctactcagatctacagcttctactaactgggtaacaaagactcaaacgggttccagtaggaagaaggaaggaaaaacacaaggctgaacatgacattcccctttacacacaccacttatgcacttccaaatactttcacacgtgtttcttttcttctctactttcaagtgtagagtagagaataacttcccctgtaaagtactgagagggaactctgtggccctggagacacccac

SEQ ID NO: 128787 - DNA, 582 bp, Homo sapiens
aagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggtgaggccagggctggggtctcgggaaggagccgagagagggtcctggctcctaggtggggcctgccttagcacagaccagtggggagcagccttcccctcagccagtttcaagacctttattgaatcataggggtttaaacatgtatatatggtcctatagcttcagtgacctattgtattgaagagaagaatgttatgaagaaacagatttcgtaaccattaaaacgttcatgcttagggcacacaaagagga

SEQ ID NO: 128788 - DNA, 1547 bp, Homo sapiens
aagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 128789 - DNA, 517 bp, Homo sapiens
caggttcaagcattcccagggctggctctgatcccgataaagcccatcatcatgaatgaatgcctcctttgcaggttattctaagtattgtaaatagtgcacatggagcgtcctcatgatgcctgggatggtagtgaatatttataggtttcttttagtgcctttttttttttttttagcgttttccatagttccatgtttctacaaggcataggaacatcagaatcatgtgtgtgtgggtgcttattaaataaaccaattcctggagctcactcccagtgactcccagtctgatgattaggggctcagttaggacctatgtttgcaaaagctcccaggtgatctcatgcagccagcctggctctggctctggctctggctctgggagctgggttgggaactagtctttggtgctattctgctgaaacttcaagttgggctctttgactctgtcttgtattgtcaccatttgtattcaggtctgttttccccctggattgtaaactccctgatgtct

SEQ ID NO: 128790 - DNA, 439 bp, Homo sapiens
atcccagcactttggtgggccaaagtgggcagatcatttgagcccaggagtttgagaccagcctgggcaacataataaaacccgtctcgaccaaatatagaaaaattcgtcaggcatggtggtgcacacctgtagttccctgtagttccagctatactagaggctgaggtgggaggctcgcctgagcccagggaagctgagcctgcagtgagccatgaccacgccagtgcactccagtctggacaacaaagtgaaactctgtcctcaaaaaatcccccaaatcaaaaaaagccagtgatgtctattttaagctaaggccaatccttccattaatgctttgcatttcatatcctctagcccactcagaaagagttttaatcaaagtttcatcatctcacttgttttaatgagctctcactagctgtagtattgacaacag

SEQ ID NO: 128791 - DNA, 244 bp, Homo sapiens
cagctactcgagaggctgaggcaggaaaatcgcttgaatccggggggcagaggttttagtaagccaagatctcgccattgcactccagcctgggcgacatagcgagactttgtctcaaaaaaaaaaaaaaaatggataatttttattccatttgcctcaattcctcataagtgccagttagactcctggaggggaaaagaaatgagtggtagaattcagtcaacaattcagtcacctgaattca

SEQ ID NO: 128792 - DNA, 263 bp, Homo sapiens
actacacataagaatcacatgaagaacttaataagattctgtgtgctggggcctagtttactgaaaaatttctcagttgtgtctaatatgcaagacaggatggaaaacgactgatctaaagtaaagatcttgtgttgtaatctaaattcttctcataatgagatctattattaatcttcagtacttggcatataatgggcacccagcataagaaaatctggatagctgctacataaaaatgtcagtcaggcttgaaaagatcc

SEQ ID NO: 128793 - DNA, 142 bp, Homo sapiens
gtgggtgagtcagtagttatgtgcatgggagtgtaaaagtgtagggggtgtgagcgtgtgtgcttgtgagaatgtatgaacgtgcatgtgtgaaactgagttttgtaagtgtgtctgtgtgtgtttctatgtatgcctatgc

SEQ ID NO: 128794 - DNA, 396 bp, Homo sapiens
ctcgaactcctgtcctggcctcaaccgatcctcctgcctcagcctctattttttattttttagtcttaacctagcaaaagatggttgatttaagcacactttgatatctatgcctatattagctctgtaatgtcagtaaattaagagtttcttccgtgagctccagttaggatggtacatcccagtgaagagaaccttacgatgtgatttggtatgttgttgtttcaacttttctgcatgtcctttcctagcaaagaagtctaaagctgtattgttgccttagaggaagtacaaaaaatccaccatctgcctttagataggatgctcacctgtcacccactagccacaacagaaaatgtctgtgtttgagcacttctcatacttggaggacccgtg

SEQ ID NO: 128795 - DNA, 159 bp, Homo sapiens
aagttggtgggtaagaaaggaagaagagaaaatctctatcttcctcatttgtgaccaactctgatgtgtattctacatatacagcactccagagtttccctatgagatgggatccagtttccctcagaaggctggcttgacacacacttacttactttt

SEQ ID NO: 128796 - DNA, 670 bp, Homo sapiens
gcagcacacagctgatccaaagattttggatataggtgtgagtgcagcacatacttctaatagtgaaggcagtgaatatttgtaattagcgatacctagaagtgatttggctactgtaccacatcaattttggccacctccagtctctggcaatactattttgtgtcctgggagcaattcttgtggatatggagaataaaggttattgatagtgtaggggattttcaaagacattaaggaaggctaagaggttgcattggctgtaggattggaggcctaggaagccttctgcctgatgcccattgaacatccctggagaatgctggatttttagtttgcacccttagcagaactgtaactcatttctggaccaggagccagagttatttattagatgtataagttatattaagatgtttaagttacatatttgtccttgagcctgtaaaactcagattggactgggcatggtggcttacgcctgtaatcccagcactttgggaggctgaggcaggcagatcacctgaggtcaggagttcaagaccagcctggccaacatggtgaaaccccgtctgtactaaaaatacaaaaaatcagccaggcgtggtggcgtgtgcctgtaatcccagctactcgggaggctgaggcataagaatcgcttgaacctggg

SEQ ID NO: 128797 - DNA, 501 bp, Homo sapiens
taaaggaacttgcccaaggtcacacagccagtaaatggcagagccaggattcaaacccacgcagtctggctccagagcccacatatgtaagcactatactattaagaagacaacaattcctatacttactagcttcatgaaagtaaaaacatttgcaggttttgctttgaaagatccaagtgaatgctactagaaaaatacaaagaataatgtactttttttatcttaagcactagccaaggaaacaaagaaggagcagaattcactgtacccaagtactgtgtggttattttgatacaagtcaacaactacagcagatgctggtatccatcttcctgacaggtgacaggtagtaccaacactcttcagatcatgagacctcaaaatactcattttatcctgacagcaggggtgagaaataacatgtaaatcatcatggggagatggaggcctaagtaaatattccaggaaaagggctcctttagcataaagtagcctttt

SEQ ID NO: 128798 - DNA, 343 bp, Homo sapiens
gcctcccaaagtgctaggattactgcaccaggcccacatgtcattattttaaatgactacatcagattttatctgatggacatatatacattatttaatattcccattgttggacccttacatgagttccaattttttctagacaaatatccacataggtaagacttagaagaaattcatattatttcattaggataaatttctaaaaatgggagcagtgggccaaagggcatatacatcttttaggtttttcatataaattgccaatttatattcccatgagaagggtatgagagtacctgttttctcaagccctttgctgacagctacgttagtgcttagg

SEQ ID NO: 128799 - DNA, 358 bp, Homo sapiens
gtcttcagctggttgttaatttatcaatgtcagggccagtgtctgtcacttcactcagtccctagcccagaatcgtgaccagcagatgcctaatcggttctagcatgataaatatgccaggcctctcactaaaccctccttgtccttccttcattcattcattcactccacatgcatcaaatgcctgatttctatagtgagaatataaaatcaggcccaggcaatttaatccttttctgaagcgtggatgtgttgaaactactaactttaactcatttatacagcgagaatctaataacaaacaagacctggtttctgcctgcattgtgctcattttcagccctttcctagattaggc

SEQ ID NO: 128800 - DNA, 645 bp, Homo sapiens
ccattctcctgcctcagcctcctgaggagctgggactacaggcgcctgccaccatgcctggctaattttttgtatttttagtagagatggggtttcgccatgttagccaagatggtgtcgatctcctgatctcgtgatccacatgcctcggcctcccaaagtgctgggattgcaggtgtgagccaccatgcccggcgaggtggtgatttttttgtttttttgttttgttttgttttgtttttttgaggcatggtctccctctattgcccaggctggatggaatagagtggtgcaatcatagctcactgtagccttgaactcgtgggctcaagcgatcctgtcatctcagcctcccaagtagctagaacgacagatgcagcccccccacatctggctatttttttctctttctttctttttttgtagaggcagggttttgccatgttgcccagactggtctgaaactcctggcctcaagcaatcctcccacatgggtcgcccaaagtactgggattataggcgtgagccactgcacctggtctggttcagagagtttaacaggcattgccttaagcaaaatattggacaaactgaggagtttctaatatgcctgttgtgccctttctccacctctgtgaccttccc

SEQ ID NO: 128801 - DNA, 784 bp, Homo sapiens
cttctaaaaaaaaagaaaaacagaactaactagagattattggctgcacaaacccatcagcacctgccagtttttaaatttcattttggaaaatcagccatcacttaagggacttgtccataatagcttcattaaagctttgttttttatcaaaagggggccacatatgtaaacttgtggaagtaatttacctcctctactcttgtctttttatttgattgcaaaagttaatgttattaaagttgctatggaagcattaatgttcagcctgaacaagagcttgacgaacttctttatacaagcaataacactctgcaaccccattttatgagatatttttcatgatgtagacatttactttcttagcacaagtgatctcttaagattaatttcttttccattttccttcagttttaaatgatgtaatatagtaatctttataacatgatcagccaagtataatttgagaagtcagttctgttggcaaatatctgaaggacaaaaccaaagccaccctagctgaggtttttgtcccttccttctttcatttaccaaaaaccttaattgggttaacagtaggggaattttagaaatcatgttttcctaatgtaacctgtgaaacaaaagcaaaatagattaaggcaaggggaaaaatgaacttaccaagagtgttctttttcctaagtaaaaaccacaaattttatagttttttaaattttagactttctcaatcctttttttcacatttaattattctcataagtatacatagaagagagaatgt

SEQ ID NO: 128802 - DNA, 263 bp, Homo sapiens
gggcacccagctgcaccagcctgcaactgcctttgggaaaccgaggaggcgaggctcaactctccgatttgaaggcagcagaatcattgatcaaggcatagaggtgctcaggtttgcctctcggagtggcatgatggtcaggtgctcaggatccagagctagacctggatcccaattctgcctagctcttagtagctgcatgacttacctcactcagcctcgatgttctcatctgtaaaatgggacttacattataccactca

SEQ ID NO: 128803 - DNA, 407 bp, Homo sapiens
cgttgagcagctgagaagcggtactttggagctggtacgggaacagatgcaacaccagcctgctcagcatcgaactggactgggaggcagggttgggtgtctggagccctgggcaggcagcaggatgtgggtggtgagtggataaggggtctgcagaggagctggagaaggtgcagccagggaggggaacagaaagcaggctctgagtggacaagcaagactctgctgggcagtgcatggaaaggactctgtatgctgcagtgggaacagcctacacaaaggctcagaggcctcaataaaccagccatatttggagaggactaatggagagacaggagagaccacaccgccttcctgcccacacttggccacacaggggctaggggctgtgggcaagcgcatgcctg

SEQ ID NO: 128804 - DNA, 542 bp, Homo sapiens
gcctgtagcctccaccagcctgaggggtactggtgccatcataaggtgaagccagagaagaaagccaggtaaaaaaggacaggaggtcctgcctgcccaaggaaggaggaagaaatagcacgtgcaggagaaggagccaccagcacctgcagagcctgccctgaatgctgaggttgggatgggccacctggactgggtattgaatggagggccctgtggggagagagcacagaaacaggtgcatgctgccatcaccagacccccactgtgccctgcctcggcacaggacccgcagcaaccaggggaagctcctcatgcttcctctgggtcacccacaggcaaagtctttccaggtgtgctcacaaaccattcttccagcccccagaaccatgcaggaacccgtcactcagcttcggtgcatcaagaaggccttctctgcaaatccacctcctcacacaagcaactttccagaccccctggggggtggctgattcttctctggaagcacagctctacacacacatgcacacagctctgtgttc

SEQ ID NO: 128805 - DNA, 515 bp, Homo sapiens
aaaaataaaaataaaaaaataaaatagtctcttctcaaagtgatctgttcgaataaaaatgcgggggtgggggctgaagaggaggaaacgatttttggttttaaattgaaagatgaatttctaacttgttattgaaatggtcacgacacatgaagtgagtttaatatggaactataattagtaaaaaacaaagctggaaagaagaactaggataccagttaacacattttgtttctgctgataagaaagtcagtggaagttagtgtttctatgcatcaggaggttgagttttctttttttctttttcttttttttgagacggagtctcgctgagttgcccaggctaaagtgcagtggtgcgatctcggctcactgcaagctccgcctcccgggttcaccccattctcctgccaggaggttgagttttctaacacgcacttcatacagggatttagatttcagattctatgtttccaaatactttctccatctactgagttggaagaaactagaga

SEQ ID NO: 128806 - DNA, 351 bp, Homo sapiens
gtgagccgagattgcaccactgcactccagcctaggtgacagagtgagactgtctcaaaacgaaaacaaaaacatcttgctatacaaccaaaaggggaaagtcatacacttaggaattttaaatatgcaagtcaaagagcctttgaggtaccccacagatgactatcagataattcttcccttttatacaattcctatattacatcacttgatcacaaagttaaaattttactttaaaaggaatccctcattcattcacacttgagtcatcccacctggccactcccctgcttcccaccccttccccatccctttaaggtggtattctttagccattcccttcctgaataa

SEQ ID NO: 128807 - DNA, 895 bp, Homo sapiens
aaccaaaaagatattatttcaaagcctggttctgtcatttgccaacgatcttatttttgttatgaagttagtgaatgtccctaagactcagtttttccatcttaaaaatggggtaataatacacttgtcagagtgatttttgtttaaattattttgtgtctgggaagtgcctaacaacagcagctgttattatgaggaaattttgttattattactttaggtcaccttggaacctcacttttaatgctgctgtcatctgtacacccagccagtacagcctgattgcattgtggtccctttagtgcttatggaatagcttgcttataagaacttttacaggactgtattcatacaccaaatgtgagtgtctcaaaaaatggcacaagaagcccagtgggacatggtggcatttgtgcctctcagaaccctgaagttatttgtatgtgttgtttttacatcatccagcagcattttaatatgttgtaggacttaatgccataaacagtttctgtttttcaacaaatgtactggatttcttgatttggtttcttagttcattgtcagaagtaacttgttttaaaaatgcacagcaaagttctgtattgatgaatatcataagttttgtgtgctctagtttttgaggacaaggccttctaaatcaggctgagtgcttcaaaggagatcttattatctttatgacaaacatgtagcaattctgaggtctgccatcctcaatacatagtcacacacacatacacacacacactcctacatcatttgcattatttttgtttctttataatagcatttatcatatttgtaacaacctaatttaattcttgctaattgtgtatctttcccatcatactcttaataaaagaagatatattatttc

SEQ ID NO: 128808 - DNA, 318 bp, Homo sapiens
ctgctccgcccctctctgctagtagcaccctgatcttcctctgaggagccaccccctgtgcctggctgagcccttatgcttgaggggggctctgcccacatctccagaccaagtccacaaatgccagtccctcaggcccaagctaaagtcagggtcagacacaggactccgcagagccatctggggtgaacaagaggcttctgggggcgttttcttccactggagctggcctgtgtggggcttccccaaacatgaaggcccaggaaaagcctgtgtgcaaccccagaaatgagacagaactagaggcggagcaggggt

SEQ ID NO: 128809 - DNA, 835 bp, Homo sapiens
gtgtaatttctgagatgcttaaagatataataaaatttatattgttataccaatcttaagagtgcctaggaaaactttaaagaaccacccaagaaactgccatttaattctgtctaaatatattttgtccaagttaagaaaaggaaagatattttgttcgtataattattttgccttctgcaagctccctttcatcatatgctgaatctctagcaggttagatcattaaacttttcagatgaaaaaaaaagatggttggggaaagactagttagtacctgattgggcaaatgtgggtcgagttttgaaaacctttttatttttttagatgagtttccctgagtttttgtttactcaatttataaggtatgtaagaatacatcattagttcttaccttgacctttcctaaatcttttgtgtcattaaatagaacaaggctatgcagttaaaatatttatttgaaagtttttagaatcctaataattttgcttactttaattaattactgtcaaattgtgatagtaattgttagtcctaaattgttaagaactttattttaaatttgttttcccataattttccccaaaattgttttatttcttaagcaatccaaaacataaccagccacagccacataaaaatttttaataaaaactttattgagatataattcacacaccatataactcacccatttaaagtatgtaattcaatggttgtttagtacatatacagttttgtagctggcactataatccatttcagaatattttcatcattatcccaaaaagaaaccctgtacccactagtagtcacttcccatttcctcccaaca

SEQ ID NO: 128810 - DNA, 282 bp, Homo sapiens
acctgccgctgcggggagtgttggagggaaagtgagacagggagtgggccggttcgagaaggaaactgactggtggctgagaagagggaacctcctggagtttgagagtttatgccattcccttccccaagagagcagtctcaggggacttcggaggccttgagaagggaggatcgttaccccttgaactctgcctgacatccccacctaagatacccatctcccattcctcgggccagagggaagagcttagatggggaacttccccaccccacccatccc

SEQ ID NO: 128811 - DNA, 227 bp, Homo sapiens
ggtcctgagtagctgggattagaggcatgtgctaccatgcctggctatttttgtatttttttagtagagtccgggtttcactgtgttgcactggctggtctcctgacctcaactgatgtgtgcatcttggccttccacagtgttggaactataggcgtgagccaccgcacctggcctactcctgtgttcttagcttgagttcctggttgatgggtggtgccaccaat

SEQ ID NO: 128812 - DNA, 647 bp, Homo sapiens
ggaaatgaaattagttttttgttgttttgttttgtttcgagacggactctcactctgtcacccaggctggagtgcaatggtgtgatcttggctcactgcaacctccgcctcccaggttcaagcgattctcctgcctcagcctctgaaatagttgggattacaggcacctgccaccacacccagctaatttttgtatttttagtagagatggggtttcaccatgttggtcaagctggtctggagctcctgacctcaagcaatccaccctcctcagcctcccaaagtgttgggattatgtgcgtgagccactgcacctggcctaggttattttaaagtaagaactattaatccagaatgttagtgggaatttttttatacacagcatatcttttaattttttcttacctttcttgaaaatttccttgttaaatgatgcaaaatatgatatgacagattataggtattttaaagaagagtatgggttatagaaacatctgttgttctaaaggccacctgtagatggcattgcttgactttgtctttaaatgttttctagaaaggaagttgttaaaatagaatctactttgaaatgcaatcacattttaaaggtgaacgaaattagattaaaaaaaaaagcctaccttttg

SEQ ID NO: 128813 - DNA, 322 bp, Homo sapiens
ttcttgtcgctgttcattcacccaagttgcaaacgtgtgacctgtaaaggccttgaggctggttggtggcctggccagcgggcccagtctcggaccgtggcccagtgccagcagccgggagtatccagcctgtaactgggcactaagccagcctgggcaggaatcatcggaagatggggcagggcttgaggtcgaggccttggtagcctgactttgcatccagttcctgcactcccagctctataccttctttgtttcagtttctacttctctgagtttcagtttctttgtctgtaaaatgggaataaggatcagactgacc

SEQ ID NO: 128814 - DNA, 156 bp, Homo sapiens
tgcagtctctcaagggcaggaaaggaggagccttaggaattgtatagtccgcttccctcattttacagatacagagagaggttcagagaggtaaagtgactttttccaggttgcagagctgacagaattgcagaacaagaatccaaattggattct

SEQ ID NO: 128815 - DNA, 463 bp, Homo sapiens
gcctaatagacatggaggtcacagaatgagagatggggcataaaacatctattagtggaagaaaattgaacctatgcataaaatgcattttcatccaaaaagtattttttatttttttattttttatttttatttcttattttttgagacagagtttctctcttattgcccaggctggagtgcaataatacgatcttggttcactgcaatctctgcctcccgggttcaagtaattctcctgcctcagcctcctgagtagctgggttacaggcacccaccaccatgcccagctaatgtttttgtatttttagtagagacagggtttcaccatgttggccaggccggtcttgaactcttggcctcaagtgatctacccgcctcggcctcccaaagtgctaggattacaggtgttggccaccccaaccggcccaaaaagtgtttttgagatgcagtgacctgatgt

SEQ ID NO: 128816 - DNA, 547 bp, Homo sapiens
tccctatcacccagattccccaatttttaatttttcatttgctccatttttctttttttttaaaaaaatagatacactcccctaagcatatacgtatacccataattagtcttttctgaagtatccaagaacaagcagcagacatgattcctatcaaccctaaatactccagtacttcttaagacaaggacattcttctacagaatcaccatataagcctttgagtcagaaaatcaacatttatacaacactactatcaatctacagacatcattcaaactttgtcaactgccccagtatcgtcaggacattcattctcctcccatattctcagtctctccaggtctttcatgttcttgacatttttccaaagatacagaaccttcattctgtaggctaatcataaacttagatctatctactatttcctcatgatcatgctttttgggcagggaaaccactaacatgatactctgctcttttcaaggctacacatcaaggtgatgtgccatacatgaagttgacccacttgtgatgtcaaccttga
